United States Patent 9,290,773 (TRANSGENIC PLANTS WITH ENHANCED AGRONOMIC TRAITS) - sequence listing, part 4

SEQ ID NO: 14248 - protein, 533 aa, Caenorhabditis elegans
MSLIRRLSVVLIGLLLILGYAQAECDEKEEEVFPSRYPIAYFKWEEVKIPMTICLWLIAASISKIVFNSIPHLNDLFPDSALLIMIGLIIGIIFKLIGVDKNQFFLESEIFMLYLLPPLVFDAGYFMPARQFFDNFGSIMCFAMIGTLFNFLAISFSLWAISLTGLFSVETPLLHMLLFGSVAADVDPVAVIVIFEELAVNDVLFIAVFGESLFNDGVSVVLYRMFLTFSEIGAENLIPEDFANGGVSFLVVVFGGVGIGVLFAFLASLLTKYSRAEEISILNCVFILILPYTCYLCGELFGLSSIIAVVFCGALMRQYCRENVEQETVKATEKFIKVLSIASETVIFVFLGLSTVSSNHHWDTCFIVLTVVFCLIYRTLGVVVMCHFLNKYRLNKYTKVDQFIMAYGGLRGAIAYGLVVAIPDFIPAKNMFVTSCIIVIYFTVFLQGITLKPIAEFLQVEKKNVHSKNMIEHIYTELIDTTMAGMEDIAGFKGHHWIRDSWNYFNNCYLRPVLVNKNNMKQMDKTKLVRKYK

SEQ ID NO: 14249 - protein, 231 aa, Echinochloa crus-galli var. formosensis
VLPVFTGECKECAHCKSAESNMCDLLRINTDRGVMIGDGKSRFSINGKPIYHFVGTSTFSEYTVMHVGCVAKINPVAPLDKVCVLSCGISTGLGASINVAKPPKGSTVAIFGLGAVGLAAAEGARIAGASRIIGVDLNAARFEEARKFGCTEFVNPKDHDKPVQQVLAEMTNGGVDRSVECTGNINAMIQAFECVHDGWGTAVLVGVPHKDAEFKTHPMNFLNERTLKGTF

SEQ ID NO: 14250 - protein, 772 aa, Sus scrofa
MASLLQGLSASPGSGLPINQDLLLMQKGMLMRKVRSKSWKKLRYYRLQDDGMTVWHARQAGGRAKPSFSISDVETVRGGHESELLRNLAEEFPLEQGFTIVFHGRRSNLDLVANSVEEAQVWMQGLQLLVDFVTNMDQQERLDQWLSDWFQRGDKNQDGRMSFGEVQRLLHLMNVEMDQEHAFQLFQTADTSQSGTLEGEEFVEFYKSLTKRAEVQELFENFSSDGQKLTLLEFVDFLQEEQKEGERASDLALELIDRHEPSDSGKLRHVLSLDGFLSYLCSKDGDIFNPTCLPIYQDMTQPLNHYFINSSHNTYLVGDQLCGQSSVEGYIRALKRGCRCVEVDIWDGPNGEPVVYHGHTLTSRIPFKDVVAAIAQYAFQTSDYPVILSLENHCSWEQQEMIAHHLTEILGEQLLSTTLDGQLPTQLPSPEELRRKILVKGKKLRTLEEDLEEEEEEPEESELEGEQEAELELEAQFESEPQELSPRSKDKKKKVKAILCPALSALVVYLKAVSFYSFAHSREHYRFYEISSFSEAKAKSLIKESGNEFVQHNTWQLSRVYPGGLRTDSSNYNPQEFWNAGCQMVAMNMQTAGLEMDLCDGLFRQNAGCGYVLKPDFLRDAQSSFHPERPISPSKAQTLLIQVISGQQLPKVDDSKEGSIVDPLVRVEIFGVRPDTARQETSYVENNGFNPYWGQTLCFRVLVPELALLRFVVKDYDWKSRNDFVGQYTLPWNCMQQGYRHIHLLSKDGISLHPASIFVHICIREGIEGVES

SEQ ID NO: 14251 - protein, 312 aa, Babesia bovis
MARMSKQEKKKAYFERLTHLVKTYPQILIVSVDYVGSRQMAHVRHSLRGKAEILIGKNTMIRMVLNTSFPNSEAISKLLSCVKLNVGFVFCMGDPLEVRRIILDNKVPAPAKQGVIAPCDVFISAGATGMDPSQTSFFQALGISTKIVKGQIEIQNDVHLIKVNDRVTASSATLLQKLNMKPFAYGLKIEKFYDSGHLVEASALDITEDDILDSVKTAVTNVNAFALAIGFPTSLSITHSLIGAFKNCVALALENDYCFKEMQGIKDRLDNPELFAAAAPTAGAVEAVQEAAPEAAEEPEEEEDDMGFSLFD

SEQ ID NO: 14252 - protein, 353 aa, Leptosphaeria maculans
MGCGMSTEEKEGKQRNEEIENQLKRDKMMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQHETKQIYTHFTCATDTMQIRFVMAAVNDIIIQENLRLCGLI

SEQ ID NO: 14253 - protein, 520 aa, Trametes pubescens
MSRFQSLLAFVVASLAAVAHAGIGPVADLTISNAAVSPDGFSRQAVVVNGGTPGPLITGNKGDNFQLNVIDNLTNHTMLKSTSIHWHGFFQKGTNWADGPAFINQCPISSGNSFLYNFQVPDQAGTFWYHSHLSTQYCDGLRGPFVVYDPNDPSADLYDVDNDDTVITLVDWYHVAAKLGPAFPLGADATLINGKGRSPSTTTADLAVISVTAGKRYRFRLVSLSCDPNYVFSIDGHNMTIIETDSINTQPLVVDSIQIFAAQRYSFVLEANQAVDNYWIRANPNFGNVGFTGGINSAILRYDGAAAIEPTTTQTTSTQPLNEVNLHPLVATAVPGSPVAGGVDLAINMAFNFNGTNFFINGASFTPPTVPVLLQIISGAQNAQDLLPSGSVYSLPSNADIEISFPATTAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDPSDQ

SEQ ID NO: 14254 - protein, 526 aa, Trametes pubescens
MGKFHSFVNLALSLSLSGRVFGAIGPVTDLTISNADVTPDGITRAAVLANSVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSINGHNMTIIEVDGVNHESLDVDSIQIFAGQRYSFILNANQTIDNYWIRAIPNVGTTDTTGGVNSAILRYDTAEEIEPTTNATTSVIPLAETDLVPLDNPAAPGDPQVGGVDLAMSLDFSFNGSNFFINNETFVPPTVPVLLQILSGAQDAASLLPNGSVYTLPANSTIEISFPIITTDGASNAPGAPHPFHLHGHTFSVVRSAGSSTFNYANPVRRDTVSTGNSGDNVTIRFTTDNPGPWFLHCHIDFHLEAGFAIVFAEDTADTASVNPVPTAWSDLCPTYDALDSSDL

SEQ ID NO: 14255 - protein, 139 aa, Arabidopsis lyrata subsp. petraea
STGKRSEREEDTDPQGSRGISDDEDGDNSRKKLRLSKDQSVILEETFKDHSTLNPKQKQALAKQLGLRARQVEVWFQNRRARTKLKQTEVDCEFLRRCCENLTEENRRLQKEVTELRALKLSPQFYMHMSPPTTLTMCP

SEQ ID NO: 14256 - protein, 505 aa, Arabidopsis lyrata subsp. lyrata
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALT

SEQ ID NO: 14257 - protein, 246 aa, Ovis aries
MAAMQFLWGSAPGWEEPPTGAEHQGFHVAQLRCPGIYKPFIIGISLMAFQQLSGVNAVMFYAETIFEEAKFKDSSLASVVVGVIQVLFTATAALIMDRAGRRLLLTLSGVVMVFSTSAFGAYFKLTEGGPSNSSHVDLPAPVSMEPANTNVGLAWLAVGSMCLFIAGFAVGWGPIPWLLMSEIFPLHVKGVATGVCVLTNWFMAFLVTKEFSSLMEVLRPYGAFWLASAFCIFGVLFTLACVPETK

SEQ ID NO: 14258 - protein, 935 aa, Acinetobacter baumannii
MSNFNKTLSKRLRLNHAYGQLIALIFVPIMILTCVGAFLVLTETSRSAKQQQLHHASAILARYNQIAKDLYTLVELQPDEYDHAQHIMQSMFSEKNLKRAALIDSNGQTYLSIGYRDNRYWPNFTQNNNFFGPISYNHNNIYGVRIIDTAGKPPVWLLIEMDNQPLELARYRILIALVITGLMTLLLLLLCLNFYSRRWIAPMYEIRMQLQRLNADTLDQHIVINSSGELRLLQRDIANVVKRLHFSFLELKEHTEQTEEDLRRTLDTLEVQNITYRQARDQAISSNQAKSVFLANISHELRTPLNSIDGFIHLLLRQQNLSNEQNLYLQTIRKSSAHLLALINDVLDFSKIDAGKLELETAPFDLEEAVFDVMDMLSPLAAQKHIAMAFYYADNIPQQVIGDALRFKQILTNLISNAIKFTPDGEIIVRVRMEHDDIGQCLLHFSVQDSGIGLSGTDRKKLFESFSQGDASVTRQFGGTGLGLAISKQLVHLMHGQIGFEDNQERAPTEKGSTFWFTAQFAVDEEHEIEHPHFEHLQVVSYLAHPATASVLRYYLENYQVPHIETQSILDLFSRLKHLDQKDNTWLIVDHSGDTEALLKEIRSRYQGNLAVYGYQMTLEPNMLTEYRARPLYQPLSRSGLIQLLSDQPIFEEEQQDFNGQGLHILAVDDHLPNLIVLEALLGELNVKTTKALSGQEALNIIQERIDQKLKPFDLVFMDIQMPVMSGIDTTRAIRSLESTLDGEMQLPIIALTAHALADEKQKLLKVGMNDYVTKPIQMEQIIQILTQWTKNNFTAQNLAKDHHVVAEALDPEILNWQQSLQLAANKEDLAQDLLKMLVDSFPTELEEMQQLIELEDFPQLEHVLHRLYGATRYVGTPKLQQVTGDFEQFISTLRKERRRADDGFIEEVMRRFDELGLVIKEVESAAHQILVIPD

SEQ ID NO: 14259 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 14260 - protein, 925 aa, Oryza sativa (japonica cultivar-group)
MHADVVARRIENLENMCDERARMLQDQFNVSMNHVHALAILVSTFHHGKNPSAIDQKTFEDFTARTTFERPLMSGVAYALKVLHSERELFEQKLGWKIKKMETEDQSLVHDYNPEKLQPSPVQDEYAPVIFSQETVKHIISVDMMSGKEDRDNILRSRATGKGALTAPFPLLKSNHLGVVLTFTVYKYDLPPDATPEERIEATLGYLGASFDVPSLVERLLEQLASKQKIVVRLYDITNHTYPTKMYDSDVIASDDLHISNIDFGDPTRKHVMHCRFKHAPSLPWSAIMISSAVAIIVLLVGYIIYATLNSLEEAEDNYTTMRDLKGRAEAADVAKSQFLATVSHEIRTPMNGVLGMLQMLMDTELDTTQRDFVVTAQESGKSLINLINEVLDLAKIESGKIELEAVRFDVRDILDNVVSLFSEKSWAKGIELAVLVSDQVPDVLIGDPWRFRQIITNLVGNSMKFTEQGHIFIRVHLIEEVKRKMEALDDTSPENIEVTANSKNTMPYNTLSGLEVANNRKTLESFRMFKDSSDAIDSVNLLVTVEDTGIGITKDAQTRIFTPFMQADGSTSRTYGGTGIGLSITKRLVELMGGEIGFVSKPGVSSTFSFTAIFKENRKDPGDIKRYCPEPTPPDFQGMRALVVDGRCARAEVTMYHLRRLGIQCDLAATSESALSALLESCNSSVKSSLNMVLVDKEAWGEDSGLAFFRCLIDLRLKGTLKSWQTMPKFFLLAGSITPADSDCLRLAGYSNSIRKPLRLSTVAACLSKALGVGLTGRRSRDNSLVLRSVLTGKNILVVDDNAVNRIVAAGALKKYGAIVTCVDSGKEAISRLQPPHKFDACFMDVQMPEMDGFEATRLVRSVESKINDTIQAASAKNPFGDNNIAKQKSYAVNREQKFDWTAIYVSFDNWMKSISTSRLQPCA

SEQ ID NO: 14261 - protein, 475 aa, Oryza sativa (japonica cultivar-group)
MGALLSSPNSKNQPWEHGEASKADSSKKLRMSAPPLSGGYDHPGLIPGLPDEISLQILARMPRMGYLNAKMVSRSWKAAITGVELYRVRKELGVSEEWLYMLTKSDDGKLVWNAFDPVCGQWQRLPLMPGISHGGECKRGIPGLWLGDLLSAGIRVSDVIRGWLGQRDSLDRLPFCGCAIGTVNGCIYVLGGFSRGSAMKCVWRYDPFVNAWQEVSSMSTGRAFCKASLLNNKLYVVGGVSKGKNGLAPLQSAEVFDPRTGIWVEVPDIPFSKAQALPTAFLAELLKPIATGMTSFGGKLYVPQSLYSWPFFVDVGGEIFDPETNSWAEMPVGMGEGWPARQAGTKLSAVIDGDLYALEPSTSSDRGKIKIYDPQEDAWKVAIGQVPVGDFAESECPYLLAGFLGKLNLIIKDVDSKINIMQTDVLKPVELSAPGNGPTCQNQQLSSEQETNLWKVIVSKNLAAAELVSCQVLNI

SEQ ID NO: 14262 - protein, 492 aa, Rattus norvegicus
MEPSSKKVTGRLMLAVGGAVLGSLQFGYNTGVINAPQKVIEEFYNQTWNHRYGESIPSTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNADLWPLLLSVIFIPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLEQLPWMSYLSIVAIFGFVAFFEVGPGPIPWFIVAELFSQGPRPAAVAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 14263 - protein, 746 aa, Rattus norvegicus
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPPRVSAGCRDLITRMLQRDPKRRASLEEIESHPWLQGVDPSPATKYNIPLVSYKNLSEEEHNSIIQRMVLGDIADRDAIVEALETNRYNHITATYFLLAERILREKQEKEIQTRSASPSNIKAQFRQSWPTKIDVPQDLEDDLTATPLSHATVPQSPARAGDSVLNGHRSKGLCDPAKKDELPELAGPALSTVPPASLKPAASGRKCLFRVEEDEEEDEEDKKPVSLSTQVVLRRKPSVTNRLTSRKSAPVLNQIFEEGESDDEFDMDENLPPKLSRLKMNIASPGTVHKRYHRRKSQGRGSSCSSSETSDDDSESRRRLDKDSGLAYSWHRRDSSEGPPGSEGDGGGQSKPSGGGGVDKASPGEQGTGGSGQGGSGGTPSGTAGSSRRCAGPDSSSSSPASAAPRGAELVQSLKLVSLCLGSQLHGAKYILDPQKALLSSVKVQERSTWKMCISAPGPGPSADLDPVRTKKLRNNVLQLPLCEKTISVNIQRSRKEGLLCASSPASCCHVI

SEQ ID NO: 14264 - protein, 898 aa, Rattus norvegicus
MLRVALLLLPGLPLAGVGATEEPTQEPGPLGEPPGLALFRWQWHEVEAPYLVALWILVASLAKIVFHLSRKVTSLVPESCLLILLGLALGGIVLAVAKKAEYQLEPGTFFLFLLPPIVLDSGYFMPSRLFFDNLGAILTYAVVGTLWNAFTTGVALWGLQQAGLVAPRVQAGLLDFLLFGSLISAVDPVAVLAVFEEVHVNETLFIIVFGESLLNDAVTAVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTAVKYTMKTLASSAETVIFMLLGISAVDSSKWAWDSGLVLGTLFFILFFRALGVVLQTWVLNQFRLAPLDKIDQVVMSYGGLRGAVAFALVILLDRTKVPAKDYFVATTIVVVFFTVIVQGLTIKPLVKWLRVKRSDYHKPTLNQELHEHTFDHILAAVEDVVGHHGYHYWRDRWEQFDKKYLSQLLMRRSAYRIRDQIWDVYYRLNIRDAISFVDQGGHVLSSAGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGHKKKDGVANPEATNGKPPRDLGFQDTAAVILTVESEEEEESESSETEKEDDEGIIFVARATSEVLQEGKVSGSLEVCPSPRIIPPSPTCAEKELPWKSGQGDLAVYVSSETTKIVPVDMQTGWNQSISSLESLASPPCTQPPTLTRLPPHPLVPEEPQVPLDLSSDPRSSFAFPPSLAKAGRSRSESSADIPQQQELQPLMGHKDHTHLSPGPANSHWCIQFNRGGRL

SEQ ID NO: 14265 - protein, 707 aa, Rattus norvegicus
MSQYTEKEPSVMDQDSSKAAWPRAAGGYQTITGRRYGRRHAYVSFKPCMTRHERSLGRAGDDYEVLELDDVAKENTAGSSSLDQVHPSLPSETTVEKSETEIPTCGPALNQSTESNPSVATVCHSEEVRETLDSSTNLQNHAERECTPAVCNASSVQNGIVLVHTDSYDPDSKHDENDSLQLCAQAVEGGRRQKVLGNAVFELENGEVERYADLCPSVPSLSGEIREESEELGSALLEKNSAGDAEAVHQDGQEFQRSSEDGIVRKRRQDDTDQGRQTENSTEDADCVPGHVEQNTSERANHHGSSPEQVVRPKVRKVISSSQVDQESGFNRHEAKQRSVQRWREALEVEECSSDDPIIKCDDYDGDHDCMFLTPSYSRVTPREAERHRATAENGATASGRQEARENAFWNACGEYYQLFDKDEDSSECSDGEWSASLPHRFSGTEKDQSSSDESWETLPGKDENEPELQSDSSGPEEENQELSLQEGEQTSLEEGEIPWLQYNEVNESSSDEGNEPANEFAQPEAFMLDGNNNLEDDSSVSEDLDVDWSLFDGFADGLGVAEAISYVDPQFLTYMALEERLAQAMETALAHLESLAVDVEVANPPASKESIDGLPETLVLEDHTAIGQEQCCPICCSEYIKDDIATELPCHHFFHKPCVSIWLQKSGTCPVCRRHFPPAVIDASAAASSEPDLDASPANDNAEEAP

SEQ ID NO: 14266 - protein, 398 aa, Staphylococcus aureus
SFGTPTIVYDELQIREQMRRYHRAFKDSGLKYNISYASKAFTCIQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAKKAIDKVQQSKHLKLKGVHCHIGSQIEGTEAFIETAKIVLRWLKEQGIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 14267 - protein, 299 aa, Branchiostoma floridae
MDVDMPMSPEVTQTSDSDPYNTLRNFTIEKKIGRGQFSVVYRAQNLVNGKDVALKKVQIFEMMDAKARQDCIKEIDLLKQLNHPNVIQYYASFIEDNELNIVLELADAGDLSRMIKHFKKQKRLIPERTIWKYFVQLCSALEHMHSRRVMHRDIKPANVFITATGVVKLGDLGLGRFFSSKTTAAHSLVGTPYYMSPERIHENGYNFKSDIWSLGCLLYEMAALQSPFYGDKMNLYSLCKKIEQCDYPPLPSEHYSDELRHLVNICINPDPDKRPDINYVHEVARTMHSANIQAQQQQQ

SEQ ID NO: 14268 - protein, 214 aa, Brassica napus
  unsure (1)..(214): unsure at all Xaa locations
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLLASMAEGMLLPPPSVRFEHXYDFDGDAXVSLWSY

SEQ ID NO: 14269 - protein, 214 aa, Brassica napus
  unsure (1)..(214): unsure at all Xaa locations
MTSFSTFSEMLGSEYESPVTLGGEYCPKLAASCPKKPAGRKKFRETRHPVYRGXRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 14270 - protein, 215 aa, Brassica napus
  unsure (1)..(215): unsure at all Xaa locations
MTSFSTFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAAVAFKAEINNTTADHGIDVEETIVEAIFTEENNDGFYMDEEESMFGMPALLASXAEGMLLPPPSVQFGHTYDFDGDADVSLWSY

SEQ ID NO: 14271 - protein, 250 aa, Brassica napus
MNSVSTFSELLGSENESPVGSDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQVEVNDTTDHDLDMEETIVEAVFREEQREGFYMAEETTVVGVVPEEQMSKGFYMDEEWMFGMPTLLADMAAGMLLPLPSVQWGHNDDFEGVADINLWSY

SEQ ID NO: 14272 - protein, 461 aa, Homo sapiens
MLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 14273 - protein, 428 aa, Rattus sp.
ELGRGATSIVYRCKQKGTQKPYALKVLKKTVDKKIVRTEIGVLLRLSHPNIIKLKEIFETPTEISLVLELVTGGELFDRIVEKGYYSERDAADAVNEILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTNIQESNKASSEAQPAQDGKDKTDPLENKIQAGDHEAAKAAADETMKLQSEEVEEEEGVKEEEEEEEEEEETSRMVPQEPEDRLETDDQEMKRNSEETLKSVEEEMDPKAEEEAAAVGLGVPPQQDAILPEY

SEQ ID NO: 14274 - protein, 474 aa, Rattus norvegicus
MLKVTVPSCPSSPCSSVTSSTENLVPDYWIDGSKRDPLSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTNIQESNKASSEAQPAQDGKDKTDPLENKMQAGDHEAAKAAADETMKLQSEEVEEEEGVKEEEEEEEEEEETSRMVPQEPEDRLETDDQEMKRNSEETLKSVEEEMDPKAEEEAAAVGLGVPPQQDAILPEY

SEQ ID NO: 14275 - protein, 362 aa, Burkholderia cepacia
MPKSKRHEPQAESEKISRATQASVGRAGASTDDEDDNADNERDLEARDAEADGGDDEREGRAEASPDVDDFRTLLQAELTADTIQHYLNRISVKPLLTVEEEQRYSRLAKAGEFEARQVMIERNLRLVVSIAKGYLNRGVPLLDLIEEGNLGLMHAIEKFDPTRGFRFSTYATWWIRQSIERAIMNQARTVRLPVHVIRELNQVLRAKRHLEKNSMSTGEAAERREASIDDIAYLTGKTAEEVTDILALNEHTASLDAPLDLDPASSLLDLLPDDQSQSPDAEVQHRELETLTRAWLSRLSDKHRHVIERRFGLNHIEPATLEELADEMGLTRERVRQIQQEALVRLKRFFASNGVRKDAVL

SEQ ID NO: 14276 - protein, 350 aa, Emericella nidulans
MKSADRFSPVKMEDAFANSLPTTPSLEVPVLTVSPADTSLRTKNVVAQTKPEEKKPAKKRKSWGQELPVPKTNLPPRKRAKTEDEKEQRRIERVLRNRAAAQTSRERKRLEMEKLESEKIDMEQQNQFLLQRLAQMEAENNRLSQQVAQLSAEVRGSRHSTPTSSSPASVSPTLTPTLFKQEGDEVPLDRIPFPTPSVTDYSPTLKPSSLAESPDLTQHPAVSVGGLEGDESALTLFDLGASIKHEPTHDLTAPLSDDDFRRLFNGDSSLESDSSLLEDGFAFDVLDSGDLSAFPFDSMVDFDTEPVTLEDLEQTNGLSDSASCKAASLQPSHGASTSRCDGQGIAAGSA

SEQ ID NO: 14277 - protein, 426 aa, Oryza sativa (japonica cultivar-group)
MNGGIGDALMQPQHVQVMSSSLPMVASTFVAEPAAAANKPRAAGLPPTPPQVFAAQRAAAAAGGDVCMEESAQGGGGGLPPRKAHRRSSSDVPFGYLAGQHQLLPPKVEAGWGHLGAGAGGAAAADDLFNAYLNLEGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 14278 - protein, 588 aa, Oryza sativa (japonica cultivar-group)
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 14279 - protein, 354 aa, Homo sapiens
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPELVEVIRRLWKDGGVQACFERAAEYQLNDSASYYLNQLERITDPEYLPSEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYDDAGNYIKSQFLDLNMRKDVKEIYSHMTCATDTQNVKFVFDAVTDIIIKENLKDCGLF

SEQ ID NO: 14280 - protein, 4134 aa, Gallus gallus
MAGGVQECLQELHGCLQPGDAMRGYGLLRGLGEACLTCLAGGALALHVSLVFAPERGLLAFVCRSLGVEEFRECREEALKFLCVFLERIGERAHPYACSLKQTCISVYTKERAAKCKIPALELLIKLLQSLRRSCLMEEMKVGEIFNKFYGELAVRSKISDTVLEKIYELLGVLGEVHPADMINNSEKLFRAYLGELKTQMTSATRVPKLPIVAGCLRGLTALMYNFTKSVDEDAQTSKEIFDFAVKAIRPQVDQKRYAVHLAGLQLFSWHAAQFGTLLLDSYVMLFETMCRWCGHTNQELKKAGHNALDSFLKQMSLMVAKDAELHKSKLKFFMEQFYGIIRRMDSSNKELSIAIRGYGLFAAPCKAMHPADVDAMYIELLQRCKQMYLTEAETIDDHLYQLPSFLQSIASVIFHLDTIPEVYTPVLEHLVVLQINSFPRYSEKMQLVCCRSIIKVFLALSIKGPVLWNFISTVVHQGLIRVFSKPMKFSKDVFGKETSGSEEFPESGEVDTARWKVPTYKDYLYLFRSLLSCDTMKESIFEEENFLTGNSPLQSLNRLLYDELIKSILKIIEKLDLTVQKLNVHEQDENETDSAFIGPTSDPASNLQPKKPTDFIAFINLVEFCRDILPDKHVEYFQPWVYSFGYELIIHSTRLPLISGFYKLLSVTMKIAKKIKYFEGVGPKSLRKATEDPEKSSCFALFAKFGKEVTAKMKQYKDELLASCLNFLLSLPHDIVMLDIKAYIPALQNAFKLGLSCTPMADLGLDALEDWSAHIPRHIMQPYYKDVLPLLDGYLKNSATTVEPQNNWEVRKLSRAAQKGFNKIVIQRLRKAKTSSLDDNPSLEAVRTRVARLLGSLGGQINHNLITATSAEEMMKKCVSWDTKNHLSFAVPFADMKPVIYLDVFLPRVTDLALSASDRQTKIAACELLHSIVAYMLGKASQMPERQQGPPPMHQLYKRIFPVLLRLACDVDQVTRQLYEPLVMQLIHWFTNNKKFESQDTVTFLEAILSGIVDPVDSTLRDFCGQCVREFLKWSIKQTTPKQQEKSPANTKSLFKRLYSLALHPSAFKRLGAALAFNSIYREFREENSLVEQFVFEALVVFLESLALTHTDEKSLGTTQQCCDAINHLKRIIKHKAPALNKEGKRRVPRGFPATKSVCLQDVVMWLLVQCGRPQTECRHKAMELFYEFVPLLPGNNSPSSWLADVLKKRDVSFLINKFEGGGSDAKSPSGILSQPTLRDMQEPFSLLTVMRWMDMFLAALDCYNTFFELRMIKPHEILGVNERSSFLEAVDFFLETIALHDIHAAEQCFDCRSRGNIFSPQEREVYNYSKCTIIVRIMEFVTMILEICQQDFWKLLEKELLNANFIELLVMTVCDPSHIGFNTADVQVMKNLPDISVRLLKALMKSPYKEYLQLCLKKRITPQSFEDLCSVDLFNSDARFDQVRFSAVLSACKQLQKSGLLHSVLHSQDERPHPSIGSKLLSVVYKSIAPGSERSSLPAVDISSKRLADRLLQLAFAIDDQCEELVSLLLNTVVLSVPLSKASERNFVDFSHGQYFYSLFSDTINQQLLKNLDVIVIHLMESSVSNPQMVGSILNGMLDQSFRERTIRKQQGVKLVTAVLRNWKRLDSWWAKDSSPESKMAVLTLLAKVLQIDSSVSFNTSHEAFTAVFDTYTSLLTDQNLGLNLKGHAVIILPFFTNLSGEKLHDLKNALDQLVAFNFPMSSDEFPKGTLKHNNYVDCTKKFLDALELSQSPMLLQLMTEVLCRDHRHSMEDLFQASFKRISRRSSTDKQVVLLDTVHKMFQNEDLLSNIVRQAFVDRSLLTLMSHCSLDALREFFCKIIVQAMDTLNSRFTKSNECVFDTQITKKMGYYKMLEVMYIRLSKDDVHSKDSKINQAYRGSVSVEGNELTKALIKLCYDAFTENMAGENQLLEKRRQYHCAAYNCAIAVISCVFTESKFYQGFLFTEKSEKNLLIFENLIDLKRQYVFPVEIEVPLERKKRYIAIRKEAREAWNDGQDEPKYLASASYMMDSSLSEEMSQFDFSTGVQGFSYSSQDVTASSAHFRRKETSEYMVLNDEMELEMDELNQHECMAPLTTLIKHMQRNQITPKVEEGVIPVDLPLWMKFLHSKLGNPSVPLNIRLFIAKLIVNTEDVFRPYAKQWLGPMLQLVVSGDNGGEGIHYMVVEIAVTVLSWTSVTTPKGNIKDEILANRLLEFLMKNAFHQKRAVFRHNLEIIKTVIECWKNCLSIPYSLIFEKFSSGDPDTKDNSVGIQLLGIVLANNLPPFDLKCEIDRVRYFQALVSNMGLLRYKEVYAAAAEVLGLALQYIAERQNILEDPVYDCVIKQLKRHQNTQQDKFIICLNKVVKNFPPLADRFMNAVFFLIPKLHGVMKNYCLEVIMCRAEEIPDLYLQLKSKDFIQIMKHRDDERQRVCLDIIYKMLSTLKPPELKELLPGVTGFISHPSVICRQRMYDILMWIYDNYSDPESQADGDSQEVLSLAKEILLQGLIDENAELQLIVRNFWSDETRLPANILDRMLMLLNSLYSAKIETQYLSLITNFLLEMTSKSPDYSRKIFEHPLSECKFHDFVIDSSWRYRSTMLTPMFVETQASQSTNRNSSQERSLSISGSVGGRVRATQRQYEFTPTQNVSGRSSFNWLTGNSIDTLAEYTVPSSSESLSSSMLLVNKRSEKFKQAAFKPVGPDFGKKRLSLPGDKVDSKTKGIDERAEILRLRRRFLKDQEKVSLIYARKGVAEQKREKEMKSELKMKFDGQVTLYRSYRVGDLPDIQIEHCSLIAPLQGLAQKDPTFAKQLFSSLFGGIFCEVKKSKIPSEKKAIIQKLLKDFNHFLSTSVSYFPPFIACIQEISYKHRELLELDSANVSTSCLASLQQPVGILLLEHALMALSPAEEPPSKRMRGRTELPPDVVKWLELAKLYRSLGDYDVLRGIFSGKIGTKDITQQALLAEARSDYAEAAKCYDEALSKEDWEDGEPTEAEKDFWELASLECYDHLTEWKSLEYCATVNIDSGKPPDLNKTWSDPFYQETYLPYIIRSKLKLLLNGENDQTLLTFIDEAMKTEQKKALIEMHYSQELSLLYILQDDFDRAKYYIGNGIQIFMQSYSSIDTLLYQSRMSKLQSVQALTEIQDFINFMTKTSNIASQAKSLKRLLRTWTSRYPDAKMDPMNIWDDIITNRCFFLDKLQEKFLCDKANDSMEVDEESSVGDQMEVDQQDEDIHSMIRSCKFNMKLKMIESARKQNSFSIAKKLLKGLRREAKTREDWLVRWNYAYCRFVHSCSQSQSCPERVLSVLKTISLLEDTKSDYLNKNIMAFRNQNLLLGTTYHIMANALSQDPKCCEQIEEEKTGKILELSGESSESPEKILAGLNKRAFQCFSSAARKSEEEVQSLSMEHVDVKGVIDAYMTLVGFCDQHLRKEEEGSLEINAADLQLFPAIVVEKMIKALKLNSREARLRFPRLLQIIERYPAETLGLVTRELPSVPCWQFIGWISQMMALLDKDEAVAVQHTVEEIVDTYPQAIIYPFTISSESYCFKDTAAGCRNKEFVASIKNKLDRGGVVQDFIHALEQLSNPVMLFKDWVADVRNELVKTQRNKIILKEMYEGMYKNLGDVKAPGLGWLRKRFVQAFGKDFDSHFGKGGSKLLDMKISDFNEITTALLTKMNKTHKEPGNLKECSPWMSEFRAEFLRNELEVPGQYDGKGKPLPEYHVKISGFDERIMVLESLRKPKRITIRGSDEQEHPFLVKGGEDLRQDQRIEQLFDVMNIVLSRDAACSQRNMQLKTYQVIPMTTRLGLIKWLENTCTLKEFLRNSMTEEEDANYNSLKGPRAAYSDWLSKMGGKAQGLSRYNAMYKNASRTETVIAFKSRESSVPEDLLRRAFVKMSTSPEAFLALRSHFVSSHALMCVSHWILGIGDRHLSNFMINKETGGMVGIDFGHAFGSATQFLPVPELMPFRLTRQFVNLMMPVKEWGLIYSVMVHALRAYRADPDLLISTMDVFVKEPSLDWKNFEQRQLKKGGTWIKEINTAEVNWYPLQKVSYVKRKLTGANPARITCDELRLGYEKLPFYNDFAAVARGSADHNIRAKEPEDRLSEETQVRCLIDQATDPNLLGRVWEGWEPWM

SEQ ID NO: 14281 - protein, 148 aa, Rattus norvegicus
MNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVSATDGLSEELTEEAFSKLGTAAGEPSPWAVC

SEQ ID NO: 14282 - protein, 385 aa, Ciona intestinalis
MAIPSRARVYHDVNTHRPREYWDYESHVVDWGNQDDYQLVRKLGRGKYSEVFEAFNVTDNKKVVIKILKPVKTKKIKREIKILQNLRGGGPNIITLLDIVKDPVSRTPALVFEHVNNIDFKQLYQTLTDYDIRYYMFEILKALDFCHSMGIMHRDVKPHNVMIDHENRKLRLIDWGLAEFYHPGQEYNVRVASRYFKGPELLVDYQFYDYSLDMWSLGCMLASMIFRKEPFFHGHDNYDQLVRIAKVLGTEDLYEYLDKYNIELDPRFNDILGRHSRKRWERFVHSDNQHLVSPEAIDFLDKLIKYDHQARLTARESMEHPYFYPVVKDQGGLSSNATLPSSSTQLGQVQMGSGMCLGGITSTTGVLKDSPGGSIRQSNTAQSMN

SEQ ID NO: 14283 - protein, 155 aa, Citrus reticulata
AANSLVISEWMNWLKTEIGFDGWRFDFVKGYAPSITKVYMENTSPDFAVGEKWDSLSYGPDGKPDANQDGHRGALKDWVQAAGGAVAAFDFTTKGILQAAVQGELWRLKDSNGKPPGFIGILPQNAVTFIDNHDTGSTQRLWPFPSDKVMQGYES

SEQ ID NO: 14284 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYSGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 14285 - protein, 272 aa, Thellungiella halophila
MATQPPSSSSAREEFVYMAKLAEQAERYEEMVEFMEKVAKAVDKEELTVEERNLLSVAYKNVIGARRASWRIISSIEQKEESRGNNDHVSLIRDYRTKIETELSGICDGILKLLDTMLIPAAASGDSKVFYLKMKGDYHRYLAEFKTSQERKDAAEHTLNAYKAAQDIANAELAPTHPIRLGLALNFSVFYYEILNSPDRACNLAKQAFDDAIAELDTLGEESYKDSTLIMQLLRDNLTLWTSDMQDDDDVIKEAAAAAPAAPKPAEEQQQS

SEQ ID NO: 14286 - protein, 195 aa, Thellungiella halophila
MTKMGFKPDSNPSPNPNESNAKEIRYRGVRKRPWGRYAAEIRDPGKKTRVWLGTFDTAQQAARAYDAAAREFRGAKAKTNFPTFLELNAAKDGGFARSPSQSSTVDSVSPTSARLVTPPQLELSLGGGGGGACYQIPVARRPVYFYNMTTFPAAAAATCGVQSESDSSSVVDFECGAEKKYRPLDLDLNLAPPAE

SEQ ID NO: 14287 - protein, 409 aa, Thellungiella halophila
MPFVGDELHHSGWNSCSSCHGDASADRRYLVLPSLISGRIYAIDTKENPRAPSLYKYVDPKEIAEKTGLAYPHTAHCLASGEILVSCLGDEEGNAKGNGFLLLDSDFNIKNRWEKPGHSPLFGYDFWYQPRHKTMISTSWGAPKAFSKGFDLQHVADGLYGSHLHVYSWPGGEMKQLIDLGETGLLPLEIRFLHDPSKDTGYVGSALSSNMIRFFKNSDDTWSYEIVISVKPLKVENWILPEMPGLITDFLISLDDRFLYFVNWLHGDIRQYNIEDPKNPVLTGQIWVGGLLQKGSPVKAVGEDGNSFQFDVPQIKGKSLRGGPQMIQLSLDGKRLYATNSLFSAWDRQFYPELMDKGSHIIQIDVDTEKGGLSINPNFFVDFGDEPEGPALAHEMRYPGGDCTSDIWI

SEQ ID NO: 14288 - protein, 164 aa, Thellungiella halophila
MGLSSLPGPSEGMLCVILVNTALSISIFKGIVRSVLHVLGIRLSQSSSSPSSVTASSEIPASEPFDFRVSHPESFLEEFRNKTPTLRYESLCRCKKHEDNECSVCLSKFEEDSEINKLKCGHLFHKTCLEKWIDYWNITCPLCRTPLVVVAAAEDQKQLSSNVW

SEQ ID NO: 14289 - protein, 254 aa, Mus musculus
MLDGTSRFTCRGKKIYNIMGTSTFTEYTVVHEIAVAKIEAAAPMDTVCIMSCAVPTGFGAVFNTAQVTPGSSCVVFGLGGIGSAIVMACKASGACRIIGVDINEEKFPRARALGVTDCLNPNKLKKPVQEVVKEMTGVGVDFAFEAIGLIETMVAALKSCNRSYGVCVIMGVAPTGSQLSFDPLVLLPGRTLKSSVLGGYKTRDDIPKLVTDYVQKKINIDPLITHRLPFPKINEGFRLLQEGKCIRCVLSMRP

SEQ ID NO: 14290 - protein, 176 aa, Mus musculus
MGMRRSWRKLKPTGRRLKIEKELETVCNDVLALLDKFLIKNCNDFQYESKVFYLKMKGDYYRYLAEVASGEKKNSVVEASEAAYKEAFEISKEHMQPTHPIRLGLALNFSVFYYETQNAPEQACLLAKQAFDDAIAELDTLNEDSYKDSTLIMQLLRDNLTLWTSDQQDEEAGEGN

SEQ ID NO: 14291 - protein, 386 aa, Mus musculus
MALRVTRNTKINTENKAEVSMAGAKRVPVTVTAASKPGPRPRTALGDIGNKVSEELQARVPLKREAKTLGTGKGTVKALPKPVEKVPVCEPGVELAEPEPEPELEHVREEKLSPEPILVDNPSPSPMETSGCAPAEEYLCQAFSDVILAVSDVDADDGADPNLCSEYVKDIYAYLRQLEEEQSVRPKYLQGREVTGNMRDILIDWLIQVQMKFRLLQETMYMTVSIIDRFMQNSCVPKKMLQLVGVTAMFIASKYEEMYPPEIGDFAFVTNNTYTKHQIRQMEMKILRVLNFSLGRPLPLHFLRRASKVGEVDVEQHTLAKYLMELSMLDYDMVHFVPSQIAAGAFCLALESLDNGEWTQLCSTTYPTRKTPCFLLCSTWLRIESW

SEQ ID NO: 14292 - protein, 491 aa, Mus musculus
MADPSLNDNPTACPHCASSQAGLLCVCPAGKSPVLVVEMSQTSSIGSTEFFASQERKKERNTSRESSLKDLSIRTSNVERKPQAQWSRSNVTVGKIPHIRMDDGAGIEEFYTFGRILGQGSFGMVFEAIDKETGAKWAIKKVNKEKAGSSAMKLLEREVSILKTVNHQHIIHLEQVFESPQKMYLVMELCEDGELKAVMDQRGHFSENETRLIIQSLASAIAYLHNKDIVHRDLKLENIMVKSSFIDDNNEMNLNIKVTDFGLSVQKHGSRSEGMMQTTCGTPIYMAPEVINAHDYSQQCDIWSIGVIMFILLCGEPPFLANSEEKLYELIKKGELRFENPVWESVSDSAKNTLKQLMKVDPAHRITAKELLDNQWLTGNTLSSARPTNVLEMMKEWKNNPESDEETNTDEETEQSAVYSPSANTAKQPTNAAKKPAAESVGMTSSNSSSSKLLSAESKAEPEKSSETVGHASVAKTTLKSTTLFRGKKRL

SEQ ID NO: 14293 - protein, 114 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGEKRRCS

SEQ ID NO: 14294 - protein, 398 aa, Danio rerio
MMALRVTRNTRLASSENQNALPGKAVVANKPGLRPRAALGEIGNNPQTRQALKKKEVKVAPAAEVVVEKAPVVQQPKKDSPKVQHGVKVVSEPSSPVPMETSGCASDDLCQAFSDVLLNIKDVDADDYDNPMLCSEYVKDIYLYLRQLETEQAVRPKYLAGKEVTGNMRAILIDWLVQVQIKFRLLQETMYMTVAIIDRFLQDHPVPKKQLQLVGVTAMFIASKYEEMYPPEIADFAFVTDRAYTTSQIREMEMKVLRVLNFGFGRPLPLQFLRRASKIGDVTAEHHTLAKYFLELTMVDYDMVHYPPSQMASAAYALTLKVFNCGDWTPTLQHYMGYTEDELVPVMQHIAKNVVRVNEGLSKHLAVKNKYSSQKQMRIATISQLKSSLIKDLAKQIS

SEQ ID NO: 14295 - protein, 524 aa, Rattus norvegicus
MPSVYGFPAFTSATELLLAVTTFCLGFWVVRVTRTWVPKGLKSPPGPWGLPFIGHVLTLGKNPHLSLTKLSQQYGDVLQIRIGSTPVVVLSGLNTIKQALVKQGDDFKGRPDLYSFTLIANGQSMTFNPDSGPLWAARRRLAQNALKSFSIASDPTLASSCYLEEHVSKEAEYLISKFQKLMAEVGHFDPFKYLVVSVANVICAICFGRRYDHDDQELLSIVNLSNEFGEVTGSGYPADFIPILRYLPNSSLDAFKDLNKKFYSFMKKLIKEHYRTFEKGHIRDITDSLIEHCQDRRLDENANVQLSDDKVITIVFDLFGAGFDTITTAISWSLMYLVTNPRIQRKIQEELDTVIGRDRQPRLSDRPQLPYLEAFILETFRHSSFVPFTIPHSTIRDTSLNGFYIPKGHCVFVNQWQVNHDQELWGDPNEFRPERFLTSSGTLDKHLSEKVILFGLGKRKCIGETIGRLEVFLFLAILLQQMEFNVSPGEKVDSTPAYGLTLKHARCEHFQVQMRSSGPQHLQA

SEQ ID NO: 14296 - protein, 266 aa, Hypocrea jecorina
MPQPVPTANRLLDLFSLKGKVVVVTGASGPRGMGIEAARGCAEMGADLAITYSSRKEGAEKNAEELTKEYGVKVKVYKVNQSDYNDVERFVNQVVSDFGKIDAFIANAGATANSGVVDGSASDWDHVIQVDLSGTAYCAKAVGAHFKKQGHGSLVITASMSGHVANYPQEQTSYNVAKAGCIHLARSLANEWRDFARVNSISPGYIDTGLSDFIDEKTQELWRSMIPMGRNGDAKELKGAYVYLVSDASSYTTGADIVIDGGYTTR

SEQ ID NO: 14297 - protein, 1003 aa, Eimeria tenella
MGACSSKAQHQTRDPEPREQQAAQEQKSTGPSGAPNDAPAPAEAERKMSGSSATAPKGEMPTASTGTPEQQQQQQQQQQQQQEQQQHPEHQQSEKQQQHGEEQQQERKPSQQQQNEEAAAPHKHGGERKVQKAIKQQEDTQAEDARLLGHLEKREKTPSDLSLIRDSLSTNLVCSSLNDAEVEALANAVEFFTFKKGDVVTKQGESGSYFFIVHSGEFEVIVNDKVVNKILTGQAFGEISLIHNSARTATIKTLSEDAALWGVQRQVFRETLKQLSSRNFAENRQFLASVKFFEMLTEAQKNVITNALVVQSFQPGQAIVKEGEKGDVLYILKSGKALVSIKNKEVRVLQRGEYFGERALLYDEPRSATITAEEPTVCVSIGRDLLDRVLGNLQHVLFRNIMLEALQQSKVFASFPTEQLSRLIGSVVVKDYPENYIILDRENRTRASASALFSAQGVRFFFVLEGEVSVFAYKDKSSSSSSSSSSSSSSSSAEGEMELHLIDTLKRGQAFGDEYVLSPNKPFAHCVKSNGPTKLALLTASALTATLGGQDIDETLDYNNKLAITKKMYIFRYLSEQQTQTLIKAFKTVRYTQGESIIREGEIGSRFFIIKLGEVVILKGEKRVRTLGRHDYFGERALLHDERRSATVAANSPEVDLWVVDKDVFLQIVKGPMLTHLEERIRMQDTKVEFKDLNVVRVVGRGTFGTVKLVQHIPTQMRYALKCVSRKSVVALNQQDHIRLEREIMAENDHPFIIRLVRTFRDKEFLYFLTELVTGGELYDAIRKLGLLGRYQAQFYLASIVLAIEYLHERNIAYRDLKPENILLDSQGYVKLIDFGCAKKMQGRAYTLVGTPHYMAPEVILGKGYTLTADTWAFGVCLYEFMCGPLPFGNDAEDQLEIFRDILAGKLIFPHYVTDQDAINLMKRLLCRLPEVRIGCSINGYKDIKEHAFFSDFDWDRLAGRDLSPPLLPKGEIYAEDAEEGGLDIEEDEGIELEDEYEWDKDF

SEQ ID NO: 14298 - protein, 994 aa, Toxoplasma gondii
MGACISKNSSARVSRSSALSASKQTVAASAPPGAAGDETSATGAAEEASRNSLARVDGTRASAAELERAPDGVCPDREEPGTANAEQGGVTEKKDTRETLAGMNSPKTLEAEAQEDDPKREAPNQDVPSEAPEGPKEKPGGDRKPAQKAILKQDDSHTEEEKLNAHLAYREKTPADFALIQDSLKANLVCSSLNEGEIDALAVAMQFFTFKKGDVVTKQGEPGSYFFIIHSGTFDVLVNDKRVNAMDKGKAFGEIALIHNTERSATVVASSTEGALWGVQRHTFRETLKQLSSRNFAENRQFLASVKFFEMLTEAQKNVITNALVVENFKPGQPIVKEGDAGDVLYILKSGKAKVSIGGREIRMLRKGDYFGERALLYKEPRSATITAEEFTVCVSIGRELLDRVLGNLQHVLFRNIMVEALQQSKVYELFQGDQLSKLIEAAVVKDYGADYVILDKENKTKGIRFFFVLEGELSVYAYTQNPATKEEERKLAATLKRGQAFGEEYVLNPTRPFNHYVKSVGPCKLALFTSSVLTATLGGEDIDETLDFNNKRAIIRKMYIFRYLSDHQMTMLIKAFKTVRYMSGEYIIKEGERGTRFFIIKAGEVAILKNNKRLRTLGRHDYFGERALLYDKPRTASVCANSAGVDLWVVDKSVFNEIIKGPMLAHLEERIRMQDTKVEFQDLQVVRVVGRGTFGTVKLVRHVPTDIRYALKCVSRRSVIALSQQQHIRLEREIMAENDHPFIIRLVRTFRDKEFLYFLTELVTGGELYDAIRKLGLLARSQAQFYLASIVLAIEYLHERNIAYRDLKPENILLDSQGYVKLIDFGCAKKMQGRAYTLVGTPHYMAPEVILGKGYTLTADTWAFGVCLYEFMCGPLPFGNDAEDQLEIFRDILTGKLVFPHYVTDQDAINLMKRLLCRLPEVRIGCSINGYKDIKEHAFFGDFDWDKLAGRGLPPPLAPKGETYAEDTEQSSFELDEDDTIVLEDEYDWDKDF

SEQ ID NO: 14299 - protein, 965 aa, Cryptosporidium parvum
MAFLTKLKTSKFSSGVKAAKETTYEELSKEENDEIEYPEEKMVVFRDRQKANIQSRIGGLSKNMSNISNAGGGMEDDYEQNMVISHLKDREKTEEDIKTISKALAGNVVGASLNESEIATLVSSMHYYEYEVGEVVIEQGASGFYFFVISTGSFGVEINGNRVNTMSEGTAFGELALIHNTPRSATILVIEKGGLWGLGRSTFRDTLRLISSRNYEENRAFIESLSIFSGLTDKQKSLLSEALVREIFVKDQVIIREKEIGNVLYMIKSGIVGVFVEDKYIRSLNEGDAFGERSLMFDEPRSATVIANATTECLTLNRGILTQILGNLGQVLSKNLIQQSLQNSPIFKQFTKNQMQILLDKISIKTFQKDVILSTAETKALNMRAFVILEGEVQVSLPSNWLSRRASSLTSMVIDKSIGSVNNYSLSDYINVNLGRGDYFGDDFVFHPKIPFVCKIEMKSETKIGVITSSMLSECFGDENVDVGLEINRKRDAIKSCFVFQYVSEQQLSLLVKSLRLVKFTSGEKIVVQGDKGTAFFILQSGEVAVYRNNKFIRYLGKNDYFGERALLYDELRSATIEAATPEVHLWTVDKEAFLKIVEPPMRRYLDERIKLQETRVQMSDLKILQTIGKGTFGVVYMVENIKSGNKYALKKISKSRILALNMQAHVKLERSILALNDHPFIIKLVRTFKDSENIYLLTELIPGGELYDALQRIGLLTRYQAQFYIGSIILALEYLHERSIVYRDLKPENILLDSQGYIKLIDFGCAKKIAGRSYTLAGTPHYMAPEVILGKGYNLSCDAWAIGICLYEFLCGCLPFGNDAVDHLEIFKDILTSKLVFPRHLNDVDTVNIIKRLLCRVPEVRMGCSATGYKEIKDNVFFKDFNFDRLLGRSYVAPLVRKYRVFAKNTENENIVENITEVSQNEEALSPNTHNIKSKQKISFNASKNHSVSTRGNKMDEYDWDIEF

SEQ ID NO: 14300 - protein, 265 aa, Rosa hybrid cultivar
LVQFGAFIVLCGATHLINLWTFSVYSRTVAIVMATAKVFTAAVSCATALMLVHIIPDLLSVKTRELFLKNKAAELDREMGLIRTQEETGRHVRMLTHEIRSTLDRHIILKTTLVELGRILTLEECALWMPTRTGLELQLSYTLHQQNPVGYTVPIHLPVINQVFNNNGTVKISPNSPVARLRPIAGKHIPGEVVAVRVPLLHLSNFQINDWPELSTKRYALMVLVLPSDSARQWHVHELELVEVVADQVAVALSHAAILEESMRA

SEQ ID NO: 14301 - protein, 1128 aa, Mus musculus
MAECGRGAAGGALPTSPSPALGAKGALKAGAGEGGGGGGGGRLGHGRARYDSGGVSNGDCSLGVSGDEARTSPGRGPLGVALARTPSPAAGPVPRDSKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISEQISEDCAFSVIYGENYESLDLVANSADVANIWVTGLRYLISYGKHTLDMLESSQDNMRTSWVSQMFSEIDVDGLGHITLCHAVQCIRNLNPGLKTSKIELKFKELHKSKDKAGTEITKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKILGDKLYTTSPNMEESYLPSPDVLKGKILIKAKKLSSNCSGVEGDVTDEDEGAEMSQRMGKENVEQPNHVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNVGWFRQNGNCGYVLRPAIMREEVSFFSANTKDSVPGVSPQLLHIKIISGQNFPKPKGSGAKGDVVDPYVYVEIHGIPADCAEQRTKTVNQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNNPLVVLNLSEPYPTMELQAIVPEVLKKIVTTYDMMMQSLKALIENADAVYEKIVHCQKAAMEFHEHLHSIGTKEGLKERKLQKAVESFTWNITILKGQADLLKYAKNETLENLKQIHFAAVSCGLNKPGTENSEAQKPRRSLEAIPEKASDENGD

SEQ ID NO: 14302 - protein, 308 aa, Helianthus annuus
MAILSRYSSSNTLFCIEEQVHEDEDELTHQDSSAIHPLDLQDLCWEHEELVSLFTKEEEQQKQTPWPSSCTLSFRKEAVDWILKVKGCHGFTPLTAILAINYLDRFLSSLHFQKANTPWMIHLVAVTCLSLAAKIQETHVPLLLDLQLEESKFLFEAKNIQKTELLVMSTLKWRMNLVTPISFLDHIVRRLGLSNHLHWDFFKKCEAMILYLVADSRFVCYKPSVLATATMLCVVEEIDPTNSIGYKSQLLDLLKTTKDHINECYKLVMDLSYDNHNKGKRDENERTIYPVSPAGFIGFMCHESSNDS

SEQ ID NO: 14303 - protein, 357 aa, Homo sapiens [sequence omitted]

SEQ ID NO: 14304 - protein, 335 aa, Homo sapiens [sequence omitted]

SEQ ID NO: 14305 - protein, 371 aa, Acetobacter pasteurianus
MDVRAAVAFEAGRPLEIERVQLEGPRAGEVLVEVKATGLCHTDKYTLSGADPEGLFPAILGHEGAGVVVEVGAGVQHLRPGDHVIPLYTPECRECKSCLSRKTNLCTAIRATQGKGLMPDGTSRFSFKGQPIHHYMGCSTFANYTVLPEIALAKIRPDAPFDKVCYIGCGVTTGIGAVLFTAKVEPGSTVVVFGLGGIGLNVIQGAKMVGADRIIGVDINPAREAMARQFGMTDFVNPRDLGPNGDVVGHLVELTGGGADYTFECVGNPTLMRQALECAHRGWGVSTIIGVAAAGQEISTRPFQLVTGRRWIGSAFGGARGRTDVPKIVDWYMENRINIDDLITHKLPLERINEGFDMMERGESIRTVVEF

SEQ ID NO: 14306 - protein, 249 aa, Populus tremula x Populus tremuloides
MTSIMGAEPAGTYSMMNFEETELRLGLPGGVSNGNDSEAAKSNGKRGFSETVDLKLNLSTKETGKDGSDQEKVVMKEKTVAPRPNDPAKPPSKAQVVGWPPIRSFRKNVMAVQKNSNDEGEKASSSGATGAAFVKVSMDGAPYLRKVDLKLYKSYRELSDALGKMFSSFTIGNCGSQGTKDFMNESKLIDLLNSSEYVPTYEDKDGDWMLVGDVPWGMFVDSCKRLRIMKGSEAIGLAPRAVEKCKNRS

SEQ ID NO: 14307 - protein, 244 aa, Vitis vinifera
MGRGRVELKRIENKINRQVTFAKRRNGLLKKAYELSVLCDAEVALIIFSTRGKLYEFCSSSSMLKTLERYQKCSYGAVEVSRPSKELEQSSYREYLKLKSKFEALQRTQRNLLGEDLGPLNTKELEQLERQLETSLKQVRSTKTQFMLDQLSDLQNKEQVLVESNKALTRKLDEISVKNHLQLSWESGEQSMPYGHQQAQSQGFFQPLECNPTLQIGYNPAGSSQLSAPSNAQNVNGFIPGWML

SEQ ID NO: 14308 - protein, 244 aa, Vitis vinifera
MGRGRVELKRIENKINRQVTFSKRRNGLLKKAYELSVLCDAEVALIIFSSRGKLYEFGSAGTTKTLERYQRVCYTPQDNNMECETQSWYQEVSKLKAKYESLQRTQRHLLGEDLGPLSVKELQNLEKQLEGALAQARQRKTQMMIEQMEDLRRKERQLGDLNKQLKLKLEAEGQSLKAIQGSWNPSTATAGNSSFPVHPSQSNPMDCEPEPILQIGYHHYVPAEGPSVSKSMAGESNFIQGWVL

SEQ ID NO: 14309 - protein, 242 aa, Vitis vinifera
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQLSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 14310 - protein, 690 aa, Cryptococcus neoformans var. grubii
MRKAMANDGQGTTESTEAAMENSQTNLSHTSRTTGPKGTLRVKVISARGLAVSHSPGAEPQPYVVIQFEQNEYVSRPPHPVTSASSVPFTTSTPQPIGTPNNLTRSSSGLGVGAISRAFADAVGRGKKKEDGSGTMTPKAEEPAGGSWLGKPGPGDPVWKEEVSFDVTSSKPTLHLSVYDRNRDGEGFLGMLDIKPVLQDGYVLDNWYKLDTRGDETVTGEVWIQMTYTIIRKRISLKPSDFEFLKLIGRGTFGRVFQVRKKDTRRIYAMKVLSKKEIVAKKEVAHTIGERKILQCSLECPFLVGLKFSFQTDTELYFVTDYKCGGELFWHLQKEGRFQRRSGGLQKEGRFSEDRARFYIAELVLALEHLHKYNIVYRDLKPENILLDATGHVALCDFGLSKPDLTDDKLTNTFCGTTEYLAPEVLLDEKGYGKHVDFWSLGVLLFEMCCGWSPFYAEQTQEMYRLICYGKIRFPKNVIGDDGKQFVKGLLNRNPQNRLGSHRGAVELKEHPFFKNIDWDLLYKKQITPPFKPIVDSDESVANFDPEFTNSSLLDAGIVPWEEVNANVDPGTASQPGKHSYLGPGAGISGSVPGGGGVAINKAQRPGLPGANGSPLTSSVQENFRGFTYTGESLMPQSMLADQSMDSDSDNENAVDDDEDDDEDEEEYEEDDDEENGIGSSRRECDVDMD

SEQ ID NO: 14311 - protein, 69 aa, Phaseolus vulgaris
KNYTYSLEVGGNGRKMIWQGVPRSIRDSHRKVRDSFDGLIIQRSMALFFSGGDKKELKLRVTGRIWKEQ

SEQ ID NO: 14312 - protein, 635 aa, Persea americana
MKGCDCIEPQWSSDDLLVKYQYLSDFFIAVAYFSIPLELVYFVQKSAFFPYRWVLTQFGAFIILCGATHFISLWTFTIHSKTVILVMAVAKVSTAVVSCATALMLVHIIPDLLSVKTREMFLKNKAEELDREMVIIRAQEETGRHVRMLTHEIRSTLNRDTILKTTLVELGRTLGLEECALWMPSHNGSSLQLSLTLRYPISVGATVSIQLPIVNKVFNSIHAVIIPHSCPLARIRPLSGKYVPPEVAAVRVPLLYLSNSQVNNWPELSANGYAVMVLMLPSDSARKWHVHELELVEVVADQVAVALSHASILEESMRAQDMLTEQNAALDLARQEAERAICARNDFLAVMNHEMRTPVHAIIALSSLLLETELTPEQRVMVETVLKSSNLLETLINDVLDLSRLEDGSLKLDIGIFNLHAVFREVINLIKPIAAMKKLSLSLMVAPNVPAFAVGDERRLMQIILNVAGNAVKFTKEGQVSVMACVEKQESLADPQALESYPASSDSHFHLRVQIKDSGCRVSPQDIPHLFTKFCICTRSGVNRSQDGSGLGLAICKRFVNLMEGHIWLQSEGLGKGCTATIVVKLGNNGNKTEESTQVVPRAHPKCGVENLSSRNPFLTISSRTQILKKCLLDF

SEQ ID NO: 14313 - protein, 1548 aa, Dictyostelium discoideum
MDKENNSQFYFHKDDKIKKNVKNPTPKNESNVNDKNIPNNNKENNNNNNNNNNNNNNNNNNKNNNNNNNNNNNKTIEIDDENEEAKKINLAFEREISPKKNNYLKTIECFFQKMNDTPNNEKKSQDLEEFDHLGDNSPLTKRKKKQNKDGKYYNLSASDFDSRLIKSSSSNESMDSLDSSCSCNACDYNSEYNNNNNNNNNNNNNNNNNNNNNNNNNINNINSNSSNDNNNKNNYNNNINKSDFQKMEKFDNYLGGDDESGEQPNDQHQLQIQKQNPLYNVKDKKSLIGNNLLDSSFNSMNSSSNSNKTTKSFNSLEELSISMDSSEPYNMFSMNNDQLFSNIVQYFLKYFPHLDQIIISQVFNGTNNCLVLCEYKDGKVTSDFNYISDSGKFPQKSNKLFLEGRTLRIPLITPDNLYGEIKLYPTVPEDIKELDNNMILKFIIQQCVFKVAKIFSDNLIQIFMDISSVYSSSTLFFSKLSLLMCKVFNSKVCCAGISVLNKDGLFDTIAFCSSTQELENFSYSLKKISKNITYYDNINEIFNNSEIIKKYNLKSYMEIPLKDSKEFYFGDIVLFGDQTLNPNILDTNILTFITNRTSMEFEKKKVSDQLIIAKNLLDQSPSCSCLVSRNGKIIRKIGAFYERLLGLEIGENISSVEKSSDISTILKQVCFENNNLSTETTITKKNGEKYPAEVFVKEISDIHSNSIGIMIIVRDITDQIRLKEMNIELQKKSELEQKRNQELMEARDLALTATKIKSQFLATISHEIRTPLNGIITMGEMLLSTSPLNTEQHDIAETIFGSSELLLSITSDILDFSKIEASKLELEMIEFDFIGCLEGIGKTIGVSITNKPIEIAFLMDTDIPHRLIGDPNRLIQIMLNMGTNAVKYTDRGHIVFRISVISREQNRCKIKISIDDSGIGIGEDQRAHLFEPFHQIDSSSTRKYGGSGLGLAISSKLAKLMGGEVILERSKPGVGSLFSVTLNFEQIGSNTLKSLLPDKSFSRNKTCIILDNYEYTASIASQRFDQIFEESNIILVKESTVKKFFELVQEYKINGDVNKIDLKNLDPELLPFFDSSLICIIVFHRFMDNLDIFLKYVKDFIEFYKKKIVVALGINHKNFKNLPKRRDFLIFKKPISSTNLIKVSNMARKIIPKSSSSSNLIQTISQIDNQQQQQQQQLQQQEQEQQHQQQQLQQEQQFVTISPHSDSSEKKTTPKKDRGKYDFNISPLRIDRFGTESTSSPKIKLYSDTSSDSGESDEFEFSENLRELKSDGELVVLKNQPYKEQRLSNIQLINDPIVTPPTPKANSEVVSTKAESTFFQSSSITIKETRSDSVNSVNSVNSVNSVNSLNSENSNNSLDVGIRTRPRILLVDDNAVNRKVVKLQLKKLGYDCDTATNGFEGFEMQKKDNYELIFMDLNMPLCDGSMASKLIRSHEELNNYKSRANIVGLSATYLHGSKDYCVSMGMDDFVVKPLKLQPLGELVKKYLEVENNNNNNNNNNNNNNNNNSNNNNSNSNSNPNSNSNSNSNSNSNPNQNPNYCNNLPTDFI

SEQ ID NO: 14314 - protein, 367 aa, Rattus norvegicus
EPRGTAGVVPVVPGEVEVVKGQPFDVGPRYTQLQYIGEGAYGMVSSAYDHVRKTRVAIKKISPFEHQTYCQRTLREIQILLGFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEAP

SEQ ID NO: 14315 - protein, 374 aa, Rattus norvegicus
APGGGGGEPRGTAGVVPVVPGEVEVVKGQPFDVGPRYTQLQYIGEGAYGMVSSAYDHVRKTRVAIKKISPFEHQTYCQRTLREIQILLGFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEAP

SEQ ID NO: 14316 - protein, 262 aa, Homo sapiens
MTSVQQLFSLEGQTALVTGGTRGIGQSMAIAHAEAGADILLVQRDTSNQTTKQKIESLGRKATIYTADLSSKSSITALIPSILSDGHRIHILLNCGGIQKRHPAHQFPDEDWDAVLQVNLTSVFQLCRDVGAHMLSQPADLPLGRRGSIINVASLLTFQGGITVPAYAASKGGVGQLTKALSNEWASKGVSVNAIAPGYIATDMNEALIKDEKRAESILSRIPAGRWGAPEDFKGAVVFLGSAASAYVSGEVLTVDGGWMGR

SEQ ID NO: 14317 - protein, 154 aa, Azoarcus evansii
MNDEDYMRVALEQAREAGSCDEVPVGAVVVLDGEIVGRGFNQPIGRHDPTAHAEVMALRDAAARLGNYRLPGCELYVTLEPCAMCSGAIMHSRIARVVFGARDPKTGVAGSVIDLFAESRLNHHATISGGVLAEECGGLLSSFFAARRGRTLVA

SEQ ID NO: 14318 - protein, 240 aa, Paracoccus zeaxanthinifaciens
MSKVALVTGGSRGIGAEICKALQAAGYTVAANYAGNDDAAKAFTEETGIKTYKWSVADYDACKAGIAQVEEDLGPIAVLINNAGITRDAPFHKMTPEKWKEVIDTNLTGTFNMTHPVWPGMRERKFGRVINISSINGQKGQFGQANYAAAKAGDLGFTKSLAQEGARNNITVNAICPGYIATDMVMAVPEQVREGIIAQIPVGRLGEPSEIARCVVFLASDDAGFVTGSTITANGGQYYI

SEQ ID NO: 14319 - protein, 143 aa, Paracoccus zeaxanthinifaciens
MMTDGPATPILDRVQQPSDLASLDDAQLRLLADELRAETIDIVSRTGGHLGAGLGVVELTVALHAVFRAPRDKIVWDVGHQCYPHKILTGRRDRMRTLRMGGGLSGFTKRQESAFDPFGAGHSSTSISAALGFAMARELGGDP

SEQ ID NO: 14320 - protein, 502 aa, Rattus norvegicus
MEKEDQEKTGKLTLVLALATFLAAFGSSFQYGYNVAAVNSPSEFMQQFYNDTYYDRNKENIESFTLTLLWSLTVSMFPFGGFIGSLMVGFLVNNLGRKGALLFNNIFSILPAILMGCSKIAKSFEIIIASRLLVGICAGISSNVVPMYLGELAPKNLRGALGVAPQLFITVGILVAQLFGLRSVLASEEGWPILLGLTGVPAGLQLLLLPFFPESPRYLLIQKKNESAAEKALQTLRGWKDVDMEMEEIRKEDEAEKAAGFISVWKLFRMQSLRWQLISTIVLMAGQQLSGVNAIYYYADQIYLSAGVKSNDVQYVTAGTGAVNVFMTMVTVFVVELWGRRNLLLIGFSTCLTACIVLTVALALQNTISWMPYVSIVCVIVYVIGHAVGPSPIPALFITEIFLQSSRPSAYMIGGSVHWLSNFIVGLIFPFIQVGLGPYSFIIFAIICLLTTIYIFMVVPETKGRTFVEINQIFAKKNNVSDVYPEKEEKELNDLPPATREQ

SEQ ID NO: 14321 - protein, 310 aa, Rattus norvegicus
GKSTIVKQMKIIHEDGFSGEDVKQYKPVVYSNTIQSLAAIVRAMDTLGVEYGDKERKADSKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYPGSNTYEDAAAYIQTQFESKNRSPNKEIYCHMTCATDTNNIQVVFDAVTDIIIANNLRGCGLY

SEQ ID NO: 14322 - protein, 571 aa, Cucurbita maxima
MGNTCRGSFKGNIFQGYSQPEDSSTLYSKRNNSSSSARSNSDISPTSINTHNLIAQEFSKENKTKSKDNDYNQAFLSPTKKDFTMRKSAENQAYYVLGHKTANIRDLYTLGRKLGQGQFGTTYLCTEITTGIEYACKSISKRKLIAKEDVEDVRREIQIMHHLAGHKNIVTIKGAYEDSLYVHIVMELCSGGELFDRIIHRGHYSERKAAELTRIIVGVVETCHSLGVMHRDLKPENFLLVNKDDDFSLKAIDFGLSVFFKPGQIFTDVVGRPYYVAPEVLLKHYGPAADVWTAGVILYILLSGVPPFWAETQQGIFDAVLKGHIDFDSDPWPLISDSAKDIIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDIEIRDLMDAADIDNSGTIDYGEFIAATIHLNKLEREEHLVAAFRYFDKDGSGYITVDELQQACAEHNMTDAYLEDVIREVDQDNDGRIDYGEFVAMMQKGNAGVGRRTMRNSLNLSMRDGPGAL

SEQ ID NO: 14323 - protein, 558 aa, Cucurbita maxima
MGNTCRGSFKGNIFQGYSQPEESSTPNFKRNINGSSDHSPSSINTNNLISQAFAEENKTKSKDNDCKKDYTMRKSAENQAYYVLGHKTANIRDLYTLGRKLGQGQFGTTYLCTEIMTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENFLLVNKDDDFSLKAIDFGLSVFFKPGQIFTDVVGSPYYVAPEVLLKHYGPAADVWTAGVILYILLSGVPPFWAETQQGIFDAVLKGHIDFDSDPWPLISDSAKDLIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDTEIRDLMEAADIDNSGTIDYGEFIAATIHLNKLEREEHLVAAFRYFDKDGSGYITVDELQQACAEHNMTDAYLEDIIREVDQDNDGRIDYSEFVAMMQKGNAGIGRRTMRNSLNLSMRDGPGAL

SEQ ID NO: 14324 - protein, 485 aa, Arabidopsis thaliana
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEAIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 14325 - protein, 505 aa, Oncorhynchus kisutch
MPSGFQQLGGETVTGTLALSVFTAVLGSFQFGYNIGVINAPQKIIEADYNATWVHRYGEPIPSSTLTTLWSLSVAIFSIGGMISSFCVGVISEWLGRRKAMLINNLFAFIGGGLMGMAKISRSFEMMILGRFVIGAYCGLASGLVPMYVGEIAPTSLRGALGTLHQLAIVTGILMAQVLGLESLLGSEELWPVLVGVTVLPTVLQMVLLPFCPESPRFLYIIRSQEHHAKSGLRRLTGRQEVGDMLAEMKEEKRRMDMERKVSIAELFRSPMYRQPIIIAILLQLSQQLSGVNAIFYYSTSIFQKAGVQSPVYATIGAGVVNCAFTVVSLFLVERTGRRTLHMLGLSGMCGCAIVMTMALALLDSVPWMSYISMLAIFGFVAFFEVGPGPIPWFFVAELFSQGPRPAAMAVAGFANWTANFIIGFGFQYVAELCGPYVFLIFAALLLFFLIFTFFRVPETRGKTFDQISNTFSKHSPAMIDMDLDMELGKHSTELDYLGEEGSLN

SEQ ID NO: 14326 - protein, 365 aa, Drosophila melanogaster
MSRKMAKFYKLDINRTEWEIPETYQNLQPVGQGAYGQVCKAVVRGTSTKVAIKKLARPFQSAVHAKRTYRELRLLKHMDHENVIGLLDVFHPGQPADSLDQFQQVYMVTHLMDADLNNIIRTQKLSDDHVQFLVYQILRGLKYIHSAGVIHRDLKPSNIAVNEDCELRILDFGLARPAESEMTGYVATRWYRAPEIMLNWMHYNQTADIWSVGCIMAELLTGRTLFPGTDHIHQLNLIMEVLGTPADEFMSRISSESARNYIRSLPVMPRRNFRDIFRGANPLAIDLLEKMLELDADKRITAEQALAHPYMEKYHDPTDEQTAALYDQSFEENELPVEKWREMVFSEVTAFKPTAAFAELLPKEQ

SEQ ID NO: 14327 - protein, 476 aa, Hordeum vulgare
MRTTTRRLPPAPAAAAVLLAALTCLLLRPAAVAAAGGHAADRIVRLPGQPEVDFDMYSGYITVDEAAGRSLFYLLQEAPEEAQPAPLVLWLNGGPGCSSVAYGASEELGAFRVMPRGAGLVLNEYRWNKVANVLFLDSPAGVGFSYTNTSSDIYTSGDNRTAHDSYAFLAAWFERFPHYKYREFYVAGESYAGHYVPELSQLVHRSGNPVINLKGFMVGNGLIDDYHDYVGTFEFWWNHGIVSDDTYRRLKDACLHDSFIHPSPACDAATDVATAEQGNIDMYSLYTPVCNISSSSSSSSLSRRRTRGRYPWLTGSYDPCTERYSTAYYNRRDVQTALHANVTGAMNYTWTNCSDTINTHWHDAPRSMLPIYRELIAAGLRIWVFSGDTDAVVPLTATRYSIGALGLATTTSWYPWYDDLQEVGGWSQVYKGLTLVSVRGAGHEVPLHRPRQALILFQQFLQGKPMPGRTTNVTVA

SEQ ID NO: 14328 - protein, 506 aa, Arabidopsis thaliana
MDSSPNDGVHQPLLHPQPSPSPPESTNGELETVLSDVETPLFLRLRKATIIESKLLFNLAAPAVIVYMINYLMSMSTQIFSGHLGNLELAAASLGNTGIQVFAYGLMLGMGSAVETLCGQAYGGRKYEMLGVYLQRSTVLLTLTGLLLTLIYVFSEPILLFLGESPAIASAASLFVYGLIPQIFAYAANFPIQKFLQSQSIVAPSAYISTATLFVHLLLSWLAVYKLGMGLLGASLVLSLSWWIIVVAQFVYIVTSERCRETWRGFSVQAFSGLWSFFKLSAASAVMLCLETWYFQILVLLAGLLENPELALDPLSICMTISGWVFMISVGFNAAISVRVSNELGAGNPKSAAFSVIIVNIYSLITCVILAIVILACRDVLSYAFTEGKEVSDAVSDLCPLLAVTLVLNGIQPVLSGVAVGCGWQTFVAKVNVGCYYIIGIPLGALFGFYFNFGAKGIWTGMIGGTVIQTFILAWVTFRTDWTKEVEEASKRLDKWSNKKQEVVPE

SEQ ID NO: 14329 - protein, 494 aa, Arabidopsis thaliana
MGQRNRNVDLEMEQQQSQASLQAEPCILLGSFPQQPDNNNMPAMVAHVPNLEPHSLQDPTYDNSAMFYGLPQYHHHPHQRAPTNFYVPYVAFQAPPGQLPSSSSHGVVGVSPDHEYERNAHFMDHTRGTYKRKNAEGIPGQPQYLSTLAAPFNTPETIAPFGGARNRPGAVTVNTVLPSHAPNNFIQGNYAGHHPFPPPGSMWYDQHHGRSDGSPSFWPTPYMHGSNIFAGSIESSSRNPTSFMYPSQLNPRDHYYSHHHHPAPPPVQGMRGQNATLYPHTASSASYRVPPGSFTPQNTMNSGPLGSEMGSSHMGPVQPTGFRIYQHHQRDDSVPVATLRQHRGGVPRLRVMPDDEVALLEFGDFLGGSGNNHIDHHRDMRLDIEEMSYEELLALSERIGTVNTGLPEEDVKNHLKTRTCSGINFEKESSSPRTKDLETEPCTICQESFKNEEKIATLDCGHEYHAECLEKWLIVKNVCPICKSEALVMEKRKV

SEQ ID NO: 14330 - protein, 348 aa, Homo sapiens
MGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 14331 - protein, 95 aa, Homo sapiens
NSGASKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 14332 - protein, 315 aa, Plasmodium berghei strain ANKA
MAKLSKAQKKQIYMDKLSSLIQQYNKILIVHVDNVGSDQMASVRQSLRGKATILMGKNTRIRTALKKNLQAVPQIEKLLPLVKLNMGFVFCKDDLSEVRNIILQNKSPAPARLGVIAPIDVFIPPGPTGMDPSHTSFFQSLGISTKIVKGQIEIQENVHLIKQGEKVSASSATLLQKFNMKPFSYGVDVRTVYDDGVIYDAKVLDITEEDILEKFSKGVANVAALSRSVGIITEASYPHVFVEAFKNIVSLVIDTDYTFPLMKKIKDMVENPQAYAAAPVAASSAQKDEPEKEAAKKEEEEEEEEDGFMGFGMFD

SEQ ID NO: 14333 - protein, 219 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 14334 - protein, 163 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 14335 - protein, 409 aa, Vibrio cholerae O37
MTMKVTHVNSGDLIGRRFNGYDLKPYLSDLGVETSQLVYWNKQSNADFVHQAFDYPGSRYITRAVNLVEQRLSLHAKLHPHSWALPYHAEIKNADLVHMHIIHDGFFSMDAIPFLSRRKPIVWTWHDPWPMTGHCIYPMECDKWKTGCGNCPNLEAPFRMRKDRTKQQFSWKNNIYKKTKAEVVLASKWMLDMAQNSPFSEYFNFTQIPFGLDLEKYRPRDKKVARERLGIFPDRAVEFIRASSTPFKGLREFVEALALINPELKLCIIALQEVGHFDQFIGKHQIIEFGWSNDEELLLDAYAACDFFAMPSMAEAFGLMAIEAMACGRPVLSFDSTSLEDVSFAPSAGISVPRGDTNLLAKAIEELVMDPHECEKRGNLSRELAEKHYDIRMQAQLSFELYDRVLSNS

SEQ ID NO: 14336 - protein, 378 aa, Vibrio cholerae O37
MYKANRNLHITTVVKDSSKHGGGMLAVAYSVHKYLCSKLSNASFISSCASCYKVENSWIVGELGIRTFFISNKAIGDITHVHGVWTPFEFFVIKAAKKRNSKIVVSPHGALEPWAFQSKGLKKRIAWYLYQKRILTEADLIIVNSQKERDNLRRLGLNGPIAVIPNGIILDGYDKQSAMKSEREKIILYFSRLDKKKGIELLIKAWRKVKDKRGYKLHIQGYGDQSYRLFLHDMVSKFGLEEEILFIDPSYDEKRWASFFSASFYILPSYSENFGITVAEALISGLPAITTTEMPWEDLTNEGIGWSVKCNESAIAEAITEAIGIDESKLALMRRRAVDYAEKHFSWETIVQDYGLAYQWVLSPDLESIPKSITNSYS

SEQ ID NO: 14337 - protein, 1007 aa, Eimeria maxima
MGACSSKAQQQTRDPEPREQQPALEPKTSEPCGPSDAAAPVEAVRKMSGSSATAPKGEMPTASTGTPEQQQQQQEQQQQQQQQLERQQQQQQEQQQHQEQQQQQQEQQEQQQQDRKTSQPQQNDDAAAPPKPGGERKAQKAIMQQDDTQAEDARLLNHLEKREKTDSDLSLIRSSLSGNLVCSSLNDSEVEALANAVQFFTFAKGDIVTKQGENGSYFFIVHSGEFEVIVNEKVVNKIVQGQAFGEISLIHNSARTATIKTLSDQAALWGVQRQVFRETLKQLSSRNFAENRQFLASVEFFQMLTEAQKNVITNALVVQSFKPGQPIVKEGEKGDILYIIKSGKARVSIKGKDVRLLQKGDYFGERALLYDEPRSATITAEEETICVSIGRDLLDRVLGNLQHVLFRNIMLEALQQSKVFASFPTEQLSRLIGSVVVKDYPENYLILDRENRTKASASPLFSAQGVRFFFVLEGEVSVYAYREAPSASSSGGGSSSGEPRMELHLVDTLKRGQAFGDEYVLSPNKPFAHCVRSNGPAKLALLTASALTATLGGQDIDETLDYNNKLAITKKMYIFRYLSEQQTQTLIRAFKTVRYTQGEAIIREGEIGSRFFIIKLGEVAILKGGRRVRTLGRHDYFGERALLHDERRSATVAANSPEVDLWVVDKDVFLQIVKGPMLTHLEERIRMQDTKVEFKDLQVVRVVGRGTFGTVKLVQHIPTKIRYALKCVSRKSVVALNQQDHIRLEREIMAENDHPFIIRLVRTFRDKDFLYFLTELVTGGELYDAIRKLGLLGRYQAQFYLASIVLAIEYLHERNIAYRDLKPENILLDSQGYVKLIDFGCAKKMQGRAYTLVGTPHYMAPEVILGKGYTLTADTWAFGVCLYEFMCGPLPFGNDAEDQLEIFRDILAGKLMFPHYVTDQDAINLMKRLLCRLPEVRIGCSINGYKDIKEHAFFSDFDWDRLAGRDLSPPLLPKGETYAEDAEEGGLEIEEDEGIELEDEYDWDKDF

SEQ ID NO: 14338 - protein, 277 aa, Homo sapiens
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMGCPPSPPPPTAVRTLSADTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSR

SEQ ID NO: 14339 - protein, 228 aa, Lilium regale
MGRGKIEIKKIENSTNRQVTYSKRRTGIIKKATELTVLCDAEVSLLMFSSTGKLSEFCSPSTDTKKIFDRYQQLSGINLWSAQYEKMQNTLNHLSEINRNLRKEISQRMGEELDGLDIKDLRGLEQNLDEALKLVRHRKYHVINTQTETYKKKVKNSEEAHKNLLRDLVNREMKDENPVYGYVDEDPSNYDGGLALANGASHLYEFRVQPSQPNLHGMGYGSHDLRLA

SEQ ID NO: 14340 - protein, 210 aa, Lilium regale
MGRGKIEIKRIENSTNRQVTFSKRRNGIIKKAREISVLCEAQVSVVIFSSSGKMSEYCSPSTSLPKILERYQVNCGKKIWDPKHEHLSAEIDRIKKENDNMQIQLRHLKGEDLNSLQPKELIPIEEALENGIRGVREKQNDFLRMLKKNERILEEDNKRLTYILHHQQLAMDENMRNLEFAYHHKDGDFSSQMPMAFRVQPIQPNLHEDK

SEQ ID NO: 14341 - protein, 181 aa, Lilium regale
MGRGKIEIKRIENSTNRQVTFSKRRNGIIKKARELSVLCEAHVSVVIFSSSGKMSEYCSPSTSLPKILERYQLNSGKKIWDAKHEHLSAEIDRIKKENDNMQIELRHLKGEDLNSLQPKELIPIEEALENGVRGVREKQNDVLRMLKKNERILEEDNKRLAYILHHHQLTRGEYEGHGTCM

SEQ ID NO: 14342 - protein, 268 aa, Sequoia sempervirens
VEHRPFSPAEDAAIIEAHLRHGNKWATIARLLPGRTDNAIKNHWNSTLRRRSLQQQSHNLGRKRSGVFSEEDYEVESRGLKRPNLIQSPSGSDNSSDFNLNVSFPGSTSAGSSLHRQSAFKSYESQKTPEDASSPWSPSSGSPSVLCSSDPPTLLSLSLPGSTSSSENNGGECQEQNCSPSPVILQANQQPPVPVSGDYLKAEDAMSMMSAAVKMAVTQALPLMFQSSTGVGTSSDFGGGALSVMREMIAKEVRSYMNGLNAFAPVLK

SEQ ID NO: 14343 - protein, 187 aa, Sequoia sempervirens
ICTYFAQPLHQRDYTRWPEKPEGWREIVDKYSETLMGLATKLLAIVSEALGLEPEAVTKACVEMDQKVVINYYPKCPQPDMTLGLKRHTDPGTITLLLQDQVGGLQATKDNGVNWITVEPVQGAFVVNLGDHMHYLSNGKFKSADHQAVVNSNSSRLSIATFQNPSQEAIVYPLKLEEGEQSFMEEP

SEQ ID NO: 14344 - protein, 187 aa, Glyptostrobus lineatus
ICTYFAQPLHQRDYTRWPEKPEGWREIVDKYSEALMGLASKLLGIVSEALGLEPEAVTKACVEMDQKVVINYYPKCPQPDMTLGLKRHTDPGTITLLLQDQVGGLQATKDDGLNWITVEPVQGAFVVNLGDHMHFLSNGKFKTADHQAVVNSNYSRLSIATFQNPSQEAIVYPLKLEEGEQSFMEEP

SEQ ID NO: 14345 - protein, 187 aa, Glyptostrobus lineatus
ICTYFAQPLHQRDYTRWPEKPEGWREIVDKYSEALMGLASKLLAIISEALGLEPEAVTKACVEMDQKVVINYYPKCPQPDMTLGLKRHTDPGTITLLLQDQVGGLQATKDDGLNWITVEPVQGAFVVNLGDHMHYLSNGKFKTADHQAVVNSNYSRLSIATFQNPSQEAIVYPLKLEEGEQSFMEEP

SEQ ID NO: 14346 - protein, 187 aa, Taxodium distichum
ICTYFAQPLHQRDYTRWPEKPEGWREIVDKYSEALMGLASKLLAIISEALGLDPEAVTKACVEMDQKVVINYYPTCPQPDMTLGLKRHTDPGTITLLLQDQVGGLQATKDDGLNWITVQPVQGAFVVNLGDHMHYLSNGKFKTADHQAVVNSNCSRLSIATFQNPSQEAIVYPLKLEEGEQSFMEEP

SEQ ID NO: 14347 - protein, 187 aa, Chamaecyparis pisifera
ICTYFAQPLYQRDYSRWPDKPEGWREIVDKYSEALMGLASKLLAIVSEALGLEADAVTKACVEMDQKVVINYYPKCPEPDMTLGLKRHTDPGTITLLLQDQVGGLQATKDDGLNWITVQPVQGAFVVNLGDHMHYLSNGKFKTADHQAVVNSNYSRLSIATFQNPSQEASVYPLELEEGEKSFMEEP

SEQ ID NO: 14348 - protein, 187 aa, Thujopsis dolabrata
ICTYFAQPLHQRDYSRWPLKPEGWREIVDKYSEALMDLASKMLTIVSEALGLEPDAVTKACVEMDQKVVINYYPKCPEPDMTLGLKRHTDPGTITLLLQDQVGGLQATKDNGLNWITVQPVQGAFVVNLGDHMHYLSNGKFKTADHQAVVNSNYSRLSIATFQNPSQEAIVYPLKLEEGEECFMEEP

SEQ ID NO: 14349 - protein, 187 aa, Thujopsis dolabrata
ICTYFAQPLHQRDYSRWPLKPEGWREIVDKYSEALMGLASKMLAIVSEALGLEPDAVTKACVEMDQKVVINYYPKCPEPDMTLGLKRHTDPGTITLLLQDQVGGLQATKDDGLNWITVQPVQGAFVVNLGDHMHFLSNGKFKTADHQAVVNSNYSRLSIATFQNPSQDAIVYPLKLEEGEECFMEEP

SEQ ID NO: 14350 - protein, 187 aa, Thuja standishii
ICTYFAQPLHQRDYSRWPVKPEGWREIVDKYSEALMGLAKKMLAIVSEALGLEPDAVTKACVEMDQKVVINYYPKCPEPDMTLGLKRHTDPGTITLLLQDQVGGLQATKDNGLNWITVQPVQGAFVVNLGDHMHYLSNGKFKTADHQAVVNSNYSRLSIATFQNPSQDAIVYPLKLEEGEECFMEEP

SEQ ID NO: 14351 - protein, 187 aa, Thuja standishii
ICTYFAQPLHQRDYSRWPLKPEGWREIVDKYSEALMGLAKKMLAIVSEALGLEPDAVTKACVEMDQKVVINYYPKCPEPDMTLGLKRHTDPGTITLLLQDQVGGLQATKDDGLNWITVQPVQGAFVVNLGDHMHYLSNGKFKTADHQAVVNSNYSRLSIATFQNPSQDAIVYPLKLEEGEESFMEEP

SEQ ID NO: 14352 - protein, 187 aa, Cryptomeria japonica
ICTYFAQPLHQRDYTRWPEKPEGWREIVDKYSEVLMGLASKLLAIISEALGLEPEAVTKACVEMDQKVVINYYPKCPQPDMTLGLKRHTDPGTITLLLQDQVGGLQATKDDGLNWITVEPVQGAFVVNLGDHMHYLSNGKFKTADHQAVVNSNYSRLSIATFQNPSQGAIVYPLKLEEGEQSFMEEP

SEQ ID NO: 14353 - protein, 187 aa, Cryptomeria japonica
ICTYFAQPLHQRDYTRWPDKPEGWREIVDKYSEALMGLASKLLQIVSEALGLEPEAVTKACVEMDQKVVINYYPKCPQPDMTLGLKRHTDPGTITLLLQDQVGGLQATKDDGLNWITVEPVQGAFVVNLGDHMHFLSNGKFKTADHQAVVNSNYSRLSIATFQNPSQEAIVYPLKLEEGEQSFMEEP

SEQ ID NO: 14354 - protein, 346 aa, Homo sapiens
MADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQ

SEQ ID NO: 14355 - protein, 1198 aa, Mus musculus
MAGAQPGVHALQLKPVCVSDSLKKGTKFVKWDDDSTIVTPIILRTDPQGFFFYWTDQNKETELLDLSLVKDARCGKHAKAPKDPKLRELLDVGNIGHLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPSLACLRIAAYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETSSEAPSETRTTPAENGVNHTASLAPKPPSQAPHSQPAPGSVKAPAKTEDLIQSVLTEVEAQTIEELKQQKSFVKLQKKHYKEMKDLVKRHHKKTTELIKEHTTKYNEIQNDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHNEIRQQILDEKPKLQTELEQEYQDKFKRLPLEILEFVQEAMKGKISEDSNHGSAPPSLASDAAKVNLKGS

SEQ ID NO: 14356 - protein, 1198 aa, Mus musculus
MAGAQPGVHALQLKPVCVSDSLKKGTKFVKWDDDSTIVTPIILRTDPQGFFFYWTDQNKETELLDLSLVKDARCGKHAKAPKDPKLRELLDVGNIGHLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPSLACLRIAAYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETSSEAPSETRTTPAENGVNHTASLAPKPPSQAPHSQPAPGSVKAPAKTEDLIQSVLTEVEAQTIEELKQQKSFVKLQKKHYKEMKDLVKRHHKKTTELIKEHTTKYNEIQNDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHNEIRQQILDEKPKLQTELEQEYQDKFKRLPLEILEFVQEAMKGKISEDSNHGSAPPSLASDAAKVNLKWS

SEQ ID NO: 14357 - protein, 155 aa, Toxoplasma gondii
MDGAGKVGGKVGGKVGGKVGGMGKGGKGKSGSGKGKKAPLSRAARAGLQFPVGRVHRMLKSRISSEGRVGSTAAVYASAILEYLTAEVLELAGNASKDLKVKRITPRHLQLAIRGDEELDTLIKATIAGGGVIPHIHKSLMTKGPSTQPMKKAKK

SEQ ID NO: 14358 - protein, 193 aa, Cucumis sativus
  unsure (1)..(193): unsure at all Xaa locations
TGDEGNNEYKKGLWTVEEDKILMDYVKAHGKGHWNRIAKKTGLKRCGKSCRLRWMNYLSPNVKRGNFTEQEEDLIIRLHKLPGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFINX

SEQ ID NO: 14359 - protein, 525 aa, Oryza sativa (japonica cultivar-group)
MAAAIIGVGGGGWTRLRSIGHGASGATVSLAADDASGELFVVKSAGDAVAATARQQLRREWSVMSGLSSPHVLRCLGFVQAAAGAGGEHQLLLEYAPGGSLADVVARNGDRLDESAFRAYAADVLRGLDYLHEKLVVHGDVKGSNVLVGADGRAKLADFGCARVVMPGGSKQPVLGGTPAFMAPEVARGEEQGPAADVWALGCTVIEMATGRAPWSDMDDVLAALRMIGYTDAVPDLPPWLSPEAKDFLRRCMQRRAGDRPTAAQLLQHPFVSKSCGLKKEVVKATWVSPTSALDAAAALWESETSSSTDDEEADDMSNSPTGRIIAMASSGGQTLPDWDSDDHGWIEVLGTVSINIAKKKTAAAEDYEASESPAKRVRAMACSPSSVPDWDSDNHGWIDVLSASPADDNGGEGNAPEEFDVVAAADQIFGEAVGSIVVGVGSEQSVVVENQEDEFISLSYCSERILLVAVHAADNNAASRKAGIKECSHDPRPSIPSRCAHNLFLSLIFIQIDNSNVVPFAPKY

SEQ ID NO: 14360 - protein, 1076 aa, Homo sapiens
LLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLSTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 14361 - protein, 347 aa, Oryza sativa (japonica cultivar-group)
MRSMFLPVLPLRACGTGTTAPVPPPTASLRRELALSPNLPARGGVAGQPNAATREAPAAAVSSARRVVVVSPSLARRRRTRPPPPPPPPLLFSPRVFSASPPFGLIPRMRSLRLRSGRRRGESGGDQAGALILSWVDANYRGYLDEQFCQVEDLQDEASPNFVEEVVTLFFKDSGRLMSNIEQALCMRSFQKVKREHAVLRQKLESYFQLCSCTWAEEQKGILADDRLAKKPSRQYSMEKGSATNRAIPDFRSAAAMSDAMRRARRRSPCHARNTRNGTRRAGARPDPEPSRQPIRVLGGRSLSVDETWVTSPAAAVFLRHGETRAPAFALGTAGRRRGEDDMSVIR

SEQ ID NO: 14362 - protein, 950 aa, Homo sapiens
KPSRAANPPARPRSCPPCLAAGPSMVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 14363 - protein, 595 aa, Homo sapiens
APRLRTRWSWKLRRMGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 14364 - protein, 489 aa, Homo sapiens
RAPGRLRSVRRLSRPRARPEAVSVTMAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 14365 - protein, 2675 aa, Homo sapiens
SPGRMAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDFSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 14366 - protein, 2044 aa, Homo sapiens
HTEVFMDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 14367 - protein, 365 aa, Cryptococcus neoformans var. neoformans
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAGDIWSTGCIFAEMLEGKPLFPGKDHVNQFSIITELLGTPPDDVIQTIASENTIRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 14368 - protein, 99 aa, Branchiostoma floridae
RAALESCHKGWGTSVIIGVAAAGQEISTRPFQLVTGRVWKGTAFGGWKSVESVPRLVGEYQAGKIKVDEFISHTFPLDNINQSFQLMHDGESIRSVIHF

SEQ ID NO: 14369 - protein, 169 aa, Branchiostoma floridae
MADTAGKPISCRAAVAWEAKKPLVIETIEVAPPRAHEVRIKVLATGVCHTDAYTLSGADSEGKFPVVLGHEGGGVVESVGEGVTGFQPGDHVIPLYIPQCRDCKFCRSPKTNLCQKIRVSQGQGVMPDGSSRFTCKGQTVYHFMGTSTFSEYTVVADISLCKVAESAPL

SEQ ID NO: 14370 - protein, 994 aa, Toxoplasma gondii
MGACISKNSSARVSRSSALSASKQTVAASAPPGAAGDETSATGAAEEASRNSLARVDGTRASAAELERAPDGVCPDREEPGTANAEQGGVTEKKDTRETLAGMNSPKTLEAEAQEDDLKREAPNQDVPSEAPEGPKEKPGGDRKPAQKAILKQDDSHTEEEKLNAHLAYREKTPADFALIQDSLKANLVCSSLNEGEIDALAVAMQFFTFKKGDVVTKQGEPGSYFFIIHSGTFDVLVNDKRVNAMDKGKAFGEIALIHNTERSATVVASSTEGALWGVQRHTFRETLKQLSSRNFAENRQFLASVKFFEMLTEAQKNVITNALVVENFKPGQPIVKEGDAGDVLYILKSGKAKVSIGGREIRMLRKGDYFGERALLYKEPRSATITAEEFTVCVSIGRELLDRVLGNLQHVLFRNIMVEALQQSKVYELFQGDQLSKLIEAAVVKDYGADYVILDKENKTKGIRFFFVLEGELSVYAYTQNPATKEEERKLAATLKRGQAFGEEYVLNPTRPFNHYVKSVGPCKLALFTSSVLTATLGGEDIDETLDFNNKRAIIRKMYIFRYLSDHQMTMLIKAFKTVRYMSGEYIIKEGERGTRFFIIKAGEVAILKNNKRLRTLGRHDYFGERALLYDKPRTASVCANSAGVDLWVVDKSVFNEIIKGPMLAHLEERIRMQDTKVEFQDLQVVRVVGRGTFGTVKLVRHVPTDIRYALKCVSRRSVIALSQQQHIRLEREIMAENDHPFIIRLVRTFRDKEFLYFLTELVTGGELYDAIRKLGLLARSQAQFYLASIVLAIEYLHERNIAYRDLKPENILLDSQGYVKLIDFGCAKKMQGRAYTLVGTPHYMAPEVILGKGYTLTADTWAFGVCLYEFMCGPLPFGNDAEDQLEIFRDILTGKLVFPHYVTDQDAINLMKRLLCRLPEVRIGCSINGYKDIKEHAFFGDFDWDKLAGRGLPPPLAPKGETYAEDTEQSSFELDEDDTIVLEDEYDWDKDF

SEQ ID NO: 14371 - protein, 187 aa, Oryctolagus cuniculus
MPVDLSKWSGPLSLQEVEERPQHPLQVTYSGVALDELGQVLTPTQVKNRPTSIVWDGLDPDKLYTLVLTDPDAPSRKDPKYREWHHFLVVNMKGGNISSGTVLSDYVGSGPPKGTGLHRYVWLVYEQDGPLKCDEPVLSNRSGDHRGKFKVANFRKKYHLGTPVAGSCYQAEWDDYVPKLYELLSGK

SEQ ID NO: 14372 - protein, 228 aa, Lilium longiflorum
MGRGKIEIKKIENSTNRQVTYSKRRTGIIKKATELTVLCDAEVSLLMFSSTGKLSEFCSPSTDTKKIFDRYQQLSGINLWSAQYEKMQNTLNHLSEINRNLRKEISQRMGEELDGLDIKDLRGLEQNLDEALKLVRHRKYHVINTQTETYKKKVKNSEEAHKNLLRDLVNREMKDENPVYGYVDEDPSNYDGGLGLANGASHLYEFRVQPSQPNLHGMGYGSHDLRLA

SEQ ID NO: 14373 - protein, 427 aa, Takifugu rubripes
MASFPESVNENDIDKAKFIGELLVPMAPFDQKAGREAWTVAFAPDGSYFAWSQGHRIVRLIPWAKCLSSFSVRHGGEVTNPTSPRHLSRQSCKGGSVIPMAGAPPEHTIDCGGIVWGMAFGSSVPEKQSRSINIEWHHFQFGRDQLLLATGLNNGRIKIWDVYTGTLLLNLMDHTDIVRDLTFAPDGSLMLVSASTDKKLRVWDLKDDGNMVKVLWGHPNRVYSSAFSPDSSVLCSVGASKAVLLWNMDKYTLIRKLEGHHNDVVSCEFSPDGALLATASYDTRVIVWDHQRGSILLELGHLFPPPSPIFAGGANDRWVRSVSFCADGRHIASVSDDRLVRFWSIEERAPQAVASLPNGLCCAFSTTGSVLAAGTCDGSVHFWECPRSIASLQHLCRMALRRVKTTQQVEALPVPMPLRDFLTYRVV

SEQ ID NO: 14374 - protein, 323 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 14375 - protein, 255 aa, Homo sapiens
MDDREDLVYQAKLAEQAERYDEMVESMKKVAGMDVELTDEERNLLSVAYENVIGARRTSWRIISSIEQKEENKGGENKLEMIREYQQMVETELKLICCDILDVLDKHLIAAANTGESKVFYYKTKWYYHRYLAEFATGNDRKEAAKNSIVAYKAASDIAMTELPPAHPIRLGLALNFSIFYYEILNSPDRACRLAKAAFNDAVVELDTLSEESYKDCKLIMQLLRDNLTLWTSDMQGDGEEQNKEVLQDVEDKNQ

SEQ ID NO: 14376 - protein, 317 aa, Homo sapiens
MPREDRATWKSNYFLKIIQLLDDYPKCFIVGADNVGSKQMQQIRMSLRGKVVVLMGKNTMMRKAIRGHLENNPALEKLLPHIWGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDKTEETLHSRFLEGVRNVASVCLQTGYPTVASVPHSIINGYKRVLALSVETDYTFPLAENVKAFLADPSAFVAAAPVAADTTAAPAAAAAPAKVEAKEESEESDEDMGFGLFD

SEQ ID NO: 14377 - protein, 237 aa, Oryza sativa
ENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 14378 - protein, 425 aa, Homo sapiens
MADYLSNCCTGYVPEDGLIPQQLFTSADGLTYNDVPILPGFIDFIADEVDLTSVLTRKITLKTPLTLISSPMDTVTEADMAIAMALMGGIGFIHHNCTPEFQAKRPGGAEPLAHCGYVLEAKMRHGFSGIPMTETDIMGSKLVGIITSADINFLAEKDHNTLLSEVMMPRIELVVAPAGVMLKEANEILQRSKKGKLPIVNDLDELVAIIACTDLKKNRDYPLASKDSHEQLLWHIHIYAAVGTHEDGKYCLDLLTQAGDDFIILDSSQGNSSVSDRHSALHQTEVPQPPGSDGLRSAPGHCCVQGGQVCPTLWCAHHRTVEHVVKALELGASTVMMGCLLAAITEAPCKYFSDGKHQGMGSLDAMEKSSSSQKQYFSEGDKVKITQGVSCSIQYKGGLKFEKQTVLAQIEGGVHGLCSHEKRLY

SEQ ID NO: 14379 - protein, 374 aa, Pseudomonas aeruginosa
MTFFVETQLRAQISALAHAGAEITIVASEKELSKDIDNCRYASIVIPRKISPLSDLLALYKLWRFFRKERFDIVHSTTPKAGLLCALAGKLAFVPIRLHTFTGQPWVGLKGLKYLLSKGSDKLIALLNTHCYADSISQRKFIIDSGVADDDDISVIGEGSLAGIDLKRFAASRYSLNERVSLKASLGIGRASKTLLFVGRLTQDKGVLELLAAFESLVGNHDVFLMLLGPHEMSEEELLAGFSSDLKERLILLGFSDEPEKFMAIADMLLLPSYREGFGTVVIEAAAMGVPTIGSDIYGLSDAIVNGETGLLVPVKNSQALAAAIDQLLGDERLCKELGEKARIRVEKEFSSQRISNLLIGEYTRLLEKDRGDS

SEQ ID NO: 14380 - protein, 374 aa, Pseudomonas aeruginosa
MTFFVETQLRAQISALAHAGAEITIVASEKELSKEIENCRYASIVIPRKISPLSDLLALYKLWRLFRKERFDIVHSTTPKAGLLCALAGKLAFVPIRVHTFTGQPWVGLKGLKYLLSKGSDKLITLLNTHCYADSISQRKFIIDSGVADGDDISVIGEGSLAGIDLKRFAASRYSLNERVSLKASLGIGGASKTLLFVGRLTQDKGVLELLAAFESLVGNHDVFLMLLGPHEMSEEELLAGFSSDLKERLILLGFSDEPEKFMAIADMLLLPSYREGFGTVVIEAAAMGVPTIGSDIYGLSDAIVNGETGLLVPVKNSQALAAAIDQLLGDERLCKELGEKARIRVEKEFSSQRISNLLIGEYTRLLEKDRGDS

SEQ ID NO: 14381 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 14382 - protein, 159 aa, Deschampsia antarctica
AQNGELYRYIADTHGAFVQPALYEAFGLTVVEAMTCGLPTFATLHGGPAEIIEHGISGFHIDPYHPDQAATLMVDFFEQCKQDPNHWVKISDRGLQRIYDKYTWKIYSERLMTLAGVYGFWKYVSKLERRETRRYLEMFYILKFRELVKSVPLALDEAH

SEQ ID NO: 14383 - protein, 424 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVDMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 14384 - protein, 424 aa, Arabidopsis thaliana
MDPEGFTRGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 14385 - protein, 430 aa, Arabidopsis lyrata
MDPEGFTSGLFRWNPTRAMVAAPPPVPPQPQQQPATPQTRAFGMRLGGLEGLFGAYGIRFYTAAKIAELGFTASTLVGMKDEELEEMMNSLSHIFRWELLVGERYGIKAAVTAERRRLQEEEEEESSRRRHLLLSAAGDSGTHHALDALSQEDDWTGLSEELDREPVQQQNQTDAAGNNGGGGSGYWEAGQAKMKKQQQQRRRKKPMVTSVETDDDVNEGDDDDGMDNGNGGGGGGLGTERQREHPFIVTEPGEVARGKKNGLDYLFHLYEQCREFLLQVQTIAKDRGEKCPTKVTNQVFRYAKKSGASYINKPKMRHYVHCYALHCLDEDASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 14386 - protein, 177 aa, Arabidopsis lyrata
MENMGTRVIEPLIMGRVVGDVLDFFTPTIKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFKQKQRRVIFPNIPSRDHFNTRKFAVEYDLGLPVAAVFFNTQRETAARKR

SEQ ID NO: 14387 - protein, 461 aa, Rattus norvegicus
MGSFTKEEFDCHILDEGFTAKDILDQKINEVSSCDDKDAFYVADLGDVLKKHLRWLKALPRVTPFYAVKCNDSRAIVSTLAAIGTGFDCASKTEIQLVQGLGVPPERIIYANPCKQVSQIKYAASNGVQMMTFDSEIELMKVARAHPKAKLVLRIATDDSKAVCRLSVKFGATLKTSRLLLERAKELNIDVIGVSFHVGSGCTDPETFVQAVSDARCVFDMGTEVGFSMYLLDIGGGFPGSEDTKLKFEEITSVINPALDKYFPSDSGVRIIAEPGRYYVASAFTLAVNIIAKKTVWKEQTGSDDEDESNEQTLMYYVNDGVYGSFNCILYDHAHVKALLQKRPKPDEKYYSSSIWGPTCDGLDRIVERCSLPEMHVGDWMLFENMGAYTVAAASTFNGFQRPNIYYVMSRSMWQLMKQIQSHGFPPEVEEQDVGTLPMSCAQESGMDRHPAACASASINV

SEQ ID NO: 14388 - protein, 354 aa, Xenopus laevis
MGCTLSAEERAALERSKQIEKNLKEDGVTAAKDVKLLLLGAGESGKSTIVKQMKIIHEDGFSGEDVKQYKPVVYSNTIQSLAAIVRAMDTLGIEYGDKERRADAKMVCDVVSRMEDTEPYSPELLSAMVRLWADSGIQECFNRSREYQLNDSAKYYLDSLDRIGAPDYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFAEKIKKSPLSICFPEYTGPNTYEDAAAYIQAQFESKNRSPNKEIYCHMTCATDTNNIQVVFDAVTDIIIANNLRGCGLY

SEQ ID NO: 14389 - protein, 79 aa, Plasmodium falciparum
RKILRDNIQGITKPAIRRLARRGGVKRISGLIYEEIRGVLKVFLENVIKDSIMYTEHAKRKTVTAMDIVYSLKRQGRTL

SEQ ID NO: 14390 - protein, 253 aa, Rattus norvegicus
MKEAAVEALKKKGWEVVESDLYAMNFNPLISRNDITGEPKDSENFQYPVESSLAYKEGRLSPDIVAEQKKLEAADLVIFQFPLYWFGVPAILKGWFERVLVAGFAYTYATMYDQGPFQNKKTLLSITTGGSGSMYSLQGVHGDMNVILWPIQSGILRFCGFQVLEPQLVYSIGHTPPDARVQVLEGWKKRLETVWEESPLYFAPSSLFDLNFQAGFLLKKEVQEEQKKNKFGLSVGHHLGKSIPADNQIKARK

SEQ ID NO: 14391 - protein, 661 aa, Hydra vulgaris
MNGIQSGFTGFMKIRILEALDLNKTNVKSQFVTSMKVSSLDPYLQAYVDDQVIAKTSKKTATYCPVWEEDFSIDLHKAKMLSLTVFHSSIVGSDSFVANSSVLIQDIIDEGQSDLWIQLEPAGKLHIFIELKSGEDGEPRATSNQFKQRDSTYLNKRGRRNAVRRRIHQIGGHKFMATYLRQFTFCSHCKEFIWGVIGKQGYQCQVCSIVTHKKCHHLIVSKCPGVKIKEETSSEQRYGLNIPHKFLTHSYRFPTFCQHCGSLLYGIIKQGVQCKNCALNVHRRCQANVANDCGVDRRELAERLKEINNKTANDIMKSPKPTNIIQHTQNGMTCITHDKTKPSIQDITASPVDVCRKVASETKYSLDSFTFLKVIGKGSFGKGYLAERKGSSELFAIKILKKINIIRDDDVDCIQTEKRVLTISGQHPYLTSLHSCFQTPERLFFFMEYVNGGDLMFQIQKARKFDENRSRFYAAEITLALQFLHKNGIIYRDLKLDNILLDSDGHVKLADFGMCKDNLAPSDTTSTFCGTPDYIAPEIVCDLPYGSSVDWWALGVVMYEMMAGQPPFEADNEDELFERIQSSEVLYPVWLSREASSILKGLLTKNYEKRLGCVPDIGEVAINKHPFFASIDWRKLENRQIHPPFQPQIKSPTDVANFDTD

SEQ ID NO: 14392 - protein, 1306 aa, Schizosaccharomyces pombe
MSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLSPAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 14393 - protein, 296 aa, Rattus norvegicus
MGFVKVVKNKAYFKRYQVRFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVNGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMEEMYKKAHAAIRENPVYEKKPKREVKKKRWNRPKMSLAQKKDRVAQKKASFLRAQERAAES

SEQ ID NO: 14394 - protein, 542 aa, Homo sapiens
  unsure (1)..(542): unsure at all Xaa locations
MPLRDETLREVWASDSGHEEESLSPEAPRRPKQRPAPAQRLRKKRTEAPESPCPTGSKPRKPGAGRRGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEXSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 14395 - protein, 670 aa, Hydra vulgaris
MTSVKINEETMKGFNRRGAIREKNVFEVKDHKFVPKFFTSPTFCAHCKDFIWGIVGNNGFQCKVCSFGVHKRCHEYVSFKCPGADTGPESDAPQNPHKFKVHTYSSPTFCDHCGTLLYGLFHQGLKCGACDMNVHKRCEKSGCIPKLCGADHTEKRGRIRLKINFSQKGEEGALTIDIFEAKNLIPMDPNGQSDPYVKLKLLPDTTQNKQKTKTIRKCLNPVWNEKFVYKIGPNDKDKRLCIEVWDWDLATSNDFMGSMSFGVSELMKDEVDGWYKLLNAEEGEYYNVPIQDDAAVAALAKKFKFMDPEELDKRQQVLPEQKEIITDEVNSALKEHWKLEDFTFLKVIGKGSFGKVMLAEKKGSDKVYAIKILKKDVVLQNDDLECVLTEKRVLALQGKPTFLTALHSCFTTVDRLYFVMEFVNGGDLMFHIQQVGKFKEPQAVFYAAEIVEGLLFLHKRGIIYRDLKLDNVMLDQSGHIKIADFGMCKENIFPPKTTRTFCGTPDYIAPEIIAYQPYNASVDWWALGVLIYEMLAGQPPFDGEDEDELFNSVLEQTVSFPRSLSKEAISIIKGFLTKNPSRRLGSGDTGEQDIRDHAFFKYIDWIKLFKMEVQPPFKPKVKSKRSHDNFDTEFTDEATRLTPVDRNFIQQIDQRAFENFSFVNTNFSIQ

SEQ ID NO: 14396 - protein, 674 aa, Hydra vulgaris
MSSKSKKKSTKKEGGDGGGFHRRGAVREKHVFKVMEHEFIPKFFREPTYCAHCTSFIWGIVGNNGFQCKVCSFGVHKRCHEYVSFKCPGADTGPESDAPQNPHKFKVHTYSSPTFCDHCGTLLYGLFHQGLKCGACDMNVHKRCEKSGCIPKLCGADHTEKRGRIRLKINFSQKGEEGALTIDIFEAKNLIPMDPNGQSDPYVKLKLLPDTTQNKQKTKTIRKCLNPVWNEKFVYKIGPNDKDKRLCIEVWDWDLATSNDFMGSMSFGVSELMKDEVDGWYKLLNAEEGEYYNVPIQDDAAVAALAKKFKFMDPEELDKRQQVLPEQKEIITDEVNSALKEHWKLEDFTFLKVIGKGSFGKVMLAEKKGSDKVYAIKILKKDVVLQNDDLECVLTEKRVLALQGKPTFLTALHSCFTTVDRLYFVMEFVNGGDLMFHIQQVGKFKEPQAVFYAAEIVEGLLFLHKRGIIYRDLKLDNVMLDQSGHIKIADFGMCKENIFPPKTTRTFCGTPDYIAPEIIAYQPYNASVDWWALGVLIYEMLAGQPPFDGEDEDELFNSVLEQTVSFPRSLSKEAISIIKGFLTKNPSRRLGSGDTGEQDIRDHAFFKYIDWIKLFKMEVQPPFKPKVKSKRSHDNFDTEFTDEATRLTPVDRNFIQQIDQRAFENFSFVNTNFS

SEQ ID NO: 14397 - protein, 176 aa, Rickettsia prowazekii
FNSLYILWTGVAIIVMTIIGNNVMRMHNWFVAAVISPVIIMVTGVLFFGLIVFDQQILSLFDGAILMSPLALAVSIGGIQNILAKGTKYSIWDTSREMLYIPLDDELKTKGKAAVDVISAKVGKSSSGLVQSIIFTLVPNATFTSISPILMVVFTFVCFAWIYAVRKIYFEYQKIA

SEQ ID NO: 14398 - protein, 929 aa, Pectobacterium carotovorum subsp. carotovorum
MTKYSLRARMLILILAPTLMIGLLLSSFFVIHRYNQLQSQLADSGASIIDAAGNHQRYAITHRQMDTIPALINTLHRRHSAIIRTISVFDARNQLLATTKLRNKRTLQCLSNDVLAHNKLHLHHTNDALILHMPIVTDSEFMAGTTPVLPGTATPLGYLVIELDTSTIRLQQYQEIFIAALLLLLSLGAAVIFAYRLMRDVTTPIRNMVDTVDRIRRGQLDSRVEGYMLGELDMLKNGINSMAMSLTAYHEEMQQNIDQATYDLRETLEQMEIQNVELDLAKKRAQEAARIKSEFLANMSHELRTPLNGLIGFTRQTLKTPLNTTQTDYLLTIERSANNLLNIINDVLDFSKLEAGKLVLEDIPFSLHNTLDDVVMLLAHTAHEKGLELTLSIQNDVPEQFVGDPLRIQQIITNLLGNAIKFTEQGNIDIRVEKRRQELHQVLLEVQIRDTGIGIAELQQSQLFQAFRQADTSISRRHGGTGLGLVITQRLVKEMGGDISFQSELSKGSTFWFHITLPLNPHAIPTEPAYTMLQGKHLAYVEYHPIAAQATLDILSQTPLIVSYSPTFEQLPEGEFDILLLGIPVQYRNTLLDYTPRLRDICRRSPCVILALPSLAQMDAEQLKTFGVHACLSKPLAASRLLPLLQDSTLFQFSFLPDDTASHQSAVRHLARLPLRVMAVDDNPANLKLIGTLLEEQVETIILCESGQDAIAQAELNQCDIILMDIQMPGMDGICASELIRQIPHHATTPIIAVTAQTMTGEREHLLRSGMDDYLAKPIDEQMLKSVLTRHARQDPLKRNRGEMTGLLNEHDDSQLSLDWALAQQQAANKPELGRDLLQMLLDFLPEVQRKIENVLKGQTDDDIIELVHKLHGSCSYSGVPLQPICRYLEQQLRKGVHASDLEPEWLELLDEIDNVNRAAQPHINPRLP

SEQ ID NO: 14399 - protein, 392 aa, Chlamydomonas reinhardtii
MRSVFSDTCSAAPSTSRPHAVSVIPSRPRRYAGGRTLGGHTLLSSRNVGSVAVNTMARDRLSAQEREELEAVRARLNQQLQLVTGVSPSASSDLSVDERPTLLAKANNCPCEDEVHPSNGWRPMPHHLSKPELWERIRQEAQMDASSEPALASNLFSTILAHPSLEKSMAFLLANKLANPTMLGMQLMRLISEAYEDDAGLIEACMADLQAVYDRDPACDSFSQAMLYFKGFQAIQCQRVAHWLWQKGRKALALAIQSRMSEAFHVDIHPAAQLGRGLLIDHATGVVIGETAVVGDNVSMLHHVTLGGSGTGRGVRHPTVGNGVLLGAGVTVLGPITVGAGSKVGAGSVVVSDIPCHSVAVGVPARIIKRDIVKEPVKEMDQCTDYILDYTI

SEQ ID NO: 14400 - protein, 342 aa, Rattus norvegicus
MLLLKKQTEDISSVYEIREKLGSGAFSEVMLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALQHLWISGDAALDRDILGSVSEQIQKNFARTHWKRAFNATSFLRHIRKLGQSPEALLISFPDPCPPDWPLLESPRPWV

SEQ ID NO: 14401 - protein, 309 aa, Rattus norvegicus
MGRKEEEDCSSWKKQTTNIRKTFIFMEVLGSGAFSEVFLVKQRVTGKLFALKCIKKSPAFRDSSLENEIAVLKRIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGVMSTACGTPGYVAPEVLAQKPYSKAVDCWSIGVITYILLCGYPPFYEETESKLFEKIKEGYYEFESPFWDDISESAKDFICHLLEKDPNERYTCEKALRHPWIDGNTALHRDIYPSVSLQIQKNFAKSKWRQAFN

SEQ ID NO: 14402 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCEGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 14403 - protein, 749 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 14404 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 14405 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPEPDVNTNWSMEYNRLRAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMPSHQPSPFLNMGGLYQEDDPMAMRRNDLELTLEPVYNCNL

SEQ ID NO: 14406 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMVMRRNDLELTLEPVYNCNL

SEQ ID NO: 14407 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAVSPKELQNLEQQLDTALKHIRTRKNQLMYESINELQKKEKAIQEQNGMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 14408 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSTEYNRLKAKIELLERNQRHYLGEDLQAMSPKEPQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 14409 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQGQWDQQNQGHNMPPPLPPQQHQIQHPYMLSHQPSPFLNMGGLYQEDDPMAMRRNDLELTLEPVYNCNL

SEQ ID NO: 14410 - protein, 251 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKTKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 14411 - protein, 380 aa, Mesorhizobium loti
MLRGAEMRVVIDQDLCGTTGQCVLTLPGTFRQREPDGVAEVCVATVPQALHAAARLAASQCPVAAIRVIESDAGERASADPAPSPAQAERHAAKDQRNPGGRFEGKVAVVTGAGAGIGKACALAIAREGGRVVVADIDGSAAVACTAQIAAEAGHALALAMDIADAQAVAALFETAERHFGGVDLLVNNASAMHLTPRDRTILDLDLAVWDQTMATNLRGTLLCCRQAIPRMIARGGGAIVNMSSCQGLSGDTAQTSYAASKAAMNMLSASLATQYGHAQIRCNAVAPGLIMTERLLAKLDECMQRHLSRHQLLQRVGRPEDVAALVAFLLSDDAAFITGQVLCIDGGMLAHVPTYADGGNSRAARPAGDTAKAAAGPRC

SEQ ID NO: 14412 - protein, 340 aa, Mesorhizobium loti
MRLSKFAPRHAVNAGERKTTSAMIASIAPDGIATRNAPFGHTLARLAHERLGIVGLTADLAKYTDLHVFAQEHPDRFYQMGMAEQVLMSAAAGLAREGFTPFATTYAVFASRRAYDFICMAIAEENLDVKIVCALPGLTTGYGPSHQATEDIAIFRGMPNLTIIDPCDALDIEQATEAIADYKGPVYMRLLRGKVPVVLDEYDYTFQIGKARLLRDGADVLFISSGLMTMRVLEAAKALEADRIDCAVLHVPTIKPLDTDAILAAARRAGRMVVVAENHTMIGGLGEGVAGLLMREGVTPVFRQIALPDEFLDAGALPTLHDRYGISTSEIVRRVRKWVK

SEQ ID NO: 14413 - protein, 330 aa, Mesorhizobium loti
MPDYDVLCIGNAIVDIIAQCDEEFLETNGIIKGAMNLIDTHRAELLYSRMGPAIEASGGSAGNTAAGVASFGGRAAFFGKVSNDALGEIYAHDIHAQGVAFDTRPLAGLPPTARSMIFVTPDGERSMNTYLGAATELGPEDVEADKASGAAVTYFEGYLWDPPRAKEAIRQTAKLAHAAGREVSMTLSDSFCVDRYRDEFLKLMRSGTVDIVFANSHEIKSLYQTASFDEALAQIRKDCKIAAVTRSEKGSVIVRGDETVVIQATAIKELVDTTGAGDLYAAGFLHGYTQGRDLKTCGDLGSLAAGLVIQQIGPRPRQNLRREAEQAGLL

SEQ ID NO: 14414 - protein, 477 aa, Mesorhizobium loti
MSEARSYELFINGKWRAGGSRVTLPVINPATEKVVASVASATVSDLDEALASAERSRKAWCSRPAKERGEILVAAARVLATQIEPAARDLSAEQGKTIAEATGEYARAVETLEWNGTHAEELSATIPLGPNRMIVPEPLGVVAAFTPWNYPAVLITRKLAPALAAGCPVILKGAEETPSVAVHIVESLRQAGVPDGVVNLVFGVPVHISRHLLSSPIVKVLTFTGSTAVGKQLAMLAANNLQRCILELGGHSPVIVCEDADLAKAIPAISEYKFECAGQSCNAPSRILVARTLYEEFLSRMTEAARKIRIGLPDDPATEMGPMANARRIEAMQRLTKDAVDRGAHIETGGTRLDGAGFYWPPTILTGVPKDARVLHEEPFGPILTVAPFDTLDEAIGEANDTEYGLAAYFFTDAADTQRKLTNSLSAGAVSVNYLKGVSADAPYGGVKQSGYGYEGGEQGVRSFQILKMVNGLGSFG

SEQ ID NO: 14415 - protein, 546 aa, Mesorhizobium loti
MKQAGRVVIITGAAGGIGRALVEIVAADGDIVVAVDLPGSGVLELAGGLGHPHLGLECDVSREEDIVALYGHIEAQFAKIDVLVNNAAIGPAMAATIDTGFEAFRRVLATNLIGPFIMAGEAASRMQPGAAIVNVASLAGVLGNPKRNAYASSKAGLIALTRSLACEWASRGIRVTAVAPGYVRTPMVAELERAGKMDLAAVRRRVPMGRMARPDEIARAVRFLASAQTGYITGSVLTVDGGWMSFNQPGDAHPPVDETPRAELFRPAERTGARTVVVTGGANGIGAAVVRRFAANSDTVVIADKDGAGAAELAGLLGGRHVAKSADLAVESEVVALFEEIRGRFGRIEILVNCAAIADTFVRGIEIPRQIERVLDVNLTGTFTCAREAIKSMDAGGVILNLGSINSFLPFVPRHAYGASRAGMNILTRCMAAELGSVGIRTATVALGYIRTPDIAQLIESGCIDSVAIKRRIPMGRMGEPEDVAEAVFFLASPDASYVNGSTLYVDGGLTSLADARNAQPTDQENPTECSPATGCGSSKPTRFED

SEQ ID NO: 14416 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 14417 - protein, 242 aa, Oryza sativa (japonica cultivar-group)
MVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAADGGANSW

SEQ ID NO: 14418 - protein, 398 aa, Oryza sativa (japonica cultivar-group)
MASSPCGGFLEKAKPYFAMICLQFGYAGMNVITKVSLNHGMSHYVLVVYRHAFATISIAPFALLLERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLMQMAWTSHVQAPHGHGAEAPAAAAAVDPSGREWFLGSLFVIIATLAWASLFILQAHTLKKYSAPLSLTTLICFVGTLQAIVVTFAMEHRPSVWAIGFDMNLLAAAYAGIVTSSIAYYVQGLVIQKTGPVFASAFSPLMMIIVAGMGSFILAEKIYLGGVLGAVLIVVGLYSVLWGKHKETQEQDAAMMELPVASKGNDAEFTAATVVGDDDDAADCKKANGVKKSSSSNEQGASAV

SEQ ID NO: 14419 - protein, 449 aa, Oryza sativa (japonica cultivar-group)
MATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 14420 - protein, 417 aa, Oryza sativa (japonica cultivar-group)
MGRKRALLVGINYPGTKAELKGCHNDVDRMHRCLVDRFGFDEDDIRVLLDRDSSGTQPTGANIRRALAQLVGDARPGDFLFFHYSGHGTRLPAETGQNDDTGYDECIVPSDMNLITDQDFRELVQKVPNGCLFTIVSDSCHSGGLLDSAKEQIGNSTRQNQTQSREREEPSDSGSGFRSFLKETVRDVFESEGIHLPRSRHSQSHYGGEDQYETYAQPTDGHTKNRSLPLSTLIEMLKEKTGKDDIDVGSIRMTLFNIFGDDASPKVKKFMKVMLGKFQQGQSGEQGGLMGMVGSLAQEFLKVKLEGNEEEAFKPAIEQEVHSVDEVYAGTKTWAPNNGILISGCQSNQTSADATTPQGSSYGALSNAIQTILADKRGNVSNKDLVMKARSLLAKQGYTQQPGLYCSDDHVHVSFIC

SEQ ID NO: 14421 - protein, 495 aa, Oryza sativa (japonica cultivar-group)
MGGGQSRSPRDGSGHGRYGHSPSFQQQWGGGGGGGGGGGGGYPYGQDAHGGGYYGAPAPQGGYAAPYPAYQQPPPPMPSPAATQPPARAGGASKPRLDRRYSRIADDYHSVDQVTDALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNIPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAVPSSTYDNQVCPICLVNPKDMAFGCGHQCNPCKAFERLADKPVKYWVCIDKDRKASNPLLQDCGAGDVSSIETH

SEQ ID NO: 14422 - protein, 610 aa, Oryza sativa (japonica cultivar-group)
MPEAPTAKTAPAYGYAPGAHAEALEFIEHVTANAGQVQRRVLGEILAQNAPAEYLRRYGIPGSPDVVDAFRRLVPLVTYEGLQPDILRIANGDTSPIFSGKPISEFLTSSGTSGGERKLMPTIADEMNRRSLLYSLLMPVMSQSVSGLDKGKAMYLLFVKAESRTPGGLAARPVLTSYYRSRQFLDRPRDPYTSYTSPDEAILCVDSYQSMYAQLLCGLVHRADVLRVGAVFASGFLRAIHFLEKHWARLCHDIRTGELDPEITDRVVRDAVGRVLRADPALADAIEDECARASWEGIIRRLWPRTKYIDVIVTGTMSQYIPTLEFYGGGLPLTCTMYASSECYFGLNLNPMCKPSDVAYTLIPTMCYYEFLPVNCNNATAEASHRDLVDLVDVKLGHEYELVVTTYSGLYRYRVGDVLRVAGFKNKAPMFSFVRRQNVALSVDSDKTDETELHAAVSGAVQHLAPFGASLVEYTSYADAATIPGHYVLFWELRAGSTAVPASVFEECCLSVEEALNSVYRQGRACDRSIGPLEIRVVAEGTFDKLMDYAISRGASINQYKAPRCVRPGPVVELLDARVQGKYFSPKCPKWSPGNKQWNKSKDLVGKGDA

SEQ ID NO: 14423 - protein, 554 aa, Oryza sativa (japonica cultivar-group)
MASAAMLVPLVLVLCTAAASAAVVEHTFKVGGTKITQLCMNSVIYTANQQLPGPTIEVTEGDTLVVHAVNDSPYPLSLHWHGVYQLRSGWNDGANKITQCPIQPSGNFTYRFNITGQEGTLWWHAHSSLLRATIYGALIIKPRNGPSGYPFPEPYEEIPILLGEWWNRNVDDVENDGYLTGLGPQISDALTINGMPGDQNRCKGSAMYEVEVEYGKTCLLRIINAAVNVELFFKVAGHTFTVVAADASYTKPYATDVIVIAPGQTVDALMNTTASPGRYYMAAHVFDSKTVAVPFDQSTATGIVKYKGVPNYAPAAMPSLPPHDDVVTAGRFYWSLTGLARPSDPGVPTTVDHNMVVTFGLDQAPCAPNQTKCSGFALVAAMNRNSFQFPDQKVSLLEALYKGVPGVYSEDFPDFPPPMQGFRKATAVKKVKYNDVVEVVLQSEQYSSTLGTENHPIHLHGFDFYLLAQGLGRFNPSMKSKYNLVDPQVRNTVAVPAGGWAVIRFMANNPGMWFMHCHLDAHLPLGLAMVFEVLNGPAPNLLPPPPVDHPKCHG

SEQ ID NO: 14424 - protein, 148 aa, Thermoanaerobacter tengcongensis
MANKFMEEALKEAKKSYELGEVPVGAVIVKDGEIIARGHNQKESSKDATAHAEIIAIREACRRLGSWRLEDCSLYVTLEPCPMCAGAIVEARIKRVYIGTESPKEGAAGSVINILNNKELGTSTEVYFGIMEEEAKELLKKFFENLRE

SEQ ID NO: 14425 - protein, 245 aa, Thermoanaerobacter tengcongensis
MLTGKVAIVTGGAGDIGRRICIELAKEGASVAIHYNSSYEKAVELRDYIRENFSYAEIFQADISNRKQVDEMIDEIYRKFGRIDYLINNAGIAQIKPFVEITEEDWDRMMNVNLKGLFNCTQSVLRYMLPKKQGSIINISSIWGISGASCEVHYSASKGGVIAFTKALAKELGPSKIRVNCIAPGVIDTRMNNILNGEDKKHLIEEIPLMSIGKPEDVANAVLFLLSDKANFITGQVITVDGGFI

SEQ ID NO: 14426 - protein, 255 aa, Thermoanaerobacter tengcongensis
MNFKDKVVIVTGGGQGIGRCIAQTFASKGAKVVIAEIDDEAGLENEEYIRKNGGEALFVHTDVALEEDVKNMVNKTIETYGKIDILINNAGIGSGGTIYTRPMEEWDRVINVNLKGAYMCAKYVAPHMRDNGGGVIINIASTRAFMSEPHTEPYSASKGGLIALTHSLAISLAYDKIRVNSISPGWIEVSEWKKSREAKKPELTEQDHLQHPAGRVGKPEDVANACLFLCSEEASFITGANLIVDGGMTVKMIYL

SEQ ID NO: 14427 - protein, 358 aa, Thermoanaerobacter tengcongensis
MITKEQILSALKKVYDPELRRNVVDLGMVKNIEIEGDKVTVDINLTVKGCPLRDQIKNNAIKEISKIEGVSEVVVNIGAMTEEERQDLARRLKEEKKNLFENTRVIVVGSGKGGVGKSTVAVNLAVALSRLGFEVGLLDADILGSSVPRLLGIVGEKPYALDEHTVLPIERFGLKIISMGNFVDEDTPLIWRGPLLTGVIDQFFNEVLWGDLDYLVLDLPPGTGDIPLTVMQRLPEAKFILVTTPQASASHVAGRIGHMAKKVNVEVIGIVENMSYFECPKCGERYNIFGEGETEKLAEALQTEILARIPIVVKIRELSDEGIPPALDDTEEGAIYVELAEKIVEKVRPLRHEKEPLK

SEQ ID NO: 14428 - protein, 326 aa, Thermoanaerobacter tengcongensis
MAEKLYIEALAEAIKEEFERDPNVFMMGEDIGIYGGAFGVTKGMYPKYKDKLIETPISEASIVGAGVGAALVGMRPIVEIMFSDFMMDAMEWIVNQAAKLRYMTGGQLKVPLVIRSPMGSGTGAAAQHSQSLPAMFAHIPGLKVVMPATPYDVKGLFKAAVRDDNPVIFFEHKLLYWTKGEVPEGDYIVPIGKADVKREGKDITIIAGSITVIRSLEAAEKLKGEGIDVEVIDVRSLSPLDTETIVNSVIKTGKVLIVEDDNKSYGWGAEVLSRIVESDAFDYLDYPIQRLGGKDVPIPYNPKLERAAVPQVEDIIEAVKAIFGKE

SEQ ID NO: 14429 - protein, 447 aa, Thermoanaerobacter tengcongensis
MFYNSIKVNSKGHLVIGGCDAVELAERFGTPLYVIDEDVLRANSRIFYNALKSHNPENEVVYAGKAFLTTAMCKIIQQEGLGLDVVSGGELYTALKAGFPTEKIYFHGNNKSEEELIMALQSEVGRIIIDNWDELELLEILAKKLNKEPAIYIRVTPGIEAHTHRYIMTGQIDSKFGFTISNGEAFKAVKRALTSGSLKFKGLHCHIGSQILESTPYKIAVKIMLELLKEIKDTLGRGVEELDLGGGFGIPYVEDDSYQPVEEMLRDILEELEAQVSLLKIKLPKIIVEPGRAIIGNTGITLYKVGGVKEIPGVRKYVFVDGGMSDNIRTALYGARYSAVIANRVYNGRLEKVTIAGKLCESGDVIIWDILLPEVKKGDIIAVLNTGAYGYSMASNYNRLPKPAVILVSKGKAEIIVKRETYEDVIKNDVIPERLEEKFQGREMQAI

SEQ ID NO: 14430 - protein, 404 aa, Thermoanaerobacter tengcongensis
MKSSKNRRKWGLAMDNLKVTVFTNEYPPNIYGGAGVHVDYLTRELSKLMKVDVRCFGDQKFFSENLTVKGYKEWEELKEGLDPRYQKVLGPFSIDLAMVKDPVDSDVLHCHTWYTFMAGFLAKKLYDKPLVVTIHSLEPLRPWKEEQLGNGYKLSSWMEKTGIKAADRIIAVSQGSKEDILKYYDVPEEKIEVIYNGIDLKEYKKIDRNVARKKYGIEGRYILFVGRISRQKGITHLIDAVKYLPKDVKVVLCASSPDTPEVLEEVEQKVKLHDNIIWINKMVEKEDIVELYSNAEVFVCPSIYEPFGIINLEAMACETPVVASATGGIKEVVVHEETGFLVEPGNSEELAKYINILLENRELAKKFGINGRKRVEEMFSWGSIAKKTYEMYRKVVQEYKKAKK

SEQ ID NO: 14431 - protein, 484 aa, Thermoanaerobacter tengcongensis
MEDKFVKEGLTFDDVLLIPAKSDVLPKDVDLKTRLTKKITLNIPLMSAGMDTVTEARLAIAIAREGGIGVIHKNMSIERQAMEVDKVKRSEHGVITDPFSLSPDHTIRDAAELMARYKISGVPITVDSKLVGIITNRDIRFEDDLDKPIREVMTKENLVTAPPGTTLEEAKQILKKHKIEKLPLVDENNVLKGLITIKDIEKAVEFPNAAKDEKGRLLVAAAVGVGKDMMDRVKALIEAGVDAIVVDTAHGHSTRVLDAVAKIKEKYPDVQLIAGNVATAEATRDLIERGADAVKVGIGPGSICTTRVVAGVGVPQITAIYECAKEADKYGIPVIADGGIKYSGDIVKAIAAGASVVMIGSLFAGTEESPGEIEIYQGRSYKVYRGMGSLGAMKEGSSDRYFQEEAVKLVPEGVEGRVPYRGPLRETVYQLIGGLRAGMGYCGVKNIEELRTKTKFVRITQAGLIESHPHDIIITKEAPNYNLR

SEQ ID NO: 14432 - protein, 288 aa, Thermoanaerobacter tengcongensis
MSKQLQSDIVLTLVTMIWGSTFIIVKNAIQSLPVYNFLFIRFLLAFLLLAAIFYKKLKKIDKSTLMAASLIGTMLFLGYAFQTMGLLYTTASKSGFITGFSVVLVPILEAILLKRKPTKAATVGVVLAFIGLILLTTNIDLSINIGDFLTLLCAFAFAMHIVLISKYASKMDTYLLATVQIGMVALLSGIVSLIFEKPFIPTSLDVWGAIIITGVFATAFAFVAQNTMQAYTTATHTALIFSLEPVFAALAAYLIAGETMSIRAIIGGAFMLAGIILSELPEKEPEKR

SEQ ID NO: 14433 - protein, 219 aa, Thermoanaerobacter tengcongensis
MLKDLFIIGAGGVGKEVAWIVEEINNINPIWNIVGFIDDNKDLHDRTINGVKVLGGIEYLLNLKRKIYAVCAIADYKSRKRIVTKLERYDHIEFVNIIHPSVYISKTNHLGKGVIIYPGCILTTNIKIGDHVIISPKCGIGHETFIDDFVTLLWDVNVAGNVVINEGCLIGSGATIIQNKQIGKGVIIGAGAVVVDDIPPYCTAVGVPAKPIKFHEEAK

SEQ ID NO: 14434 - protein, 339 aa, Thermoanaerobacter tengcongensis
MSAITSRKLTMAKAIAEAISLEMERDPRVFVMGEDVGVYGGIFGATAGLYEKFGPERVIDTPISEAGFIGAALGAAMEGMRPIVELMFVDFFGVAMDQIYNHIAKNTYFSGGNIRVPLVLMTAVGGGYNDAGQHSQCLWGTFAHLPGLKVVVPSTPYDAKGLMISAIRDDNPVIYMFHKGLLGLGWMTLIKDSTGPVPEEPYTIPFGKAEVKREGKDVSIISVAMGVYQALEAAKELEKEGISVEVLDLRTLVPLDREAIINTVKKTHRVLVVDEDYLSYGMSGEVAATIVEHAFDYLEAPVKRLAVPDVPIPYSRPLEQFVLPSSSKIVNAVKELLRS

SEQ ID NO: 14435 - protein, 448 aa, Thermoanaerobacter tengcongensis
MKGIRKKLFISYLSIGMVVLLLFWLTQVVFINRIYEYYKINQLKSYSEQIVQAINNNNEMLISELIDKSNARVIAITENDIVIAGNNRGHGMRGLGIPEILLRPTNTTKVVKYEHPFLHIEYLSIVRPFLYNGKPAILIMSLPEASINDSVNLFKEVFWWIFALTIVSTLVVSSYMSKKFTRPIQILKNAAHEIASGNLNVKINYKEEDELGDLAKSMNTMVKQLSITDKFRKDLIANISHDLKTPLGLIRGYSEMLLDYYGEDKEKREKYLNTVIKETERMSKLVDDVLQLSKLQSGMIEVKEETIDLEKLIFEILDIFEIQILEKNIEVKLENLKVKVVADREMIKRAIINIISNAIASMENGGTLSITAELQDKNVLIKISDTGCGIPEKDLEHIFDRFYKGNKSGTGLGLAIVKEILTLHQSDFGIRSKEGEGTTFYFTLKAGK

SEQ ID NO: 14436 - protein, 216 aa, Thermoanaerobacter tengcongensis
MSKYEAVIFDLDGVITDTARYHYLAWKKLADELGIYFDEVINERLKGVSRLESLEIILERSQKQYSQDEKEYLANKKNEYYKEMIKKITPEDLLPGVEKFIEELKKRGIKTAIASVSKNAFTVVENLKIKDKFDYIVDANEIKRGKPDPEIFLNAAEHLGISPEKCIGIEDSAAGITAIKRAGMFAVGVGNPETVKEADLILKDMTEAGKILELLD

SEQ ID NO: 14437 - protein, 241 aa, Thermoanaerobacter tengcongensis
MINLNTNDNLTNAYEIARYIKEAKKSTPVKAYVQGKIQVEEEEGLKIFGSEDFKILIGELEVVEKVIEQNKDRIKYYHLEYDRRNSAIPLLDITHLDARIEPGAIIRDKVKIGKNAVIMMGAVINIGAEIGENSMIDMNAVIGARGIIGKNVHVGAGAVIAGVLEPPSSVPVVIEDNVMIGANAVILEGVRVGRGAVVAAGSVVIEDVPPNTVVAGVPAKIVKVVDEKTREKTKLMEDLRG

SEQ ID NO: 14438 - protein, 875 aa, Thermoanaerobacter tengcongensis
MTKKYVYFFNEGDASMRDLLGGKGANLAEMTRLGLPVPPGFTVTTEACTRYYEDGETIAPEIVEQIHEYMKKLEEVTGKKFGDPNNPLLVSVRSGARVSMPGMMDTILNLGLNDETVEGLARATNNERFAYDSYRRFIQMFSDVVMGIDKNKFEAILDEIKEKRGAKFDTDLTAEDLKEVVKRFKELYKQEKGVDFPQDPQEQLLEAVKAVFRSWNNPRAIVYRRLNDIPSDWGTAVNVQSMVFGNMGNDSGTGVAFTRNPATGEKALFGEFLMNAQGEDVVAGIRTPQPISTLKETMPEVYNQFVEIAEKLEKHYKDMQDIEFTIERGKLYMLQTRNGKRTAQAAIKIAVDLVREGLIDEKTAVLRVDPKQLDQLLHPTFEPEALKAAKPVAKGLPASPGAASGKVYFTADEAVAAAKSGEKVILVRTETSPDDIEGMASAEGILTTRGGMTSHAAVVARGMGTPCVVGCGDARIDEQAKVMRIGDIVVREGDYISIDGSTGNVYIGEIKTVTPEISGDFAILMGWADKYRRLRVKANADTPRDAKIALEFGAEGIGLARTEHMFFDEERIPAMREMIIAKTEEQRRKALEKILPMQRSDFEQLFEIMGEYPVTIRLLDPPLHEFLPHLDEEIRELAEDMGVPFEELKATVESLKEFNPMLGHRGCRLAVTYPEIAEMQTRAIIEAAINVKKRTGKDVKPQIMIPLVGELKEFKYLKDIIVKVADEIIKQSGIELKYLVGTMVEVPRAALTADKIAKEAEFFSFGTNDLTQMTFGFSRDDAGKFLETYYEKKIYEFDPFEKLDQEGVGKLVEMGTKLGKQTRPDLEVGICGEHGGDPSSIEFCHRVGLDYVSASPYRVPIARLAAAQAAIKYGN

SEQ ID NO: 14439 - protein, 622 aa, Thermoanaerobacter tengcongensis
MLEQINSPYDLKKLDIKDLPRLSEEIRQFIVEKVSKTGGHLASNLGIVELTLALHYVFNSPVDKIIWDVGHQCYVHKMITGRRDKFDTLRQFNGLSGYTKRTESIHDIFGAGHSSTSLSAALGIATARDLKGEKYHVIAVIGDGALTGGMALEALNNIGRSRKDVIVILNHNEMSISENVGSLSLYLSKLRTDPTYNKVKQEIDNLLNIIPPIGKSLHKYIEKIKDSIKQLVVPGMFFEELGFTYLGPIDGHNVEELIEVLERSKKMKGPLLIHVVTKKGKGYMFAEKRPDKFHSAAPFDIETGKFVGEGKDSYSDVFGKTLAEMALKDEKIVAITAAMPEGTGLIHFAKLIPDRFFDVGIAEQHATTFAAGLAVEGYKPYFAVYSTFLQRAYDQVIHDVCIQKLPVVFAVDRAGIVGEDGETHQGVFDISFLRAIPNIAIMSPKDANELVEMVKLSRNLDFPVAIRYPRGKAGEYDISRKPSFPLGKGEVLLEGEKIAVFALGRMVSKSIDAAEILKGHGINPFVVNLRFVKPLDEELILEISNKVDLVVTVEDNVIAGGVGSAILELLNDKKVYRPVLRLGFPDKFIEHGDVESLFKKYGLDSQSIADTILQRYKEMRGS

SEQ ID NO: 14440 - protein, 240 aa, Thermoanaerobacter tengcongensis
MKEEENLELIKLAKNNDKASLEKLILENSGLIWSIVKKFANRGYELEDLYQIGCIGFVKAVQKFDESYNVKFSTYAVPIIMGEIKRFLRDDGLIKVSRSLKELSSKAFYMKEVLSNELNREPTINEIAERLNVTPEEIAMAFESAATAESLYDSISHEEEDRQLIEMVGDKEDSVDLEEKLTLHMIIDKLKPREKQVIFLRYFKDMTQTEVANILGISQVQVSRIEKKVLEKIRKELEKV

SEQ ID NO: 14441 - protein, 382 aa, Thermoanaerobacter tengcongensis
MKKLIILGSTGSIGRQTLDVVRSLKEEFEIVGLTGYNNVSLLSKQIKEFRPKVVAVKDEEKARKLRENLDEPIEVLTGKEGLKEIVKYEADMVVVAVEGIAGLIPTVEAIKLGKNIALANKEVLVTAGEIVMGLVKEKKIEFLPVDSEHSAILQCLKGNNKREVSNLILTASGGPFRGKKKKDLVNVTVEEALKHPNWKMGKKITIDSATLMNKGFEVIEARWLFDMPLDKIKVVIHPQSIIHSMVEYVDGSVIAQLSVPDMRIAIQYALNYPDRKYVEGVKFLDFYALGQLTFEEPDFETFKCLSLAYHAAECGGTMTAVLNAADEVAVSLFLQNKINFLEIAEIIEEALENHKNIQNPTLDDIISVDLETRERIMRKYLR

SEQ ID NO: 14442 - protein, 247 aa, Thermoanaerobacter tengcongensis
MVDEKRVAFVTGGSRGIGRAIAVRLAKDGFNIAITYVKDDKSAEEVVEEVKKHGVDALAIKCDVSKYHEVEKAVEKVIEEFGSIDVVVNNAGITKDNLILKMEEEEWDQVIDVNLKGAFNVIKFASKYMIKKRKGKIINISSVVGLMGNVGQANYAASKAGIIGLTKSVAKELASRGITVNAVAPGFIETDMTNVLKEDIKEAMLKSIPLKRAGKPEEVAEVVAFLASSASDYITGQVINVDGGMVM

SEQ ID NO: 14443 - protein, 398 aa, Thermoanaerobacter tengcongensis
MNNKKNVVLGVTGGIAAYKAADLTSRLVKKDINVDVIMTKEATNFINPLTFEALTHNKVTVDMFTDRKYWEIEHISLAEKADLFAIVPATANIIAKIAHGIADDMLTTTLLATKSPVLIAPAMNTNMYTNPLTQRNIKTLKEIGFIFVEPAAGRLACGTYGAGKLADVEEIEKAILDLLYREKEKDFEGKKVLITAGPTREPLDPVRYITNRSSGKMGYEIAKAFVERGARVVLVSGPTHIDIPKGVTFIPVETAADMYNAVMMHLEEADIIVGAAAVADYRPKEVKKEKIKKDEETMVIELVKNPDIMYEVGQKKGNKISVGFAAETENLIDYAKKKLKEKNMDLIVANDVSQEGAGFEVDTNIIKVINKDLEVKEYPMMTKREAAHVILDEIAKLL

SEQ ID NO: 14444 - protein, 264 aa, Thermoanaerobacter tengcongensis
MEAGLAMNNNNKVEISGVNTSKLPVLKPSKQRELLIRMKNGDKKAREEFINSNLRLVLSVIQRFNNRGESVDDLFQVGCIGLIKAIDNFDLDQNVKFSTYAVPMIIGEIRRYLRDNTPIRVSRSLRDIAYKALQVRDKLVSENSKEPTVGEIAKELDLPSEEVVMALDAIQEPVSLFEPIYHDGGDAIYVMDQVSDDKNVDEVWLEKIALKEALEKLNEREKMILTMRFFEGKTQMEVAKEIGISQAQVSRLEKAALNHMRKYI

SEQ ID NO: 14445 - protein, 334 aa, Thermoanaerobacter tengcongensis
MLAFLPKFLYNIMGLLIKFYGGRVVKGRLILIVDDDRFTRRILRDILEKEGYSIIEARDGEEAFRLYKEMLPDMVILDVVLPGMSGFDLLKILRKEEENLMLPILVLTAKGDFEEKIKGLELGADDYLVKPVNEKELVIKVNNLFQRIEHNRMANPLTGLRGNIDIKEEIKRRIKSKELFAVLYIDLDNFKSYNDYYGFLRGDEVIKLTAKILSDAVELVGNDKDFLGHIGGDDFVIITTPEKAEEMCKYIISRFDSEIKFLYDKKDRERGYIETTSRRGEKLKFPFVSVSIAIVTNEFRDFRSDLEISEVAAELKKKLKQMKGSCYLKDRRRG

SEQ ID NO: 14446 - protein, 372 aa, Thermoanaerobacter tengcongensis
MGRKRETHREGKSMSNNEELAREAINELINKGKKTGMLTYNEIMDSLEDIDLNPDQIEKVYDTFEDMGIEIVGDEPRQEEISEEDLNLDDLSLPEGVSIDDPVRMYLKEIGKIPLLTPEEEIELAKRIEQGDEEAKKRLIEANLRLVVSIAKRYVGRGMLFLDLIQEGNLGLLKAVEKFDYRKGYKFSTYATWWIRQAITRAIADQARTIRIPVHMVETINKLIRVQRQLLQELGREPTPEELAKEMGMPEEKVREILKIAQEPVSLETPIGEEEDSHLGDFIPDEDAPAPAEAAAYTMLKEQLMDVLDTLTPREEKVLRLRFGLDDGRARTLEEVGKEFNVTRERIRQIEAKALRKLRHPSRSKKLKDFLD

SEQ ID NO: 14447 - protein, 429 aa, Thermoanaerobacter tengcongensis [sequence omitted]

SEQ ID NO: 14448 - protein, 803 aa, Thermoanaerobacter tengcongensis
MVDIFKECENRVVVFDGAMGTQLQERGLKAGECPEYINLKMPEVVFDIHKAYIEAGAEVIETNTFGANRIKLAKYGLEDKVEEIVTKGVEIARKAAGDRPVALSVGPTGELLAPFGDMTFDEAYEVFKEVVVAAEKAGADIVIIETMSDMLEAKAAILAAKENTNMKVICTMTFQEDGRTLMGSDPVTVVVSLQGLGLDAIGVNCSTGPDKMVKVVEKMAQVARIPIIAQPNAGMPVIRDGKTVYDLKPEEFASFFPQLVEKGACIVGGCCGTTPYYIKLVKKAVENLKPKKLENKFTALSSNTRTVFIGKEYPLRVIGERINPTGKKKLSGALLSGDVNLAVEEALKQQKCGAEILDVNVGVPGIEEEEMLPKVAFEVEKAVDLPLQLDSTNVKAIEKAIRILRGRPIINSVNAKEESLKEVLPIVKKYGACVVGLTVGDKGLPKDRHERVENARKILKKAEEYGIPKEDVIIDPVVLTVSSEQGAAIETLEAMKIISEELGVNTVVGLSNISFGLPERKLINSTFLAMAASHGLTAAIVNPCDESLMDTLRASMVLLNKDKGSENYLKVYGQRVKPKEEVIKRHEEDFSKKLYDQILEGKKSGVEEIVMALLEDNPPLSLVDEIIIPALKEVGDRYEKGIYFLPQLLSSAEVVQSAFKLIKEKLPKGTASKGKIILATVEGDVHDIGKNIVKVLLENYGYEVIDLGKDVKGEVIVEEVKKTGAPLVGLSALMTTTLFNMEKIIKMLKENTEAKVMVGGAVLTEEYAFKIGADYYGKTAQDAVKIADKFFLKNALVCKTCSF

SEQ ID NO: 14449 - protein, 445 aa, Thermoanaerobacter tengcongensis
MLHGTMRINSKGHLEIGGCDTVALAKKFGTPLYVIDEELLRQNCRAFYNGFKRDYPGNEVIYASKAFMTMAICKIIEEENLGLDVVSGGELYTALKAGFPPEKIYFHGNNKSREELIMALENDIGKIIVDNWHELNMLNELARKMNKVPNIYIRVSPGIEAHTHQYVKTGQIDSKFGFPLFNGDAMRAIEYALTLKNVNLVGLHSHIGSQIFDSYSYKAEIEIMMNFIKLIKEFLGWEVEELDLGGGFGIAYTEEDDPQPIEKIAHEMMQSVKEYSVSLNVKMPKIIVEPGRSIIGNAGTTLYTVGAIKEIPGIRKYVAVDGGMSDNIRTALYGAKYEAIVANKARLPRVEKVSIAGKLCESGDMLIWDILLPEIEEGDILAVLSTGAYNYSMASNYNRLPRPAAVLVSNGQADVIVERETYEDLVRKDVIPERLLSVKRKIVNY

SEQ ID NO: 14450 - protein, 265 aa, Thermoanaerobacter tengcongensis
MNSVLTKEKTDEFELFERLRNGDKKARDEIVEKNIGLVVSIAANFSKAYGVELDDLIQEGFIGLLAAIEGFDHTKGYRFSTYAVFYIKQKIQRYIWGRSRTIHLPVKTYQKLNQVLSAQLKLEQVKGEAFPEEIAEETGIKTEEVVNLLSLKNPTVSLNQQLYENDNTELIDVILDEQSENEIDRNYSLEELRKILKECLEVLPEKERSVLEMRYGLNGTPMTLKQIAEILNISKQRAGQIEKRALQRLRNSRKIRNALLDFLYN

SEQ ID NO: 14451 - protein, 220 aa, Thermoanaerobacter tengcongensis
MFKTLKEDIEVVFERDPAAKSVLEVLLCYPGLHAIILHRIAHYFYKKGFILLPRLISHINRFLTGIEIHPGAKIGRRFFIDHGMGVVIGETTEIGDNVTIYQGVTLGGTGKEKGKRHPTIKDNVVIGSGAKVLGPIVVGENSKIGAGAVVLKDVPPNSTVVGVPARCVKKDNIRIARSYEVDLEHGKLPDPVEEELRRLRERIERLEKILMERDEEDEAV

SEQ ID NO: 14452 - protein, 573 aa, Thermoanaerobacter tengcongensis
MLKGVAASPGIAIGKAFLYTKEKVTINVEKIEESKVEEEIAKFRKALEVTQEEIEKIKEKALKEFGKEKAEIFEAHLMLASDPELIEGVENMIKTELVTADNAVNKVIEQNASVMESLNDEYLKERAVDLRDVGNRIIENLLGVKSVNLSDLEEEVVVIARDLTPSDTATMKKEMVLGFATDVGGRTSHTAIMARSLEIPAVVGLGNVTSQVKAGDLVIVDGLEGIVIVNPDEKTVEDYKSKKESYEKKVEGLKQLKDLPAETPDGKKVMLAANIGTPKDVASALANGAEGVGLFRTEFLYMDRNSLPSEEEQFEAYKEVVEKMGGRPVTIRTLDIGGDKELPYLDMPKEMNPFLGYRAIRLCLDRPDIFKTQLRAILRASAYGNVQIMYPMISSVEEVRKANSILEEVKAELDREGVKYDKEIKVGIMVEIPSAAVTADILAKEVDFFSIGTNDLTQYTLAVDRMNEHVKEYYQPFHPAILRLVKMVIDAAHKEGKFAAMCGEMAGDPLAAVILLGLGLDEFSMSATSIPEIKNIIRNVEYEKAKEIAEKALNMSEAREIEKMMKDVIKDIG

SEQ ID NO: 14453 - protein, 313 aa, Thermoanaerobacter tengcongensis
MERIKSYYPYLAGIGMASIFGFSFMFTAMGLEVASPLELISYRFLLASIVITLLWAFGVIKLNYRGKDVKPLLLLSLAEPFIYFVFETYGIKYTSSSLSGLMIALIPVAVTILAVIFLNERPSLYQLLFILLSVAGVIFIIFMTGSEGGKSSLLGFLFLLGAVLSAAFYTILARKFSSVFSPIEITFVMMWFGAISFNILNLIEKVIRGDSLSSYFSSVANYKVLIPVLYLGILSSIVAYFLNNYALSKLPASQASVFANLTTVISIIAGVTIRHEVFYWYHVVGAIMILIGVWGTNYFGKAYEVKALSEEIH

SEQ ID NO: 14454 - protein, 221 aa, Thermoanaerobacter tengcongensis
MALKRMKGEEQMKKVFLVDFDGTVTKKDAVYMMVEKFAKEGWQYYNELWEKGEMSTEECAIETLKLMEVSEEELFKFIMENVEIDDHFLEFLGVTKEKEYEVVIVSDGYDFIIEAVMKKYNLKLPYYSNKMWFEGGKIKVAFPYKDKECDKCGMCKLNILKEYRKKGYSVAFVGDGYSDFCVVEHADEVFAKDVLADYCEEKGIKYFRFGSFKDIIRYVKR

SEQ ID NO: 14455 - protein, 469 aa, Thermoanaerobacter tengcongensis
MKKNRLFKKLFISNIIIVAITLAVVSIMFYIMFQNYYFAEKEKIMLEEAQEINAILNEFAVGDINLDKWNQELNVVTRLINATVWIVDKEGLVYSQSQQGKPWMKITLSKADIQNILKGESIVKKGYFGGAFTSPVLTVGVPLVIKGHIEGAIFMHASLEEMNRTVLNIFLLMLLSGGMAFVVSFILISYTSNRISEPLKKMSLAAREIAKGNFSARVDHFEEDEIGDLARSFNVMARELAQLEDMRKEFVANVSHELRSPITSIQGYIDGILDGTIPKEKTYDYLKVVQEETRRMSRLINDLLEMTKLESGEFPLNRTEFDINELIRICIIKFEKRIVEKDLTVKVDFEEDRRFVFADRDKIEQVLTNLIDNAIKFSKPKGIIHLFTEVKGDKVFITVKDNGIGISPEDLEHIWERFYKADKSRGKDGAGLGLYIVKKIIEAHKEEIWAESELKKGTSFTFTLPIKKV

SEQ ID NO: 14456 - protein, 486 aa, Mus musculus
MPLQEETLREVWASDSGHEEDCLSPEPPLRPKQRPAQGQKLRKKKPETPDSLESKPRKAGAGRRKHEEPPADSAEPRAAQTVYAKFLRDPEAKKRDPRENFLVARAPDLGGEENSEEDSDDDDNDDDEEEEEKKEGKKEKSSLPPKKAPKEREKKAKALGPRGDVGSPDAPRKPLRTKKKEVGEGTKLRKAKKKGPGETDKDPAGSPAALRKEFPAAMFLVGEGGAAEKGVKKKGPPKGSEEEKKEEEEEVEEEVASAVMKNSNQKGRAKGKGKKKVKEERASSPPVEVGEPREFVLQPAPQGRAVRCRLTRDKKGMDRGMYPSYFLHLDTEKKVFLLAGRKRKRSKTANYLISSDPTNLSRGGENFIGKLRSNLLGNRFTVFDNGQNPQRGGGGDVGSLRQELAAVVYETNVLGFRGPRRMTVIIPGMNSDNERVPIRPRNVSFYHPTPYPSEPCFLFNHSTGPGIQLGQVTLESARASDSSGHS

SEQ ID NO: 14457 - protein, 305 aa, Homo sapiens
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 14458 - protein, 286 aa, Mus musculus
MQRYWRFQDNKIQDICFGVLGESWIQRPVMARYYSEGQSLQQDDSFIEGVSDQVLVAVVVSFALIATLLYALLRNVQQNIHPENQELVRVLREQFQTEQDVPAPARQQFYTEMYCPICLHQASFPVETNCGHLFCGSCIIAYWRYGSWLGAISCPICRQTVTLLLTVFGEDDQSQDVIRLRQDVNDYNRRFSGQPRSIMERIMDLPTLLRHAFREVFSVGGLFWMFRIRIMLCLMGAFFYLISPLDFVPEALFGILGFLDDFFVIFLLLIYISIMYREVITQRLTR

SEQ ID NO: 14459 - protein, 167 aa, Mus musculus
MNDNLEQVIRTPLKGGQRSERKKWIHCFEGVTCIIFCAALSAYDMVLVEDEEVNRMHESLHLFNSICNHKYFATTSIVLFLNKKDLFQEKVAKVHLSICFPEYTGPNTFEDAGNYIKNQFLDLNLKKEDKEIYSHMTCATDTQNVKFVFDAVTDIIIKENLKDCGLF

SEQ ID NO: 14460 - protein, 528 aa, Mus musculus
MCSLAAGNGRGAELGPEPLELSDSGDDAGWEDEDADTEPAHGRQHTPCLFCDRLFASAEETFSHCKLEHQFNIDSMVHKHGLEFYGYIKLINFIRLKNPTVEYMNSIYNPVPWEKDEYLKPVLEDDLLLQFDVEDLYEPVSTPFSYPNGLSESASVVEKLKHMEARALSAEAALARAREDLQKMKQFAQDFVMNVDVRTCSSTTTIADLQEDEDGVYFSSYGHYGIHEEMLKDKVRTESYRDFIYQNPHIFKDKVVLDVGCGTGILSMFAAKVGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCDIKHIDCHTTSISDLEFSSDFTLRTTKTAMCTAVAGYFDIYFEKNCHNRVVFSTGPQSTKTHWKQTVFLLEKPFPVKAGEALKGKITVHKNKKDPRSLIVTLTLNSSTQTYSLQ

SEQ ID NO: 14461 - protein, 261 aa, Mus musculus
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMARDLHFEGMFKKELQTSIF

SEQ ID NO: 14462 - protein, 154 aa, Mus musculus
MKISRGTTEILSDVQLIKTGDKVGASEATLPNMLNISPFSFRLITQQVFDKGSIYNLEVLDITEQALHSRVLESVCNVASVCLQIGYRIVASVPHSIIYRYKRVLPLSVETEYTFPLAEKVKAFLADPSAFVAAAITAAPAVAAAPAKAEAKKE

SEQ ID NO: 14463 - protein, 140 aa, Mus musculus
MFHNRHLFKDKIVLDVGSGTGILCMFAAKTGAHKFIGTKCFSISNYAVKIIKANKLDHEATIIMGKRTGFSTSPESPYTYWETTVFYMEDYLTVKACEEIYDIIIMRSNAKKNHDLDFTLDLDFKDQLWELFCSTNYQMI

SEQ ID NO: 14464 - protein, 188 aa, Mus musculus
MEKTGLIQKAKLAQSYKDTATCMKAMMEQGMEELSNKECSLLLVTYKNMVGEPQVLWRVIWSIEQKTDTSNKKLQLIKDYQEKVELELSSISIMVLELLVKYLIANATNPESEVFYLKMKGDYFRYLAEVIELNNKMAFDETIAELDILNKDSCKDRTIIMQLLRDSLPLWTSDSAGEERDAAQGAEN

SEQ ID NO: 14465 - protein, 191 aa, Mus musculus
MKALLLRTFWNKKINEVSSSDDKDAFYVADLGDILKKHLRWLKALPRVTPVYAVKCNDSRAIVSTLAAFGIGFDCASKTEIQLVQGPGVPPETIIYANPCKQVSQIKYAASSGVQMMTFDSEIELMKVARAHPKAKLVLRIATDDSKAVCRLSVKFGATLKTSRLLLERAKELNIDVIGVSFHVGSGCTDP

SEQ ID NO: 14466 - protein, 1123 aa, Mus musculus
METFFRKHFQRKARGPGERQRRSSGVGLPTGKARRRSPAGQASSSLAQRRRSSAQLQGCFPSCGVGTRGASRRRSSTAPPTCNPRFMVDVVPTLQPVTVGAQLLGAPLLLAGLTSMKEEEEEEGVQEGNETAEATSDARPGTRTTPFSHQGTWPLLPMPRCLRRASSHLLPADVECGHTLWGLHGHYRRLSQRWPSGQHPGLGGRSPRASGAAACPMIPARVRPLSRRRQVALRRKSAGPQPWSTLLMKAITKSGLQHLAPPPPTPGAPCGESEEQIQSTVDWSESAVYGEHIWFETNVSGDFCYVGEQHCVAKMLPKSAPRKKCAACKIVVHTQCIKQLEKINFRCKPSFRESGSRNVREPTFVRHHWVHRRRQDGKCRHCGKGFQQKFTFHSKEIVAISCSWCKQAYHSKVSCFMMQQIEEPCSLGVHAAVVIPPTWILRARRPQNTLKASKKKKRASFKRRSSKKGPEEGRWRPFIIRPTPSPLMKPLLVFVNPKSGGNQGAKIIQSFLWYLNPRQVFDLSQGGPREALEMYRKVHNLRILACGGDGTVGWILSTLDQLRLKPPPPVAILPLGTGNDLARTLNWGGGYTDEPVSKILSHVEEGNVVQLDRWDLRAEPNPEAGPEERDDGATDRLPLDVFNNYFSLGFDAHVTLEFHESREANPEKFNSRFRNKMFYAGTAFSDFLMGSSKDLAKHIRVVCDGMDLTPKIQDLKPQCIVFLNIPRYCAGTMPWGHPGEHHDFEPQRHDDGYLEVIGFTMTSLAALQVGGHGERLTQCREVLLTTAKAIPVQVDGEPCKLSASRIRIALRNQATMVQKAKRRSTAPLHSDQQPVPEQLRIQVSRVSMHDYEALHYDKEQLKEASVPLGTVVVPGDSDLELCRAHIERLQREPDGAGAKSPMCHQLSSKWCFLDATTASRFYRIDRAQEHLNYVTEIAQDEIYILDPELLGASARPDLPTPTSPLPASPCSPTPGSMQGDTALPQGEELIEAAKRNDCCKLQELHRAGGDLMHRDQKSRTLLHHAVSTGSKEVVRYLLDHAPPEILDAVEENGETCLHQAAALGQRTICHYIVEAGASLMKTDLQGDTPRQRAEKAQDTELAAYLENRQHYQMIQREDQETAV

SEQ ID NO: 14467 - protein, 394 aa, Mus musculus
MAARRRPAAGVGARDALAVLALALCTPGVGGGALEWYSAMVSIEYVDPQSNLTVWSVSESGRFGESSLREERQGLVGVPRAPAPAEGCAPDTRFVAPGALGNAPWVALVARGGCTFKDKVLAAARRNASAVVVYNLESNGNATEPMSHAGTGNIVVIMISYPKGREIFDLVQKGIPVKMRIEIGTRHMQEFISGQSVVFVAIAFITMMIISLAWLIFYYIQRFLYTGSQFGSQNHRKETKKVIGQLPLHTVKHGEKGIDVDAENCAVCIENFKVKDVIRILPCKHIFHRICIDPWLLDHRTCPMCKLDVIKALGYWGDPEDTQELPTPEAAPGRVSVGNLSVTSQDEERSESNLPSSSSSESGPHRPCLKEDAGEDTALLGAGRSEPQHGGSIC

SEQ ID NO: 14468 - protein, 248 aa, Mus musculus
MERASLIQKAKLAEQAERYEDMAAFMKSAVEKGEELSCEERNLLSVAYKNVVGGQRAAWRVLSSIEQKSNEEGSEEKGPEVKEYREKVETELRGVCDTVLGLLDSHLIKGAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADSAGEEGGEAPEEPQS

SEQ ID NO: 14469 - protein, 148 aa, Mus musculus
MNKDKGVGTGISLSVRLASSLPRLSERDGCSWKGLRKGQVKGGFPSRSSLGPRIHRHLKSRRISHRLCATAAVYSAAILEYLTAEVLELAGNASKDLKVMRITPRHLQLAIRGDEELDSLIKATIAGGGVIPHIHKSLTGKKGQQKTV

SEQ ID NO: 14470 - protein, 250 aa, Mus musculus
MSDGHEDVQVEKENKNFPLKTRDELLLNELPSVEELTIILPEDIALKPLGKVSSIIEQLVIIESVTNIPPVNEDTVIFKSDRQAAGKIFEIFGPVAHPFYVLRFNSSDHIESKGIKINDTMYFAPSMKDFTQYIFTEKLKQDRGSDASWENDQEPPPEVLDFSDDEKEKEAKQRKKSQIQGRKNLKSELNEPCEDFGEVIQKWNAYSSSKGSHHREFSRGFARAAFRGASVSKAPPPPPPNTHETCTGLA

SEQ ID NO: 14471 - protein, 507 aa, Mus musculus
MEDKEIGTPLPLPHSEARLQPTLVLTTLSAAFGSVFQYGYNIAVINTPHKVLKSFYNDTHFERHGTFMDESTLLLLWSCTVSMFPLGGLLGSLVVGLMVNKWGRKGTLLINNVFAITSAVLMGVSKVARAFELIILSRVLVGICAGIAYSTLPMYLGELAPQNLRGALGTMTEVFVIIGVLLAQIFSLQAILGNATGWPILLALTGVPAVIQLLSLPFFPESPRYTLIEKGDEETARQALRRLRGQNYNVEAEMEEMRTEERTEQAEGRLSVLNLFTFRPLRWQLISIVVLMAGQQLSGINAVNYYADVIYTSAGVDPTQSQYVTLGSGVINLVMTLVSAVIIERLGRRILLLSGYAICCSACLVLTVALLLQSTAPELSYLSIVCVFSYIVGHSIGPSPVPSVVRTEIVLQSSRTAAFTVDGAVHWLTNFIVGLTFSSIQVAIGAYSFLVFAGVCILTAAYIYVGRTLVEINCAFAKRNGVEFPEEKEVATAKPHTPSLPTKETAF

SEQ ID NO: 14472 - protein, 187 aa, Mus musculus
MAADISQWAGPLCLQEVDEPPQHALRVDYAGVTVDELGKVLTPTQVMNRPSSISWDGLDPGKLYTLVLTDPNAPSRKDPKFREWHHFLVVNMKGNDISSGTVLSDYVGSGPPSGTGLHRYVWLVYEQEQPLSCDEPILSNKSGDNRGKFKVETFRKKYNLGAPAAGTCYQAKWDDYVPKLYEQLSGK

SEQ ID NO: 14473 - protein, 355 aa, Mus musculus
MKSLPTDDKDAFYVADLGDILKKQQRWLKALPRVTPVYAVKRNDSRAIVSTLAAIGTGFDCASKTEIQLVQGLGVPPERIIYANPCKQVSQIKYAASNGVQMMTFDSEIELMKVARAHPKAKLVLRIATDDSKAVCRLSVKFGATLKTSRLLLERAKELNIDVIGVSFHVGSGCTDPETFVQAVLDARCVFDMATEVGFSMYLLDIGGGFPGSEDTKLKFEEITSVINPALDKYFPSDSGVRIIAETGRYYVASAFMLAVNIIVKKTVWKEQPGSDDEDESNEQTFMYYVNDGVYGSFNCILYDHAHVKALLQKRPKPDEKYYSPSIWGQHVMALIGSWSAVTCLKCMWVIRMLV

SEQ ID NO: 14474 - protein, 241 aa, Mus musculus
MMVVTLLTSSTPNTHSFCQAIRGISEETTTGVHNLYKMMSNGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYWLKNGRRIILLAEGRLVNLGCAMGHPSFVMSNSFTNQVMAQN

SEQ ID NO: 14475 - protein, 103 aa, Mus musculus
MADVEDGEEPCVLSSHSSSGSKSGGNKMFSLKKWNAVAMWSWDVECDTCATCRVQLKTSKRDCVVVWGECNHSFHNCCMSLWVKQNNRCPLCQQDWVVQRIGK

SEQ ID NO: 14476 - protein, 298 aa, Mus musculus
MGDQALSFLKDFLAGGIAAAVSKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGSSQREFNGLGDCLTKIFKSDGLKGLYQGFSVSVQGIIIYRAAYFGVYDTAKGMLPDPKNVHIIVSWMIAQSVTAVAGLVSYPFDTVRRRMMMQSGRKGADIMYTGTLDCWRKIAKDEGANAFFKGAWSNVLRGMGGAFVLVLYDEIKKYV

SEQ ID NO: 14477 - protein, 627 aa, Mus musculus
MALARDAKLESDTFQVLQDVANRLRIHSIRATCACSSGHPTSCCSVAEIMAVLFFHTMRYKQADPEHPDNDRFVLSKGHAAPILYAVWVEVGRICESDLLNLRKIHCDLEGHPTPRLSFVDVATGSLGQGLGAACGMAYTGKYFDKASYRVFCLMGDGESSEGSVWEALAFASHYNLDNLVAIFDVNRLGQSGTAPLEHCTAVYEKRCQAFGWNTYVVDGHDVEALCQAFWKAAQVKNKPTALIAKTFKGRGIPNVEDAENWHGKPMPKDRADGIVKLIENRIQTNRNLTPKPPIEDSPRISMSNTKMTSLPVYKLGDMIATREAYGLALAKLGQSNQRVIVLDGDTKNSTFSEVFKKEHPERFIECFIAEQNMVSVALGCATRGRTIAFVSTFAAFLTRAFDQIRMGAISQTNINFVGSHCGVSVGEDGPSQMALEDLAMFRSIPNCTVFYPSDAVSTEHAVYLAANTKGMCFIRTTRPKTAVIYTAEENFVIGQAKVIRQSAVDKVTVIGAGVTLHEALVAAEELSQQGIFIRVIDLFTIKPLDAVTIIQSAKATGGQIITVEDHYREGGIGEAVCAAISREPDIVVRQLAVTEVPRSGKPSELLDMFGISARHIIAAVKDTVMK

SEQ ID NO: 14478 - protein, 118 aa, Mus musculus
MKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADSAGEEGW

SEQ ID NO: 14479 - protein, 313 aa, Mus musculus
MASLADRVRGNGRIAAGLLFNLLVSICIVFLNKWIYVHHGFPNMSLTLVHFVVTWLGLYICQKLNIFAPKSLPLSKLLLLALSFCGFVVFTNLSLQNNTIGTYQLAKAMTTPVIIAIQTFWYQKRFSVRIQLTLIPITVGVILNSYYDVKFHSLGMVFAALGVVVTSLYQVWVGAKQHELQVNSMQLLYYQAPMSSAMLLVAVPFFEPVFAEGGIFGPWSVSALLMVLLSGIIAFMVNLSIYWIIGNTSPVTYNMFGHFKFCITLCGGYILFKDPLSVNQGLGILCTLFGILTYTHFKLSEQEGSKSKLVQRP

SEQ ID NO: 14480 - protein, 439 aa, Mus musculus
MAMPRNGSRLDIVHENLKMGSDGESDQASGTSSDEVQSPTGVCLRNRIHRRISMQDLNKRLSLPADIRIPDGYLEKLQISSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINERGELKLADFGLARAKSVPTKTYSNEVVTLWYRPPDVLLGSSEYSTQIDMWGVGCIFFEMASGRPLFPGSTVEDELHLIFRLLGTPSQETWPGVSSNDEFKNYNFPKYKPQPLINHAPRLDSEGIELITKFLQYESKKRVPAEEAMKHVYFRSLGPRIHALPESVSIFSLKEIQLQKDPGFRNSSYPETGVFVINHFTCRS

SEQ ID NO: 14481 - protein, 320 aa, Mus musculus
MSNESSKKQSSKKALFDPVSFSKDLLAGGVAAAVSKTAVAPIERVKLLLQVQASSKQISPEARYKGMLDCLVRIPREQGFLSYWRGNLANVIRYFPTQALNFAFKDKYKELFMSGVNKEKQFWRWFLANLASGGAAGATSLCVVYPLDFARTRLGVDIGKGPEQRQFTGLGDCIMKIAKSDGLIGLYQGFGVSVQGIIVYRASYFGAYDTVKGLLPKPKETPFLVSFIIAQIVTTCSGILSYPFDTVRRRMMMQSGESDRQYKGTIDCFLKIYRHEGVPAFFRGAFSNILRGTGGALVLVLYDKIKEFLNIDVGGSSSGD

SEQ ID NO: 14482 - protein, 435 aa, Schizosaccharomyces pombe
MTTIQKIYSRSIYDSRGNPTVEVELTTELGTFRSMVPSGASTGEWEAKELRDNDKNKWGGKGVTIAVHNVNNIIGPALVKSDIKITDQRGIDEFMIKLDGTNDKSKLGANSIVGVSMAVARAAAAFLKIPLYEYIGKLAGSKTTECIPVPSFNVLNGGRHAGGDLAFQEFMIMPIKAPTFSEGLRWGSEVYHTLKALAKKKYGASAGNVGDEGGIAPDLTTAEEALDLVNEAIKEAGYDGKVKIGFDVAASELYNGKLYDLDFKSEHPKPENKLDYKKLYEKYSALIEKYPIVFIEDPFSEEDWGAFSYMSSKTKVEVIADDLTVTNVKRLSKAIELKCANALLVKINQIGSLSETIDAANMAKKAGWGLMVSHRSGETDDSFIAHLAVGLEAGQMKSGAPCRSERLAKYNELLRIEDNLGDSAIYAGTRAADYI

SEQ ID NO: 14483 - protein, 354 aa, Mus musculus
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGESARADDARQLFVLAGSAEEGVMTSELAGVIKRLWRDGGVQACFSRSREYQLNDSASYYLNDLDRISQTNYIPTQQDVLRTRVKTTGIVETHFTFKELYFKMFDVGGQRSERKKWIHCFEGVTAIIFCVALSDYDLVLAEDEEMNRMHESMKLFDSICNNKWFTDTSIILFLNKKDLFEEKIKRSPLTICYPEYTGSNTYEEAAAYIQCQFEDLNRRKDTKEVYTHFTCATDTKNVQFVFDAVTDVIIKNNLKECGLY

SEQ ID NO: 14484 - protein, 216 aa, Mus musculus
MFVNECSVARERLAMNYFTMQNVVEGRRSAWMVISSIEKKTDTSNKKLQLTKDCQEKVELELRSICITVLELLGKYLIANAINPESKVFYLKMNGDYFQDLAEVACGDDGKQMIENSQRAYQEAFDISKKEMQPTHPIRLGLALNLPVFYSVILNNPELAYTLAKTAFDEAITELGTLNKDSYKDSTLIMQLLRDNLTLWTSDSAEECDAAEGAEN

SEQ ID NO: 14485 - protein, 375 aa, Mus musculus
MNTLGKTITCRAAIAWAKNSPLSIEEVQVEPPKSGEVRIKMISSGICGSDDHVLKGELVVNFPLIPGHEGAGIVESVGDGVCSMKPGDKVLILIIPQCRECDACLHPKGNFCYKQDVLPCSGVMLDGTSRFSCRGQKIYHSFRTSSFTEYTVVPEIAAVKIDDAAPMDKVCLISCGFPTGYGAAVNSAKVTPGSTCVVFGLGGVGSAIVMGCKASGASRIIGVDINEEKFPRARALGVTDCLNPNKLEKPVQEVVMEMTGVGVDFAFEAIGLVDTMVAAWNSCNNSYGVCLIAGLAPSDAQLSLEAPKILSGKTLKGVCLGDYKTRDCIPQIVTDYLQNKINIDPLVTYQLPFNQLHEALELFHSGKAIRCVLLF

SEQ ID NO: 14486 - protein, 287 aa, Mus musculus
MGGLEKKKYERGSATNYITRNKARKKLQLSLPDFRQLCILKSIYPHEPKHKKKANKGSTAARTFYLIKDIKFLLHEPIVNKFRQYKVFVQKLRKAYGRREWNAVESLKDNKPCYKLDHIVKERYPTFIDALLDLEDALSMCFLFSTFPWTGKCHMQTIQLCHRLTVQFLPYVITAQALPCPIKAFIIRLKCWVSSSYGLHPMLSPMIIRQMWTTGSWPPSLSSIPCSWASSTSISTSHSTFTTHQSLKVKPKQRQRSARTHMHWTLRALWRNWLPSVPAWPEWWCLL

SEQ ID NO: 14487 - protein, 370 aa, Mus musculus
MVQASMRSPNMETFKQQKVEDFYDIGEELGSGQFAIVKKCREKSTGLEYAAKFIKKRQSRASRRGVCREEIEREVSILRQVLHPNIITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDTQQAMVRRESVVNLENFKKQYVRRRWKLSFSIVSLCNHLTRSLMKKVHLRTSEDLRNCESDTEENIARRKALHPRRRSSTS

SEQ ID NO: 14488 - protein, 722 aa, Mus musculus
MEAESPASAGASEPRALGTVDSIGSQLSRIRRKLFTWVGATVDAVEERCPTWRLAGGSVALPGSVPAFLQIGIRAHLACKSSLERFESTGMRELVGSVPGDLDLREECDSFSSRRLVGVERILILDFVAEKNFRGYFEDHSSGPDAVLVYLRHGHHQPVFGRKVQSEHAHAAEFHQLLLALPGLHVDAGVSVRLMCVMSRATFTHPDFFQPGSDNLLEILRRKWWKYTLLGLADVEANYLIVRAYQYTTLTSVQLLDCFGIPVLMALSWFILRARYKVIHFIAVFVCLLGVGTMVGADILAGREDNSGSDVLIGDILVLLGASLYAVSNVCEEYIVKKLSRQEFLGMVGLFGTIISGIQLLIVEYKDIARIQWDWKIALLFVAFALCMFCLYSFMPLVIKVTSATSVNLGILTADLYSLFFGLFLFEYKARLLLCFEFWSKLLSKPVILGIPPIQCHTIRFYPAGLPLRLSAIVNRSRSWTEWALTWSEGAQHTVSREDWESTPKQKRKCASSLAGGEPGALNRTLPSKHFLLPSGNNLKPGANLWAIYHTLSTTWLICRDEKHSLYIRRGDVRNIGANSMVTSGVQSCTDRRGLSILAPVVRSLTPEVKLCCLSSNSMEAAERTGRCSYQRAESDMNMKSEKGQVYDTREEGSGARSRERESYRMAALFLSSFRGRWRGKGNGREGHMLEILTTAIPQGLGTSPHRPMVSSSINDPIALQG

SEQ ID NO: 14489 - protein, 740 aa, Mus musculus
MLEERESKEPAMNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISMFITPMLRGDVKCFGEDCYALAFGIPGLLMVLALVVFAMGSKMYRKPPPEGNIVAQVTKCIWFAICNRFRNRSEDIPKRQHWLDWAAEKYPKHLIMDVKALTRILFLYIPLPMFWALLDQQGSRWTLQANKMDGDLGFFVLQPDQMQVLNPFLVLVFIPLFDLVIYRLISKCGVNFSSLRKMAVGMILACLAFAVAALVEIKINGMIHPQPASQEIFLQVLNLADGEIEVTVQGNRNNPLLVESISSFQNTTHYSKLRLETKSQDLHFHLKYNNLSVHNEYSVEEKNCYQLVVHENGESLSSMLVKDTGIKPANGMTAIRFINTLHKDMNISLDANAPLSVGKDYGVSEYRTVQRGKYPAVHCETEDNVFSLNLGQLDFGTTYLFVITNITNRGLQAWKAEDIPANKLSIAWQLPQYVLVTAAEVMFSVTGLEFSYSQAPSSMKSVLQAAWLLTVAVGNIIVLIVAQFSGLVQWAEFVLFSCLLLVVCLIFSVMGYYYVPLKSEGIHEATEKQIPHIQGNMINLETKNTRL

SEQ ID NO: 14490 - protein, 113 aa, Mus musculus
MADVEDGEEPCVLSSHSGSAGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 14491 - protein, 738 aa, Mus musculus
MSEEQWVSLSSEEFDQLQKYSECPYFPPDSIMSGFPASCSFKCNFTGQQVVRGEPELLAHQLGIAGGWFTQDSSKKIKDVLAEFNEGGSLRQYDPHKPISYDVFKLFMRAYLEVDLPQPLSTHLFLAFSQKPRQETPDHPKEGASSSEPNVSDYNSDNAAKADEACAPDTESKTTKTQAPSKELEAAAPWEDPGALASSSDAPVVYLKDVVCYLSLMETGRPQDKLEFMFRLYDSDENGLLDQAEMDQIVSQMLHVAQYLEWDPTELRPERCLRQQDEVYTWQKLQFPSLPSRGNSMIETQRTEKLEPSVEELSMILKEMLQGMDYDKDGFVSLQEWINGGMTTIPLLVLLGMDDSGSKGDGRHAWTLKHFKKPTYCNFCRAMLMGVGKQGLCCIYCKYTVHQRCVSKTIHGCVKTNSKAKRSGEVMQHAWVEGNSSVKCDRCHKSIKCYQSVTARHCVWCRMTFHRKCELSTVCDGGELKDHILLPTSICPVSGDRQGGKSDGSVAAKGELVTQYKIIPSPGTHPLLVLVNPKSGGRQGESPNIVDCTVKKTWTRGQLIIWPRILRKFHYLLNPEQVFNLDNGGPTPGQRYNHTLCVQRSHTENLTVATTSGRTQWIQMQMPWQMKHTLPWDKANFTKHPPVAVLPLGTGNDLARCLRWGGGYEGGSLTKILKEIEQSPLVMLDRWYLEVMPREEVENGDQVPYNIMNNYFSIGVDASIAHRFHMMREKHPEKFNSR

SEQ ID NO: 14492 - protein, 277 aa, Mus musculus
MITQNASLWEQTMWAPSRCSRSACPSEGRAVVLMGKNTMMRKAIGGHLENNPALEKLLPHIRRNMGFVFTKEDFTEIRDILLANKVPAAARAGAIAPCEVTVPAQNTGLGPEKTSFFQALGITTKISRGTIEILSDVQLIKTGDKVGASEATLLNMLNISPFSFGLIIQQVFDNDSIYTPEVLDITEQALHSRFLEGVRNVASVCLQMGYPTVASVPHSIINGYKRVLALSVETEYTFPLAEKVKAFLADPSAFEAAAPVAAAYHCCPCGCCSPCQS

SEQ ID NO: 14493 - protein, 160 aa, Mus musculus
MGLGSAVRSLPTEMSCQTATALPTGTSKCPPSQRVPALTGTTASNNYLASLFECPVCFDYVLPPILQCQSGHLVCSNCRPKLTCCPTCQGPLGSTRFLAMEKVANSVLFPCKYASSGWEITLPHTEKAEPEELCEFRPTPAPALVLPVSGKAPSMLSCPT

SEQ ID NO: 14494 - protein, 1128 aa, Mus musculus
MAECGRGAAGGALPTSPSPALGAKGALKAGAGEGGGGGGGGRLGHGRARYDSGGVSNGDCSLGVSGDEARTSPGRGPLGVALARTPSPAAGPVPRDSKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISEQISEDCAFSVIYGENYESLDLVANSADVANIWVTGLRYLISYGKHTLDMLESSQDNMRTSWISQMFSEIDVDGLGHITLCHAVQCIRNLNPGLKTSKIELKFKELHKSKDKAGTEITKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKILGDKLYTTSPNMEESYLPSPDVLKGKILIKAKKLSSNCSGVEGDVTDEDEGAEMSQRMGKENVEQPNHVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNVGWFRQNGNCGYVLRPAIMREEVSFFSANTKDSVPGVSPQLLHIKIISGQNFPKPKGSGAKGDVVDPYVYVEIHGIPADCAEQRTKTVNQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNNPLVVLNLSEPYPTMELQAIVPEVLKKIVTTYDMMMQSLKALIENADAVYEKIVHCHKAAMEFHEHLHSIGTKEGLKERKLQKAVESFTWNITILKGQADLLKYAKNETLENLKQIHFAAVSCGLNKPGTENSEAQKPRRSLEAIPEKASDENGD

SEQ ID NO: 14495 - protein, 503 aa, Mus musculus
MDLAVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTRLLTDVQLMKGKQECMDSKLLAMKHENEALWREVASLRQKHAQQQKVVNKLIQFLISLVQSNRILGVKRKIPLMLSDSNSAHSVPKYGRQYSLEHVHGPGPYSAPSPAYSSSSLYSSDAVTSSGPIISDITELAPTSPLASPGRSIDERPLSSSTLVRVKQEPPSPPHSPRVLEASPGRPSSMDTPLSPTAFIDSILRESEPTPAASNTAPMDTTGAQAPALPTPSTPEKCLSVACLDKNELSDHLDAMDSNLDNLQTMLTSHGFSVDTSALLDIQELLSPQEPPRPIEAENSNPDSGKQLVHYTAQPLFLLDPDAVDTGSSELPVLFELGESSYFSEGDDYTDDPTISLLTGTEPHKAKDPTVS

SEQ ID NO: 14496 - protein, 428 aa, Mus musculus
MGGLEKKKYELGSANNYITRNKARKKLQLSLPDFRWLCILKGIYPHEPKHKKKANKGSTAAWTFYLIKDIKFLLHEPIVNKFRQYKVFVQKLRKAYGRREWNAVESLKDNKPCYKLDHIVKERYPTFIDALLDLEDALSMCFLFSTFPWTGNPALSNKGIYYQAEVMDVDYRVLATFTEFYTMLLGFVNFHLYQSLNLHYPPKLEGQVQAETKISENTYALDSESSMEKLAALSASLARVVVPTIEEAEADEFSTDGEVTAQEGDRRKELEAQEKHKKLFEGLNFFLNREVPPEALAFIIRSFGGNVSWDKSLCIRAIYDITDSCITHQIVDWSGQQTLIIGRLEEKKPQFMAGTVKLEDKQWLAQEEESEAKRLAIMMMKKLEKYLYQKIMFGKRHKVREANKLAEKGKAPDDAVRSEKKAKRTRPV

SEQ ID NO: 14497 - protein, 316 aa, Mus musculus
MASHLELNNGTKMPTLGLGTWKSPPGQVTEAVKVAIDLGYRHIDCAQVYQNEKEVGVALQEKLKEQVVKRQDLFIVSKLWCTFHDKSMVKGAFQKTLSDLQLDYLDLYLIHWTTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWAKPEDPSLLEDPRIKAIAAKYNKTTAQVLIRFPIQRNLVVIPKSVTPVRIAENLKVFDFELSSEDMATLLSYNRNWRVCALMSCAKHKDYPFHAEV

SEQ ID NO: 14498 - protein, 224 aa, Mus musculus
MATCMKAVTEQGAELSNEERNLLSVAYKNVVGGHRSAWRVISSIEQKTDTSDKKLQLIKDYREKVESELRSICTTVLELLDKYLIANATNPESKVFYLKMKGDYFRHLAEVACGDDRKQTIENSQGAYQEAFDISKKEMQPTHPICLGLALNFSVFYYEILNNPELACTLAKTAFDEAIAEIDTLNKDSYKDSTLIMQLLRDNLTLWTSDSAGEECAAAEGAEN

SEQ ID NO: 14499 - protein, 271 aa, Mus musculus
MPREDRATWKSNYFLKIVQPLNDYPKGIIVGADNVGSKQMQQICMSLQGKAVVLMGKNTMVRKAIRGHLENNPALEKLLLHIRGNVAFRFTKENLTEIRNILLASKVPAAARTGTIAPCEVTVPAQNNELIKTGDKVEASEIVLLNTLNISAFFFGLIIQQVFDNGSIYNPEVLGITGQTLHSRFLEGVHNVASICLQRTVASVPHSIINEYKEVLALSVETEYTFPLAEKVNAVLADPSEFVAAGPAAAKAEAKEESEESDEEKGFGLFH

SEQ ID NO: 14500 - protein, 508 aa, Mus musculus
MPAHIEEELPPPSPQPSNPEDGELYSQYKVVRTLGHGTYAKVLLAKHWLTGTPVAVKVLLKNKPCFQPAMKEANIMKKIKHPNIVSLLQVIETKTRGYLIMELVEGQELYEYIKNSGHIEEDEARQIFLQILSAVGYCHGSGIVHRDLKPDNIMIDSKGSIKIIDFGLSTQVKPGQLLHEHCGAYAFGAPELFLWKSYDGTKSDLWALGVILYYMVVGKVPFDSFIIPELQMQILAGVYPAPCGVSNELKDLLSLLMTVNPKYRPTVTEVMKHPWLKGYCKGLTNIHEEPVPVRPDPDIVDAMQYIGFQAKDIRESLTKEKFNEMSAAYYLLEEQALQREVRSTQAPTVSQVKAPFPSMDAGAASCLKIKRSGSAPILGRSVWPSSIGQVPAYGQKVRQRAGRRSTGHGLVFRPNQMTPTQDQHHIRAMSVPCMLSTSSISEESVSEKREENLSNSAPAEDKPIRSRGWRRGIMRWTRRVGNAIRTLCCCIPSRKTPRLGQRRVSPQK

SEQ ID NO: 14501 - protein, 144 aa, Cicer arietinum
GVRVPISEDVFRLNELGEGGVVMDTGTAVTRLPTAAYDAFRDAFIGQTTNLPRSSDVSIFDTCYDLYGFVSVRVPTISFYFLGGPILTLPARNFLIPVNDVGTFCFAFAPSPSGLSIIGNIQQEGIEISVDGVNGFVGFGPNIC

SEQ ID NO: 14502 - protein, 432 aa, Drosophila melanogaster
MSKPSYKVADISLAEWGRKAIIIAENEMPGLMACRKKYGPSKPLKGARITGCLHMTVQTAVLIETLVELGAQVQWSSCNIFSTQDNAAAAIAATGVPVYAWKGETDEEYMWCIEQTLVFPDGQPLNMILDDGGDLTNLVHEKFPQYLKNIKGLSEETTTGVHNLYKMFKEGRLGVPAINVNDSVTKSKFDNLYGCRESLIDGIKRATDVMIAGKVCCVAGYGDVGKGCAQALKGFGGRVIVTEVDPINALQAAMEGYEVTTMEEASKEASIFVTTTGCRDIITSVHLQQMPDDAIVCNIGHFDIEIDVDWLNANAKEKVNVKPQVIRHTMQSGKHIILLAEGRLVNLGCAHGHPSFVMSNSFTNQVLAQIELWTKSDKYAVGVHVLPKILDEEVASLHLEKLGVKLTKLTEKQATYLGVSQTGPFKPDHYRY

SEQ ID NO: 14503 - protein, 257 aa, Mus musculus
MYEQLKDEWNRKNPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFAEATRILFFSTPKKMTDYAKKRGWVLGPNNYYSFASQQQKPEDSTIPFTELAKQVIEYARQLEMIV

SEQ ID NO: 14504 - protein, 237 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 14505 - protein, 237 aa, Mus musculus
MELTSDMRAILVDWLVEIQGSFQMTHETLYLAVKIMDLYLMKAQCKKNHLQLLGSTTYMIAAKFEESYPPSLSEFLFICEDMYEKSDMVSLESSILQTLNFDINIPTAYNFLRRYASCIHASMKTLTLSRFICEMTLQEYEYIEERPSKLAAASFILALYMRNLSNCVPTLEYFTGYKMAELHILVRKLNHLLNFRSHSILKNVFEKYSEETYFEVAKIPPLSKQDLENLLNCALFH

SEQ ID NO: 14506 - protein, 951 aa, Mus musculus
MVELKLRKEIVIPTASSENRRVITPHRKVSLVAPTRQDMEEWINIIKTVQQGEIRQIPAAENNPFLVGMHYWYSSSNPRSHFCNVCRENIPALSRDAVTCEVCQVKSHKFCALRANKDCKWNTLSVTDDLLLPADEIQTMPHQWVEGNIPAGSQCVVCHKSCGSHHRLQDFRCLWCGSTVHGACQKRFSKECSFGSRRSSIVPPTALSDPRGDGQLVVSPDFWNLDWPLTCSCPLLIFINSKSGDHQGIIFLRKFKQYLNPSQVFDLAKGGPEAGIAMFKNFARFRVLVCGGDGSVSWVLSTIDAYGLHDRCQLAIIPLGTGNDLARVLGWGAVWSKGTSPLDILSRVEQAHVRILDRWSVMIRETPRQAPLLKGQVAMDIPRFEAAAIKNVESATTELNKILKAKYPTEMVIATRFLCSAVEDFVEDIVKAWHQIKQNSTAVESVILKSDLMYDKLSVLIDLLAEDAVAASAERTATAYGSRSQADGKPFVPQLDHIARAKLELAERAQKLQQSLKLIIFQVEQGSRCDILCSIPSLRNEDLDNLDLEHLHIAPETIRFKEKCVMNNYFGIGLDAKISLEFNSRREEHPEQYNSRLKNKIWYGLLGSKELLQRSYRKLEERIHLECDGEAVSLPNLQGIVVLNITSYAGGVNFWGRNRATTEYDVPAINDGKLEVVAIFGSVQMAMSRIVNLQQHRIAQCHEVVITIDGEDGVPVQVDGEAWIQKPGLIKIKYKNVAQMLMRDRDFENSMKTWESKHTEIQAVQPPHLDFQESQDSLSDGEYAQMQHLARLAENLISRLTDLSKVHQHVSVLMDSVNASANILNDVFYSQDSGNEAGAASCIPIELRDAEDRAMLQTALDAMNTELRRILAIGWLSQIFFPEEQASDTRSLSRRFRIKFPKLGKKKQREEGEKPKSSQRFPGFLGKFWRRRNRSNRAKADDPPTPSSSQL

SEQ ID NO: 14507 - protein, 452 aa, Homo sapiens
APDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 14508 - protein, 251 aa, Mus musculus
MPGLMRMREMYSASKPLNGARIAGCLHMTVETAVLIETLVALGAELLSGIRVISEETTTGVHNLYKMMPNGILKVPTINVNDSVTKSTFDNLYGCQESLIDGIKRATDVMIEGKMAVVTGYGDMSKGCAQALRGLGAQVIITTIDPITALQAAMEGYEVTTMDEACKEGNIFVTTTGCVDIILGRHFQQMKDDTIVCNIGHFVVEIDKMDEAVTEAHLGKLNVKLTKLTEKQAQYLGMPINGPFKPDHHHH

SEQ ID NO: 14509 - protein, 198 aa, Mus musculus
MPREDRTTWKSSYFLKIIQFLDVYPKCFLVGVDNVGSRQMQQIPMSLRGKAVVLMGKSTMMRKAIRGHLENNPALEKLLPHIRGNVGIVFTKEDLTEIRDMLLANKGVRNVCSICLHIGYPTAAPVLHSIIDGYKQVLALSVETKYTSPLAEKVKAFLADPSAFATAATTTAPAASADPAKAEAKEESAESERMCHFD

SEQ ID NO: 14510 - protein, 290 aa, Mus musculus
MASSKKVTLSVLSREQSEGVGARVRRSIGRPELKNLDPFLLFDEFKGGKPGGFPDHPHRGFETVSYLLEGGSMAHEDFCGHVGKMNPGDLQWMTAGRGILHAEMPCSEEPAHGLQLWVNLRRSEKMVAPQYQELKSEEIPKPTKDGVTVAVISGEALGIKSKVYTRTPTLYLDFKLDQGAKHSQPIPKGWTSFIYTISGDVYIGPDDAQQKIEPHHTAVLGEGDAVQLENKDPKRSHFVLIAGEPLREPVVQHGPFVMNTNEEISQAILDFRNAKNGFEGARTWKSKIGN

SEQ ID NO: 14511 - protein, 816 aa, Homo sapiens
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 14512 - protein, 677 aa, Homo sapiens
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 14513 - protein, 816 aa, Homo sapiens
MAEPLKEEDGEDGSAEPPGPVKVEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 14514 - protein, 426 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 14515 - protein, 464 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 14516 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 14517 - protein, 297 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLGKLTIYPHLMDIELVMI

SEQ ID NO: 14518 - protein, 307 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESLSTCWRRCLYWTQIRELQRPKPLHMPTLLSTTILMMNQWPILMISPLKAGTSL

SEQ ID NO: 14519 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 14520 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 14521 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 14522 - protein, 360 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLKHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 14523 - protein, 360 aa, Homo sapiens [sequence omitted]

SEQ ID NO: 14524 - protein, 249 aa, Homo sapiens
MVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 14525 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 14526 - protein, 575 aa, Serratia marcescens
MISGILVSPGIAFGKALLLKEDDIVINRKKISADQVEQEVSRFLAGRAKGHEQLEAIKTKAGETFGEEKEAIFEGHIMLLEDEELEQEIIALIKDDLASADAAAYTVIEGQAKALEELDDEYLKERAADVRDIGKRLLQNILGMPIVDLGSIQDELILVATDLTPSETAQVNLDKVLGFITDLGGRTSHTSIMARSLELPAIVGTSDVTKQVKNDDYLILDAVNNKIYVNPTADVIDQLIAAQNQYITEKNDLAKLKDLPAITLDGHQVEVCANIGTVRDVAGAERNGAEGVGLYRTEFLFMDRDSLPTEDEQFQAYKAVAEAMGSQAVIVRTMDIGGDKDLPYMNLPKEENPFLGWRAIRIAMDRREILRAQLRAILRASAFGKLRIMFPMIISVEEVRDLRGEIETLKAQLREEGKAFDESIEVGVMVETPAAAVIAHHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKALAAQALAQPTAQDLMNCVNKFIEEKTLC

SEQ ID NO: 14527 - protein, 566 aa, Homo sapiens
GAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 14528 - protein, 1997 aa, Chlamydomonas reinhardtii
MAMPRHGRRPARCSSNRASQWLLLVLGVALAASPRFLLLVEAATYTLTLDKLGPTVNPTTSDAVTFTATVASPDSTTAVFFTLDYGDGVTAETTRTTTGALSTTPTANLVSAGTYTVTYASIGTKFVTLRLYDSAVAPGVVTGLEDGPHLCEDSTLTATLLQSGVPRLNLAFSGFKGRVSSSTANRADMWATIQLDTAPGVFESSRIFIGIAPTASTNYDFVIPDQVYNLEGAKTTVLRIYDAPVGGTLLRTFTPAAANAVYVVDPSKYVLTLTVGPTSVTTADQVTFTQTTTEVSYSASATSPILQWRFNWDDPSVVETPLAYPDALTAASNFPTTATAVSSAAASTFRYTSTGSKNARLRLYDGANNVIAEKIVVITVSNAGYTLALAKTTADPVTTDDTIAFSAGAKHLSSTSQVWWTIDYGAGESSPRTALTMTNVGAAAPNAIASLSNQYTSGGTKLATLRIYDRDGVGANTGLLLASTTVTFTVTPVLYALESAVEPFSPIATVAAKWSFKIQRSKATPAGVTGSIKCAFFGADTGTAPADLAAWLTAANGAGGLTATILPSSIPSDIISFTRTYAAAAASLQGKLQCFIGSTPLWDPYYPTPVFQVLAAAPAYTLSASVTPAVVPVDTATLWTYNIIRSVPVPAGGPSLPILCSFWDGKTGAAPTTDAGWAALAGSANGKGTSMAPGSTTATCSFTPSYSTTGTATPTLQLIQNSFALDAATTVGFLSPVYTAPAFATVTAASYTISSYLNPVTPVAGGAAAVWRIVITRNAAVTASAKTLTCQMPDNGQGGTPADVTADIAVGGTTTVCVFFIAGYTTGTPGPYFATPGPYFATVNVVDGAVTTSHITKNFTVLASGTTAPTYAVTSVVSPATPVKVSTPVTYTFTITRTTAVPAGGIPQPIICEFFNGEGTAPASAAAYWRVSTTIPDADTVVAVMAPGETTTTCTFTTYYTTVSAGGFTAKLMVFGESATAAPLLTSLSVTPSQLLAAVHSFATPMVVAAAVVAVESTTISPNYNPTTPYTNIPTYFTFTLLRDPPVPPSASSGVQFACALYTGQNVNPASAPSAITDAVYKTFTDVTTAVATDANYFADQQLRVVTMAPGTGRVSCTFPTLYAAAGPFSPKFFVFEYASSTVGANALAVADTVTSLTSFTTQAAPTFITGPTNVPQRVPLPKGFRTTCFDGYELIFSNDNYTNGVRVAVDAYPYPVGQCRKCPGGTATMDGYRCIPCPSGYWSNEGARECTACPAGTIAKPAALTARAKYSIDPTTYHFVTHLAMGPESCKKCPKGYFQPNIAGTVCLPCPSGFVSTSGATGCTACSEGTYHTDGVGTTTPGEATSLDTTDTFGSIYPIIPNTCRQCPANTYLPLRGQAAIASMNLAAVSSATPCRPCEDGTWSLRAGAAGCQKCPPGTYRNTWFSGQLGSPFITADGVPVATTLTELGSGCSQCPPGTYAPTFGMSVCLPCPAGTFASAPGATACQQCKPEPGTNSLMGDRTQQMALVVTNAANDFPALRAYTISGMVAGPAYAKPIVTGPDTNFFMAGKSETCSTNLPGYYTDVDGLPIQLPCKPGTFMPFDTATANLLDTGLTVDGTQCYTCQTGTFNDEFSQPVCKACWSGSFASKRGLPTCEIAQPGTFTNVAAAANATFNTATLIPTGLVKGAQAPTPCGMGYFQSSAETTTCTACAVGTYADQAGLAACKPCQPGRYQNSIGQRVCKPCDMGTYSRYGGELCTKCPAGTVASKTGSSQCTPCAAGFYANAPDSATSCRACPRGYYGPYSGAYADNLGDEFEGPRGCYKCPYDFFADRPGVRQCTACPPLDLGGGNLVEQCTEDLGSQRCKPCSLLSKPKTARTEQSPPPPSPSPPPPPPASPRPPSPNPPSPRPPSPAPPSPNPPPTSQPPSPPPSPPPPRPPPPRRPHPARRPPTALPPPPPPASPAINPGGGVNQNGDPVGHRRAILSLMEDEDAEAAQEEQAIVDVDAEMQPQDDE

SEQ ID NO: 14529 - protein, 249 aa, Streptomyces sp. JP95
MELGLQGKKLLVTGGSRGIGRGVVLAAARAGADVLTCYVNDSEHVESLRRELKALGGDHEVVRADVGDLDQVDALVGWARERYGKLDGIVNNAGVISHIPFAELAPDEWSRVLDTNLTAAYRVIQQSLPLLGSGASVVNIGSRGAAAGIPLRAHYTAAKAAMIGLTRSLAKELGGKGIRVNVVAPGVIETEAFDTMPAERAEGLRAMYAQKTALARLGRVDELAAPVLFLLSDLAAYVTGETLNVDGGI

SEQ ID NO: 14530 - protein, 402 aa, Streptomyces sp. JP95
MAGHTSNSIVIDAPMDLVWERTNDVASWTELFSEYSLAEILEEDGPTVTFRLALHPDENGKVWSWVSRRTTDVASRTVRAHRVETGPFAYMNIHWEYVQTDAGVRMQWTQDFHMKDEAPIDDAGMTDRINRNSVVQMGLIKSRIEAAARAARTPFADLAGKRIVVTGGSRGIGRGIVLAAARAGADVVTCYREENDHTASLAKELAPLPGSQHLLRADVSEAAGARLLADRARELLGGLDAVVNNAGDFAPRPYTELTDAAWATALQSNLTSTHQVIQAALPLLGAGGSIVNLGSTVARIGMAGGVHYTAVKQALVGLTRSLARELGPRGIRVNTLSPGRIATEALDALPPEEAARQRAVFSKFAALGRLGTPQEIADVVLFLISDQSSYITGQNIHVDGCV

SEQ ID NO: 14531 - protein, 376 aa, Homo sapiens
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVVVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 14532 - protein, 366 aa, Paramecium primaurelia
MSDKKTSQKNSFNTRQNSKDNSMEADNQLNKHHFLLQYIIGVGGFGRVWKVSYKQQVFAMKEISKALVLLKQSVQSIMNELQFLTELRHNLLVNVFSAFQDNQNLYLVLDYLGGGDLRFHLGKLRKFTEEQTKFFAACIIVGLEYLHEKNIIHRDIKPENLILDNQGYVRITDLGVAIKKTGQNFETSGTPGYMAPEVIFRQDHGVAVDFFALGVICYEFMTGRRPYYGNRREIREQIIAKQVQIQTSSEGWSTESIDFINLLLQRKPQNRLMNPRQHKWFKNFPFDLLLQKKLKAPFIPKTTDNFDQSQIYYEDEENNQIIRLHQHLIRENQNVFQGYLYQEKYSQFRIKQRKSSINNSKIFQFY

SEQ ID NO: 14533 - protein, 196 aa, Selaginella lepidophylla
MADTEFFTEYGEASRYKIQEVIGKGSYGVVCSAIDTHTGEKVAIKKINDIFEHVSDATRILREIKLLRLLRHPDIVEIKHIMLPPSRREFKDIYVVFELMESDLHQVIKANDDLTPEHYQFFLYQLLRALKYIHTGNVFHRDLKPKNILANAYCKLKICDFGLARVAFNDAPTAIFWTDYVATRWYRAPELCGSFF

SEQ ID NO: 14534 - protein, 528 aa, Citrus sinensis
MESTEAGAAAAAPTKNQSSIELRQPPPPPSSPMWKIVMVASIAAGVQFGWALQLSLLTPYVQLLGIPHKWSSLIWLCGPISGMIVQPIVGFHSDTCKSRFGRRRPFILAGAVLVAIAVFLIGYAADIGHSAGDSVTDSVKTRAIIIFVIGFWILDVANNTLQGPCRALADLSSGSSNKKTRTANSFFSFFMAVGNVLGYAAGSYTHLYHMLPFTKSKACDVYCANLKTCFFLSIALLITLTTIALFYVTEQRLEEIDDKETAPSTKDPFFSEIFGALKGLQKPMWILLAVTALNWIAWFPFLLFDTDWMGREVYGGNSKGSAEELRVYNNGVRAGSLGLMLNAIVLGFTSLGVEVLAKLIGGVKRLWGVVNFLLAVSLAFTFLITKLAESNRRSVTTAGGATHILPPPVGVKVGALAIFTVLGIPQAITFSVPFAMASIFSRTSAAGQGLSLGVLNLAIVVPQMLVSLLSGPFDAVCGGGNMPAFMVGAVAAALSGIVALTLLPSTTADVPPPITEAGTATANQTNKL

SEQ ID NO: 14535 - protein, 588 aa, Citrus hybrid cultivar
  unsure (1)..(588): unsure at all Xaa locations
QEFGTSLKXRFLAAKPRTLDGFSLSSNGVSKFQSFVSKPQGFVPKERPLLICKAEAAASASADGQPLLGEAEKPKFFGIEYTTFKKIIPLGLMFFCILFNYTILRDTKDVLVVTAKGSSAEIIPFLKTWVNLPMAIGFMLLYTKLADKLSKQALFYTVIVPFIAFFGAFGFLLYPLSNAIHPQALADKLLNILGPRFLGPLAIMRIWSFCLFYVMAELWGSVVISVLFWGFANQITTVDEAKRFYPLFGLGANVALIFSGRTVKYFSNLRKNLGPGVDGWAVSLKGMMSIVVLMGLSICGLYWWVNNNVELPTRSKKKKEKPKMGTMESLKFLVSSRYIRDLATLVVAYGISINLVEVTWKSKLKAQFPSPNEYSSFMGDFSTATGIATFTMMLLSQFIFDKFGWGVAAKITPTVLLLTGVGFFSLLLFGDPLGPALAKFGMTPLLAAVYVGAMQNIFSKSAKYSLFDPCKEMAYIPLDEDTKVKGKAAIDVVCNPLGKSGGALIQQFMILTFGSLANSTPYLGGILLVIVLAWLGAARSLDTQFTALRQEEELEKEMERAAVKIPVVSENEGGNGTLPRWISFECSR

SEQ ID NO: 14536 - protein, 607 aa, Citrus sinensis
MSETRSFKVPYRNLKKGTAAEVEMIEADEFHHRIDLNSNASSPPSSSHSPIPNGTSNFAVRPKQCSLITLVLSCTVAAGVQFGWALQLSLLTPYIQTLGIQHAFSSFIWLCGPITGLVVQPCVGIWSDKCTSKYGRRRPFILAGCLMISVAVIIIGFSADIGYILGDTKEHCSKFRGTRTRAAFVFVIGFWLLDLANNTVQGPARALLADLSGPDQRNSANAILCSWMAVGNILGFSAGASGSWHRWFPFLTSRACCAACGNLKAAFLVAVVFLTLCALVTIYFADEVPLTVNQPNHLTDSAPLLDDPQRTAISKSKHDMPAAPNANGNKVESGHERDANLKHISKKAEDPNGSFNDGPGAVLVNLLTSLRHLPPAMHVVLVVMALTWLSWFPFFLFDTDWMGREVYHGDPKGNDHEVKFYDQGVREGAFGLLLNSVVLGVSSFLIEPMCRWIGSRLVWAISNFIVFACMATTAIISVISVRRNILEGIEHGIGANQAIKVASLVVFTLLGFPLAITYSVPFAITGELTADSGGGQGLAIGVLNLAIVIPQMIVSLGAGPWDALFGGGNIPAFGLASLSALAGGVVATLKLPHLSSNSFTSSGFHFG

SEQ ID NO: 14537 - protein, 236 aa, Drosophila melanogaster
MSAEEAGSRQCSFQPVTHCIFELDGLLIDSERLRTETVQRILDPYGHTYSFDLKMRCMGKPDSEQAALIVNTFNLPFSMTEFENQQELQCRGKMGFIRLMPGVERLLHHLKAFNIPMAIASGCCRDSFRIKTRRHSRPFDVFHHVVLSGSDEEVKRGKPAPDVFLTTASRFEESPEPSKCLVFESSLVGMEAALSAGMQVVLVPDPLVSFRASAHATLRLRSLEGFKPQYFGLPPL

SEQ ID NO: 14538 - protein, 623 aa, Drosophila melanogaster
MSNAKLDSKVVQNLKDVAQKLRIHSITSTQAAKSGHPTSCASLAEIMTVLFFQQMRLNLKHPRDPSSDRLVLSKGHAAPILYAVWAEAGLFPVEELRNLRKVDSDLEGHPTPRLSFVDVSTGSLGQGISVAAGMAYVGKHLDKADYRTYVIVGDGEATEGAVWESLHFAGHYCLDNLCVIFDMNKIFCSDIGTEMEVYRERLDAFGFNALVLNGHDIDELAKAFINAASTKGKPTALLARTTKGKDFLGIEGIEEMHAQPLGKRAESAIKHLQMKIANPNVRLTPKKVGKCGHAPEVHINNIMLCSPPNYRLGDSVAPRLAYGTALAKIAADNPRVIALDGDTKNSTYADKMRNAFPERFIECFTAQQNLVGVAVGATCRRRTVAFVSTYATFFTRAFDQIRMGAISHTNVNFAGSHCGCSIGEDGPSQMGLEDIAMFRSIPGSTVFYPTDAVSTERAVELAANTKGVCYIRTTYPSTTVIYNNDEVFAVGLGKVVRQKPSDEVLLIGAGVTLYECLAAAERLEEDCITARVIDPFTVKPLDVGLIVKHGKLCRGRIVVVEDHYQQGGLGEAVLSALADYRNFVVKHLYITTVPRSGPPAVLLDMFGVSSRNIYKASLAIMKK

SEQ ID NO: 14539 - protein, 367 aa, Drosophila melanogaster
MKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 14540 - protein, 427 aa, Drosophila melanogaster
MLATLWIILLSSTFGKCLDNGLAKTPPMGWLSWERFRCNTDCVNDPDNCISEQLFQTMTDIVVADGYASVGYEYINIDDCWLEKHRSHDGKLVADRKRFPNGIKALSDYIHSRGLKFGIYEDYGNYTCAGYPGIIGYEEKDALQFADWNVDYVKLDGCYALPYDMDHGYSTFGRLLNSTGKSMVYSCSWPVYQIYAGIQPNYSAIQTHCNLWRNYDDIQDSWASVENIIDYYGNNQDVIAPNAGPGHWNDPDMLIIGNFGLSYEQAKTQFAIWSILAAPLLMSVDLRTIRPQFKHILQNRKIIAVDQDPLGIQGRRIYKHKGIEIWSRPIGPLYQNFYSYAIAFVNRRTDGTPSDISVTLKELGLINFSGYRVEDLYENVDYGVLYPNTKIKVKVNPSGVVMLKGEVQYPVTCKCNMFVEIAYDNII

SEQ ID NO: 14541 - protein, 87 aa, Cicer arietinum
KRITVITQGADPVCVAQDGKVKLYPVILLPKEKLVDTNGAGDAFVGGFLSQLVQEKPIEECVRAGCYAANVIIQRSGCTYPEKPDFH

SEQ ID NO: 14542 - protein, 579 aa, Brassica napus
MNNNWLGFSLSPYEQNHHRKDVYSSTTTTVVDVAGEYCYDPTAASDESSAIQTSFPSPFGVVVDAFTRDNNSHSRDWDINGCACNNIHNDEQDGPKLENFLGRTTTIYNTNENVGDGSGSGCYGGGDGGGGSLGLSMIKTWLRNQPVDNVDNQENGNAAKGLSLSMNSSTSCDNNNDSNNNVVAQGKTIDDSVEATPKKTIESFGQRTSIYRGVTRHRWTGRYEAHLWDNSCKREGQTRKGRQVYLGGYDKEEKAARAYDLAALKYWGTTTTTNFPMSEYEKEVEEMKHMTRQEYVASLRRKSSGFSRGASIYRGVTRHHQHGRWQARIGRVAGNKDLYLGTFGTQEEAAEAYDIAAIKFRGLTAVTNFDMNRYNVKAILESPSLPIGSAAKRLKEANRPVPSMMMISNNVSESENSASGWQNAAVQHHQGVDLSLLHQHQERYNGYYYNGGNLSSESARACFKQEDDQHHFLSNTQSLMTNIDHQSSVSDDSVTVCGNVVGYGGYQGFAAPVNCDAYAASEFDYNARNHYYFAQQQQTQQSPGGDFPAAMTNNVGSNMYYHGEGGGEVAPTFTVWNDN

SEQ ID NO: 14543 - protein, 579 aa, Brassica napus
MNNNWLGFSLSPYEQNHHRKDVCSSTTTTAVDVAGEYCYDPTAASDESSAIQTSFPSPFGVVLDAFTRDNNSHSRDWDINGSACNNIHNDEQDGPKLENFLGRTTTIYNTNENVGDIDGSGCYGGGDGGGGSLGLSMIKTWLRNQPVDNVDNQENGNGAKGLSLSMNSSTSCDNNNYSSNNLVAQGKTIDDSVEATPKKTIESFGQRTSIYRGVTRHRWTGRYEAHLWDNSCKREGQTRKGRQVYLGGYDKEEKAARAYDLAALKYWGTTTTTNFPMSEYEKEIEEMKHMTRQEYVASLRRKSSGFSRGASIYRGVTRHHQHGRWQARIGRVAGNKDLYLGTFGTQEEAAEAYDIAAIKFRGLTAVTNFDMNRYNVKAILESPSLPIGSAAKRLKEANRPVPSMMMISNNVSESENNASGWQNAAVQHHQGVDLSLLQQHQERYNGYYYNGGNLSSESARACFKQEDDQHHFLSNTQSLMTNIDHQSSVSDDSVTVCGNVVGYGGYQGFAAPVNCDAYAASEFDYNARNHYYFAQQQQTQHSPGGDFPAAMTNNVGSNMYYHGEGGGEVAPTFTVWNDN

SEQ ID NO: 14544 - protein, 459 aa, Arabidopsis thaliana
MLKIKRVPTVVSNYQKDDGAEDPVGCGRNCLGACCLNGTFWKPESSFLIMLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVKTLVQRACPIEYGHVLLIPRVLDCLPQRIDHKSLLLAVHMAAEAANPYFRLDYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 14545 - protein, 246 aa, Oryza sativa (japonica cultivar-group); identical to SEQ ID NO: 4007

SEQ ID NO: 14546 - protein, 680 aa, Oryza sativa (japonica cultivar-group)
MAGNPAAAAPSSSGSSSVFLPPPSPSDGELLRPLHRLARDLSAVDTPAPFLRAAFASISRRSKLLAAAFDDLLLCGAAGELPRSASLCLREVLLVLQRFKAIVADCSARSRMRLLLESDEMEAELRELNHDLATLLDLLPVVELGLADDVLDVLALASRQCRRCSPAPESEEALKASVLSLIQEIEREIVPERERLEEILVEVGINDPASCSEEIESLEQEIGDRASEKWTASMIALVGLLRYAKCVLFSATPRPSDSNSKADVEAEDGEPPVPPSDFRCPISLDLMRDPVVVASGQTYDRESIDRWFSSGKSTCPKTGQVLANLELVSNKALKNLISKWCRENGVAMEACEASKSEQAQAVAANKAALEAARMTASFLVKKLSVSFSPDAANRVVHEIRLLSKSGSENRAFVGEAGAVPLLVPLLYSEDAGLQLNAVTALLNLSILEANKKRIMHADGAVEAVAHIMSSGATWRAKENAAAAVLSLASVHSYRRRLGRNQSVVEKLVHLVRTGPTSTKKDALAALLTLAGERENVGKLVDAGVAEVALSAISKEETAAAVLAALAKRGGAEAIVNIDGAVARLVAEMRRGTDWARENATAALVLLCRRLGAPAVTQVMAVPGVEWAIWELMSIGTERARRKAASLGRICRRWAAASAADGERGGGCPVATVVPPAMMAS

SEQ ID NO: 14547 - protein, 127 aa, Oryza sativa (japonica cultivar-group)
MSGVWVFRNGVVKLVENPPASANSGGGGGGGGGGGGGGIRRKALLHMPTGEVVTSYASLERKLAALGWERYYSGGGGAAAAAAMMLQFHKRSSVDLISLPKDFSQFGSVHMYDIVVKNRDAFRVIDV

SEQ ID NO: 14548 - protein, 374 aa, Oryza sativa (japonica cultivar-group)
MPRETPPPPPPEGGEVHEVVEGEDGQAEDQEERWARLLPELMSEVVRRVEASGGERWPARKDVVSCACVCRRWRDAAVAVVRPPAESGKITFPSSLKQSSYPSIDGGFWPLIRSMVPGPREFPMQCFIKRNKKNSTFYLYLGLTNATVDKGKFLMAARRFRRGPHTEYIVSLDADDLSQGSNAYMGKLRSDFWGTNFKIYDSKPPYDGAKASSSRSSRRFGSRRISPQVSAGNYEVGQVSYKYNLLKSRGPRRMYCALECPSTQETWENCLKTKFRKPTGNTVLRNKAPRWHEHLQCWCLNFHGRVTVASVKNFQLVAAADPNDPASSKDEETVLLQFGKVDDNIFTMDYRQPLSAFQAFAISLSSFGTKLACE

SEQ ID NO: 14549 - protein, 538 aa, Arabidopsis thaliana
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAVGTIISCTIISLGVTQFFKKLDIGTFDMGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 14550 - protein, 480 aa, Aspergillus niger
MPSLGGLLKKRRTKDSQTLSKELEAGSAQTQTSPNAAEDHHNHNHHQHHHHLFHHHHQPQPATNSGSAANTPPQPQDSVPQQSNRSSGAEKSSDGQVASMQSAVTQASPSAHHTSGLPQPNANAASIQNIINPSQQGAMHSASSGHTQSHHAGRSDARTTKGKYSLDDFSLQRTLGTGSFGRVHLVQSKHNHRFYAVKVLKKAQVVKMKQIEHTNDERRMLNRVRHPFLITLWGTWQDSRNLYMVMDFVEGGELFSLVRKSQRFPNPVAKFYAAEVTLALEYLHTQNIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSDDVKNHPWFAEVTWDRLARKDIDAPYVPPIRGGQGDASQYDRYPEETEQYGMAGEDPHGHLFPDF

SEQ ID NO: 14551 - protein, 316 aa, Cricetulus griseus
MSTFVELSTKAKMPIVGLGTWQSPPGQVKEAVKVAIDAGYRHIDCAYAYYNEHEVGEAIQEKIKEKAVRREDLFIVSKLWPTCFERKLLKEAFQKTLTDLKLDYLDLYLIHWPQGLQPGKELFPKDDQGNVLTSKITFLDAWEVMEELVDEGLVKALGVSNFNHFQIERILNKPGLKHKPVTNQVECHPYLTQEKLIEYCHSKGITVTAYSPLGSPNRPWAKPEDPSLLEDPKIKEIAAKHKKTSAQVLIRFHIQRNVVVIPKSVTPARIHENFQVFDFQLSDQEMATILGFNRNWRACLLPETVNMEEYPYDAEY

SEQ ID NO: 14552 - protein, 387 aa, Gallus gallus
EEGLNFPTYDGKDRVIDLNEKNYKHALKKYDMLCLLFHEPVSSDRVSQKQFQMTEMVLELAAQVLEPRSIGFGMVDSKKDAKLAKKLGLVEEGSLYVFKEERLIEFDGELATDVLVEFLLDLLEDPVEIINSKLELQAFDQIDDEIKLIGYFKGEDSEHYKAFEEAAEHFQPYVKFFATFDKGVAKKLGLKMNEVDFYEPFMDEPVHIPDKPYTEEELVEFVKEHKRATLRKLRPEDMFETWEDDMEGIHIVAFAEEDDPDGFEFLEILKQVARDNTDNPDLSIVWIDPDDFPLLITYWEKTFKIDLFRPQIGIVNVTDADSVWMEIRDDDDLPTAEELEDWIEDVLSGKINTEDDDDDDDDDDDDDDDDDDDDDDDDDDDDDDDDD

SEQ ID NO: 14553 - protein, 337 aa, Mus musculus
MNLFLKVLVQRLWKSGEEDPQAARSNSDGEKATKVQDIKNNLKEAIETIVAAMSNLVPPVELANPENQFRVDYILSVMNVPNFDFPPEFYEHAKALWEDEGVPACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 14554 - protein, 396 aa, Solanum tuberosum
MDASAPQMDTMMPDVAAPAVQQPPPPPQPLPGMDNIPATLSHGGRFIQYNIFGNIFEVTAKYKPPIMPIGKGAYGIVCSALNSETNENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLASLHDISDEPICMTPFNFDFEQHALTEEQMKELIYRESIAFNPEYQRM

SEQ ID NO: 14555 - protein, 394 aa, Solanum tuberosum
MDGSAQQTDTVMSDAAAGQQPATPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEGALAHPYLTSLHDISDEPVCMTPFSFDFEQHALTEEQMKELIYREGLAFNPEYQHM

SEQ ID NO: 14556 - protein, 379 aa, Solanum tuberosum
MANQTGGASSTGSRDIRGVLIHGGQYVRYNVYGSLFEVSSKYVPPIRPIGRGAYGLVCAAVNSETREEVAIKKIGNAFDNRIDAKRTLREIKLLRHLDHENIVAIKDLIRPPKKEAFNDVYIVSELMDTDLHQIIRSEQPLTNDHCQYFMYQLLRGLKYVHSANVLHRDLKPSNLFLNANCDLKIGDFGLARTTSETDFMTEYVVTRWYRAPELLLNCSEYTGAIDVWSVGCILGEIMTREPLFPGKDYVQQLRLITELLGSPDDASLQFLRSDNARRYVRQLPQYPKQQFSARFPSMSPLAVDLLEKMLVFDPTRRITVDEALCHPFLSSLHDLNDEPICPSPFSLDFDEPSITEEKIKELIWRESVKFYPDFVDQNI

SEQ ID NO: 14557 - protein, 372 aa, Solanum tuberosum
MDAENIENSVEIKGIPTRDGKYVEYNVVGNFFEVTSKYVPPIQPVGRGAYGIVCCATNSETKEEIAIKKIGSAFENRIDAKRTLREIKLLSHMDHENVIKIKDIVRPPDREEFNDVYIVYELMDTDLHQIIRSSQALTEDHCQYFLYQLLRGLKYVHSANVLHRDLKPSNLLLNANCDLKICDFGLARTTSEADFMTEYVVTRWYRAPELLLNCTEYTSAIDIWSVGCILMELIKREPLFPGRDYAQQLGLIIKLLGSPEESDLGFLRSDNARKYVKQLPQVPKQPFSEHFPDVSPLALDLAEKMLVFDPAKRITVEDALNHPFMISLHEINEEPVCTSPFNFDFEQASLSEEDIKELIWNEALKFDPDTTK

SEQ ID NO: 14558 - protein, 344 aa, Angiopteris lygodiifolia
MKSLEELFKDYGVRYSTLAKMSEMGFTVNTLVNMTEQELEDLVMVILESCQVQLLVGEKYGIKSAVRAEKKRVDEECERLRLDMFSKAARKRKIDEPAALLAPKEGVAKESHRDDSIILTDTVNSILPLNFKEPLLIGQDSVHLGACGLVSQSDPGSDSEGRKFSKKQQKRRPSMETGEDGEDRPREHPFIVTEPGELARGKKNGLDYLFDLYEQCGRLLQEVQRISKERGEKCPTKVTNQVFRHAKHNGCGYINKPKMRHYVHCYALHCLDTEQSNNLRRLYKERGENVGAWRQACYHPLVAMARENDWDIEGLFTRNEKLRIWYVPTKLRQLCHSEKSRDSE

SEQ ID NO: 14559 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 14560 - protein, 612 aa, Homo sapiens
MATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGRCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 14561 - protein, 323 aa, Homo sapiens
MDSKQQCVKLNDGHFMPVLGFGTYAPPEVPRSKALEVTKLAIEAGFRHIDSAHLYNNEEQVGLAIRSKIADGSVMREDIFYTSKLWSTFHRPELVRPALENSLKKAQLDYVDLYLIHSPMSLKPGEELSPTDENGKVIFDIVELCTTWEAMEKCKDAGLAKSIGVSNFNRRQLEIILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 14562 - protein, 320 aa, Homo sapiens
KYQCVKLNDGHFMPVLGFGTYAPAEVPKSKALEATKLAIEAGFRHIDSAHLYNNEEQVGLAIRSKIADGSVKREDIFYTSKLWCNSHRPELDRPALERSLKNLQLDYVDLYLIHFPVSVKPGEEVIPKDENGKILFDTVDLCATWEAVEKCKDAELAKSIGVSNFNRSTLEMILNKPGLQVKPVCNQVECHPYFNQRKLLDFCKSKDIVLVAYSALGSLREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPISDEY

SEQ ID NO: 14563 - protein, 329 aa, Homo sapiens [sequence omitted]

SEQ ID NO: 14564 - protein, 323 aa, Homo sapiens [sequence omitted]

SEQ ID NO: 14565 - protein, 316 aa, Mus musculus
MASHLELNNGTKMPTLGLGTWKSPPGQVTEAVKVAIDLGYRHIDCSQVYQNEKEVGVALQEKLKEQVVKRQDLFIVSKLWCTFHDKSMVKGAFQKTLSDLQLDYLDLYLIHWPTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWAKPEDPSLLEDPRIKAIAAKYNKTTAQVLIRFPIQRNLVVIPKSVTPVRIAENLKVFDFEVSSEDMATLLSYNRNWRVCALMSCAKHKDYPFHAEV

SEQ ID NO: 14566 - protein, 323 aa, Homo sapiens [sequence omitted]

SEQ ID NO: 14567 - protein, 537 aa, Drosophila sp.
MESTTKVKVNGFVESTSSSAAPAIQTKSTTGFDAELQVGLSCKELFQNGEGLPYNDFLILPGYIDFTAEEVDLSSPLTKSLTLRAPLVSSPMDTVTESRCHAMALCGGIGIIHHNCTPEYQALEVHKVKKYKHGFMRDPSVMSPTNTVGDVLEARRKNGFTGYPVTENGKLGGKLLGMVTSRAIDFRENQPESLLADIMTTELVTAPNGINLPTEHAILEKSKKATAIVNQAGELVAMIARADLKKARSYPNASKDSNTRLLCPAAIGTRSEDKGCRALALLVRNGVDVIILDSSQGNSVIQVEMIKYIKETYPELQVIGGNVVTRAQAKNLIDAGVDGLRVGMGSGSICITQEVMACGCPQATAVYQVSTYARQFGVPVIADGGIHAIGHIVKAIALGASAVMMGSLLAGTSEAPGEYFFSDGVRLKKYRGMGSLEAMERGDAKGAAMSRYYHNEMDKMKVAQGVSGSIVDKGSVLRYLPYLECGLQHSCQDIGANSINKLRDMIYNGQLRFMKRTHSAQLEGNVHGLFSYEKRLF

SEQ ID NO: 14568 - protein, 579 aa, Cucurbita cv. Ebisu Nankin
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWCHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 14569 - protein, 346 aa, Rattus norvegicus
MENFQKVEKIGEGTYGVVYKAKNKLTGEVVALKKIRLDTETEGVPSTAIREISLLKELNHPNIVKLLDVIHTENKLYLVFEFLHQDLKKFMDASALTGLPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMHLVCTQHHAKCCGEHRRNGRHSLCPLCSYLEVAASQGGGMTAVSTPYPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 14570 - protein, 346 aa, Mesocricetus auratus
MENFQKVEKIGEGTYGVVYKAKNKLTGEVVALKKIRLDTETEGVPSTAIREISLLKELNHPNIVKLLDVIHTENKLYLVFELLHQDLKKFMDASAVTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMHLVCTQHHAKCCGEHRRNGRHSLCPLCSYLEVAASQGGGMTAVSTPYPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 14571 - protein, 294 aa, Vigna unguiculata
  unsure (1)..(294): unsure at all Xaa locations
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSXMLSLDPSKRITARIAVEHEYFKDIKFVP

SEQ ID NO: 14572 - protein, 294 aa, Drosophila melanogaster
MQKYDKMEKIGEGTYGTVFKGRNRATMEIVALKRVRLDEDDEGVPSSALREICLLKELKHKNIVRLIDVLHSDKKLTLVFEHCDQDLKKYFDSLNGEIDMAVCRSFMLQLLRGLAFCHSHNVLHRDLKPQNLLINKNGELKLADFGLARAFGIPVKCYSAEVVTLWYRPPDVLFGAKLYTTSIDMWSAGCILAELADAGRPLFPGSDVLDQLMKIFRVLGTPNEDSWPGVSHLSDYVALPSFPAITSWSQLVPRLNSKGRDLLQKLLICRPNQRISAEAAMQHPYFTDSSSSGH

SEQ ID NO: 14573 - protein, 571 aa, Chlamydophila psittaci
MLMNTQNGQAMEAAHEEEAQKKLEELVSLAKDQGFITYEEINEILPMSFDTPEQIDQVLIFLTGMDIQVLNQADVERQKERKKEAKELEGLAKRTEGTPDDPVRMYLKEMGTVPLLTREEEVEISKRIEKAQVQIERIILRFRYSSKEAISIAQYLINGKERFDKIISEKEVEDKAHFLKLLPKLISLLKEEDAYLESLLFRLKQNNLSKEETAKLNDDLEKCRIRTQAYLRCFHCRHNVTEDFGEVVFKAYDSFLQLEQQINDLKVRAERNKFAAAKLDAAKRRLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGGESSFGDFLEDTGVESPAEATGYSMLKDKMKEVLKTLTDRERFVLIHRFGLLDGKPKTLEEVGSAFNVTRERIRQIEAKALRKMRHPIRSKQLRAFLDLLEEEKITGKAKNIKGK

SEQ ID NO: 14574 - protein, 466 aa, Mycobacterium smegmatis
MAATKASPATEEPVKRTATKTPAKKAPAKRAAKSAAAKAGGKAPAKKAPAKRAAKGTAAKPEDGVTDDLEVTDDLEAEPGEDLDVEDTDLELDDLDSDDDTAVEDEEEEADAATPAVATAKAADDDIDEPSEKDKASGDFVWDEEESEALRQARKDAELTASADSVRAYLKQIGKVALLNAEEEVELAKRIEAGLYATQKLAELAEKGEKLPVQQRRDMQWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 14575 - protein, 332 aa, Streptomyces coelicolor
MATRAVARRKSAAGETSGSATSVRANGGELADRDLVGMYLDEIARTPLLDAAKEVELSQTIEAGVFARQVLEGYEETGADATREELQALIDESERAKDVFIRSNLRLVVAVARRYPRSGLPLLDLIQEGNAGLVRAVEKFDYRKGFKFSTYATWWIRQAITRSIADQSRTIRLPVHLVEELGRIRRVQREFNREHGREPEPAEIAAELGSTPERVHDVLDWARDPVSLNMSVDDEGETQFGDLLEDTSAVSPEQSVLTLLRSEELDDLIGRLDPRTASIIKMRYGIDDGRERTLTEVGKEHGLTRERIRQIEKHALLELKKLARDTGFEAAA

SEQ ID NO: 14576 - protein, 319 aa, Mycobacterium smegmatis
MANATTSRVDTDLDAQSPAADLVRVYLNGIGKTALLNAADEVELAKRIEAGLYAQHLLDTKKRLGEARKRDLQAVVRDGEAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQNLGREATDEELAEESGIPVEKINDLLEHSRDPVSLDMPVGTDEEAPLGDFIEDSEAMSAENAVISELLHTDIRYVLATLDEREQQVIRLRFGLDDGQPRTLDQIGKLFGLSRERVRQIEREVMAKLRNGERADQPAVYAS

SEQ ID NO: 14577 - protein, 541 aa, Nicotiana tabacum
AITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTDGIAVVTWIALPSTFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSTAHKAAVIGDTVGDPLKDTSGPSLNILIKLMAVESLVFAPFFATHGGLLFKLF

SEQ ID NO: 14578 - protein, 430 aa, Mus musculus
MALRVTRNTKINAENKAKVSMAGAMRVPVTVTAASKPGLRPRTALGDIGNKVSEELQARVPLKREAKTLGTGKGTVKALPKPVEKVPVCEPEVELAEPEPEPELEHVREEKLSPEPILVDNPSPSPMETSGCAPAEEYLCQAFSDVILAVSDVDADDGADPNLCSEYVKDIYAYLRQLEEEQSVRPKYLQGREVTGNMRAILIDWLIQVQMKFRLLQETMYMTVSIIDRFMQNSCVPKKMLQLVGVTAMFIASKYEEMYPPEIGDFAFVTNNTYTKHQIRQMEMKILRVLNFSLGRPLPLHFLRRASKVGEVDVEQHTLAKYLMELSMLDCDMVHFAPSQIAAGAFCLALKILDNGEWTPTLQHYLSYSEDSLLPVMQHLAKNVVMVNCGLTKHMTVKNKYAASKHAKISTLAQLNCTLVQNLSKAVTKA

SEQ ID NO: 14579 - protein, 130 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGSEEAA

SEQ ID NO: 14580 - protein, 156 aa, Nicotiana sylvestris
MAEVEYRCFVGGLAWATTDQTLGEAFSQFGEILDSKIINDRETGRSRGFGFVTFKDEKAMRDAIEGMNGQDLDGRNITVNEAQSRGSGGGGGGGGYRGGSGGGYGGGGRREGGYGGGGGYGGGRREGGYGGGGGGGYGGGRREGGYGGGSEGNWRS

SEQ ID NO: 14581 - protein, 165 aa, Nicotiana sylvestris
MAEVEYSCFVGGLAWATTDRTLGEAFSTYGEVLESKIINDRETGRSRGFGFVTFGDEKSMRDAIEGMNGQDLDGRNITVNEAQSRGSGGGGGGGGFRGGRREGGGGYGGGGYGGGRREGGGGGYGGGGYGGGRDRGYGGGDRGYGGDGGSRYSRGGGDSDGNWRN

SEQ ID NO: 14582 - protein, 148 aa, Nicotiana sylvestris
MAEVEYSCFVGGLAWATTDRTLADAFGTYGEVLDSKIINDRETGRSRGFGFVTFKDEKCMRDAIEGMNGQELDGRSITVNEAQARGSGGGGGGYGGGRREGGGGGYGGGGGGYGGGRREGGGGGYGGGRREGGGGGYGGGGYGGGGRY

SEQ ID NO: 14583 - protein, 343 aa, Methanocaldococcus jannaschii
MKGIEMETKVKAHVAPWKIEEVKTLKGLIKSKPVVAIVDMMDVPAPQLQEIRDKIRDKVKLRMSRNTLIIRALKEAAEELNNPKLAELANYVERGAAILVTDMNPFKLYKLLEENKSPAPVRGGQIAPCDIKVEKGSTGMPPGPFLGELKSVGIPAAIEKGKIAIKEDKVVVKKGEVVSPKLAAVLDRLGIKPIKVGLNILAVYEDGIIYTPDVLKVDEEKLLADIQAAYQNAFNLAFNTAYPAKEVLPFLIQKAFINARALSVETAFVTKETAGDILAKAQAQALALASKLPDEALDEDIKAKLSSVEVSAAPAAEEEKEEEKKEEEKKEEDTGAAGLALLF

SEQ ID NO: 14584 - protein, 164 aa, Arabidopsis thaliana
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSFEYVPSYEDKDGDWMLVGDVPWPMFVESCKRLRIMKGSEAIGLAPRAMEKFKNRS

SEQ ID NO: 14585 - protein, 370 aa, Ceratopteris richardii
MDVSLLPPTTTIAGTADPKQLKLLEDLFKDYGVRSTTIIKVMEMGFTVNTLVNMMEQEIDDLIKTMTESYHMELLVGEKYGLKSAIRAEKKRQEEDMERQRLQLLATSSKKHKSDESGMVVTSLEGTREQRGDNVMMFPEAVAPNAPLNLNSKDHVQQEHSHAQIGPPGLLALPEPSSDNEGHKLPRKKPKRRLLREPGEDGDDRTREHPFIVTEPGEVARGKKNGLDYLFDLYEQCARFLDEVQQMARERGEKCPTKVTNQVFRHAKLKGASYINKPKMRHYVHCYALHCLDKEKSNFLRKQFKERGENVGAWRQACYYPLVDMARDNGWDIEGVFARNEKLRIWYVPTRLRQLCHLEKSKDSDSCIYD

SEQ ID NO: 14586 - protein, 394 aa, Ceratopteris richardii
MFRWEQRVIHRKEVPSMEASILPPTTTTTTAATSVTTVGTYPKQLKLLEDLFKDYGVRSTTIVKVMEMGFTVSTLVNMMEQEIDDVIKTMIEGYHMELLVGEKYGLKSAVRAERKRQEEEMERQRLQLLVKNSKKLKSDDSGMIAVSVEGTREQRGDNGMMFPDTAAQNGPLNLNSKDHAQHEHSHGLFGPPGLLALPEPSSDNEGRQIPRKKQKRRLSREPGEDGDDRTREHPFIVTEPGEVARGKKNGLDYLFDLYEQCARFLDEVQQMARERGEKCPTKVTNQVFRHAKLKGASYINKPKMRHYVHCYALHCLDKDKSNFLRKQFKERGENVGAWRQACYFPLVDMARDNGWDIEGVFVRNEKLRIWYVPTKLRQLCHFEKSKDSDSCSYE

SEQ ID NO: 14587 - protein, 207 aa, Branchiostoma belcheri tsingtaunese
MGFVKVVKNKAYFKRFQVKFRRRREGVTDYYARKRLVIQEKNKYNTPKYRLIVRFTNKDIICQVAYARIEGDVIVCAAYAHELPRYGIKVGLTNYAAAYCTGLLLARRILKKFSLDTIYEGCTEIDGDEYNVEEVDGQPRPFRCFLDVGLVRTSTGARVFGAMKELSTAVLTSRIARSASQDTMPSPRISTPRFTEATSSGSTWQST

SEQ ID NO: 14588 - protein, 489 aa, Sphingomonas paucimobilis
AHFPDTSGMTGVLRPLRIEGDILDLEVEGEIPAQLDGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLKNQTFSAHAKIDPVTGNFCNFGYAATGLLTTDCSYFEIDPAGNLLFETEFQVPYYCMMHDYGLTEHYAIFHIVPCSPNWDRLKAGLPHFGFDTTLPVWLGVVPRGPGVTNKDVRWFKAPKTIFASHVMNAFEEGSKIHFDTPQAENNAFPFFPDIHGAPFDPVAARPYLHRWTVDLGSNSEDFAEVRQLTSWIDEFPRVDARYVGQPYRHGWGLVMDPEMEMEFARGRASGFKMNRIGHWDHATGKEDSWWCGPQSIIQEPCFVPRMADSAEGDGYIIALVDNLITNYSDLVVLDALNLKDGPIGRAKLPIRLRSGLHGNWADASKLPIAA

SEQ ID NO: 14589 - protein, 390 aa, Bordetella pertussis
MLSNVPSRQSPDFAQRTPARVALLGPARSIHTIRWANGLALRGLQVHLLSLETPDLSLYDERIVQYRLPWRAPLGYFLAAPRLRALLKRIDPDLLNVHYATGYGLLARRARFSPVLLSAWGSDIYEFPNSSTWHKALLQRNLDHATALAATSHAMQREMRGLTRRPIFVTPFGIDEALFQPAQSVQAPAADGPIVIGTVKALETHYGIDTLIQAFALLRQALAASQPGMAERLVLRIYGAGSQLQRLRAQAQAAHIANQVEFKGRIPHAEVPEALRALDVYVALSRMDSFGVAILEACSCALPVVVSNADGPAEVVVDGKTGYIVAREDAHAAADRLQELVLNPELRQRLGAAGRARVLSEYTWSKSLDMMLDAYTETARLYRATQPASV

SEQ ID NO: 14590 - protein, 723 aa, Phaseolus vulgaris
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPSNPYPRKTTIGTATLHSGAKDGNLVESSHNNQALDLEKEPLPEKYDLDEGLTTVKENKDENCSKVFKVIQEVPCSSISSANRSSISMSVPLGNSCVLKEITSSVKEVITRDENTESFLTVELGNRNLEINDGKQANGTSKNSTLENSDALQTKLVQNEKTDGLDSALTIDGMQGNQNYPRHVTVHVVDGKLGTSTQNPSQDMLFRDSMFQPIGGDNGQPNLFTNSAPTNTSESQNNTARSSVHQSFLPYPPFTQHNQDDYQSFLHMSSTFSNLVVSTLLQNPAAHVAASFAATFWPYANPETSADSPRCSQGGFTSRQIGSPPSVAAIAAATVAAATAWWAAHGLLPLCLPLHAAFACPPASVTAVPSMNPPVQDQKHPEYSEAPQAQHSDSKSLAVISSDSETGNAKLNTSPKATDHVTNETISEHLDSDKTKGRKQVDRSSCGSNTASSSDVETDALGKDEKGKEEPETPDANNLAIEFSNRRRSIYNLTDSWKEVSSEGRLAFQALFSREVLPQSFSPPHALKNKDQMDITNDYKQNIADRNEDLDSKKCSSNALHKIPSFVENNVGLLTIGLGQGKLKTRRTGFKPYKRCSVEARENRVGANCEEKGCKRIRLEGDTST

SEQ ID NO: 14591 - protein, 452 aa, Toxoplasma gondii
ARGKTGDVRTPVSSEGTPLRAEDLKSEEQDDREERKERRGSCMSRTSISSDEKGHKRIHLVMELCTGKELYDRLARKKRYSEKDAGRVTRQMLSAINYCHQRHICHRDLKLENWVFRDDSDDAPLKLIDFGFSRIFHPGVRMTAMHGTVYYVAPEVMDGKYNEKCDLWSIGVIVYMLLSGSPPFTGHGDQEILIKIRRCKYNMDGPRWRGISEQAKHFIASLLRRNPEERPSAEEALKHPWLVAAEKEALADTEIDVSVLKSMQRFAACSAIKRASLALIAMSMNAQQLDDLERLFRKIDIDNSGCIKMDRMVAVLVTFLDVPRDEALRIFQRIDQTRAEEINYSEFLAATLQTRIALNQQLIREAFERFDVDNSGHISLENLRYVLGDSYDSLSVEEILRQCDRKQNGVIEFDEFMLALTGDESGVLEEWELDGPCCSRRRANSSSESQHE

SEQ ID NO: 14592 - protein, 435 aa, Streptomyces coelicolor A3(2)
MTGRFEFMHQSSHPDRPTTPADDWSGANAAHLAAPARIAAAPASVTDEDVALVRASLTVVTPHVSELAAHFYSILFSRYPQVRDLFPAELDVQRERLVRALLRIVELVDDPDNLVAFCSRLGRGHRKFGTQSGHYPAVGECLLQALSHFAGPAWHPALATAWQRAYTAAADVMVRAAEEDARSRPAVWDAHIVGHVHRGHGIAEITVRPHQPYPFVAGQYVSIETPWAPRQWRQYSPANAPRPNSELTFHVRAVREGKVSNALVHHARPGDPVRLGPPEGDMVLRPTRQRDLLFVAGGTGLAPIRALIEEVAQGSISDAREVSLFIGARTANELYGLDDMLRMSQRYHWLRVRAAVSDERIPGLEGTLPEVLAEFGPWYRHEAYLCGPPQMLSGAVHALRRHGVPPRHIHYDPWDTPVLTAPLGPPPPDEEDDQL

SEQ ID NO: 14593 - protein, 898 aa, Streptomyces coelicolor A3(2)
MARYVYDFTEGGRDMAGLLGGKGSNLAEMTRLGLPVPPGFTLTTEACRSVLDTGGEPPGLWEEVAGHLTDLETGSGRLLGQPDNPLLLSVRSGARFSMPGMMETILDIGLDDDSVHGLAKVSGNERFAWDSYRRLVQMFGTTVMGVDPSLFERALAQLKEVRGVPDDVHLDAEDLARLVETYKNVIHQETGERFPQSPVEQLRRAVLAVFASWNGERARLYRRREHIADDLGTAVNVQRMVFGNLGSDSGSGVAFTRDPATGARGLYGDYLPNAQGEDVVAGIRNTVPLTELKRLDPGAYGRLRAHMETLERHYRDLCDIEFTIERGTLWMLQTRVGKRTAEAAFVLGADLADEGLITADEGLARVSGEGLARLMFPRFDTAVTGDVLARGVPASPGAAVGAAVFDSAEAVRRAADGERVVLVRQETTPDDLPGMIAAQAVLTSRGGKTSHAAVVARGMGKVCVCGADELTVDTGARRCTAPDGTIVEEGTVLSVDGTAGTVYAGAVPLVDSAVMRYLEAGAGGRATTGVVDAVARALARADAVRRLEVRANADTPQDAVRARRFGAQGIGLCRTEHMFLGERRKLVEEMILAGTDAGRERALAALLPLQREDFTGILEAMDGLPVTIRLLDPPLHEFLPDRADLAVRIATAEARGEEPDAHDAELLAAVGRMHEENPMLGLRGVRLGLVVPGLVAMQVRALGEAVAQRLTAGGAPRAEIMVPLVGDVRELRLVREEVERVLAEVSDTSGVPVTCPVGTMIELPRAALTAGRIAEDAEFFSFGTNDLTQTTWGFSRDDVEAEFFSAYLDRGVFPVSPFETLDRDGVGRLVGIAVEEGRATRPDLTIGVCGEHGGDPDSVHFFHSAGLDYVSCSPFRVPVARLEAGRAALDLADAGDSR

SEQ ID NO: 14594 - protein, 680 aa, Streptomyces coelicolor A3(2)
MRHLPMRVPRVIGRRALGALTTALLTTGGLAVSAQAVPAAAPDPAPASSGHEQLALTPPMGFNNWNSTHCRDEFNESMVKGIADLFVERGLKDAGYEYVNLDDCWALPERDADGRLVPDPKRFPNGIEAVADYVHSKGLKFGIYTSAGTKTCSSIGFPGALGHEYSDARQFADWGVDYLKYDNCNNQGVDAKQRYTTMRDALAATGRPIVYSICEWGENKPWEWAGDLGQLWRTTGDINDSWGSMSSIMKSNLELAEYARPGGWNDPDMLEVGNGGMTDTEYRTHFSMWSIMAAPLLIGTDLRTAPESAFEILTNDEVIAVDQDPLGKQGEVVSSEGGRWVVSKELADGSRAVALFNEGSRAQRIETTAKAVGLPKSRGYTMRDLWKHSDTNTTGRIAATVPAHGTVLVRVHADRKWAQYPPAVDVHAGGDTVTEAGRTVRITSEATDLGGTAAHSVSVALTGPDGWRVTPRSATSARALKPGATLATDWDVVVPAGTSTGDRILTLTARHRTHSGSWLTSTAPFTVRVGVPLPAGESALSDADPLSATNGWGPVERDQSVGERGAGDGNPITIGGTTFAKGLGVHASSSVEYYLGGTCGKVTAQVGVDDESGDKGTVAFEVWADETRAASTGTLTNADPARAVSADVSGADIVRLVVTDAGDGSGYDHADWADLRVTCT

SEQ ID NO: 14595 - protein, 503 aa, Streptomyces coelicolor A3(2)
MGSHSRRRILRGAAVAAAGSVVGSGLGPGFFSAAAQATPAAPKGGSAPATPFLEGAFAPVTEELTAFDLDVVGRIPADLDGRYLRNGPNALGIEDVRAHHWMIGDGMVHGVRLRGGRAEWYRNRWVRSSQVTAKLGETYPGQAPPDDFPCNTHVIPYHGRILALQEGGPLPYELDGELNTLRPYDFRATQKGAFAAHTKYDAVADELHAIAYYPTWDHVRHIVVDRTGRARPATRIPVADAPMMHDFALTEKYVVIVDVPITFDGAAAEAGAIVPYVWNDRHPMRLGLLPRTGGTTRWFEIDPVYYSHTLNAYDQGDTVVLEYIGFPAPFYAAGRGVGGPSATGSPTLDRWTVDLGAARVRSTRLDDRPQEFPRINESLVSRRHRYAYTACAAEMWRAYETVDGVCPDEKFTNYLVKHDMLRGSRQLHRFPRGAAVGEPVFVPRRGARDEDDGYVLSYVNDPDRGATDLVILSAQNFGGRPRARVRLPGRVPLGFHGSWVPDA

SEQ ID NO: 14596 - protein, 263 aa, Streptomyces coelicolor A3(2)
MPHTPTPPSPELAGLAAVVTGGASGIGLATARLLARRGARVAVLDLAPDAVPATDLEALLPVGCDVTDDASVRAGLDRAVDLLGGLDILVNNAGVGAQGTVADNDDAEWHRVLDVNVLGIVRTTRAALPHLRASRHAAVVNTCSVAATAGLPRRALYSASKGAVQSLTLAMAADHIREGIRVNCVNPGTADTPWIDRLLSSADDPAAERTALNARQPTGRLVSAEEVAAAIGYLASPAAASVTGTALAVDGGMQGLRLRPDGG

SEQ ID NO: 14597 - protein, 248 aa, Streptomyces coelicolor A3(2)
MKQPRAALVTGAGGALGRATAVRLAADGHDVAVLDRDAESLEHTAALVEKAGARVLALGTDLRDAPAVAAAVERTVTDLGPLRVLVNNAAVYPSRAFLDVPLAEYEEVVAVNQRAYWVAAQAAARHMTGTGGGAIVNVASITLHGGWDSLAAYVSTKGAAVALTRALARELGPAEIRVNCVSPGAFPTAAEEIHEDPDAYRRHVLDHQALKRRGRPEELASVVSFLTGPDASFVTGQCVEVNGGWVMA

SEQ ID NO: 14598 - protein, 325 aa, Streptomyces coelicolor A3(2)
MSNTETHPAEVRCGAGEEGAPAAGVEILTARDVPLGGPRAMTVRRTLPQRARTLIGAWCFADHYGPDEVSRSGGMDVAPHPHIGLQTVSWLFSGEIEHRDSVGSHALVRPGEVNLMTGGHGISHSEVSTPDTTVLHGVQLWVALPSEHRDTAPAFQHHVPAPVALDGGEARVFLGSLAGDTSPVGTFTPLLGAEVTLAPGATVTLDVDPGFEHGVLVDSGDVRLDGTVVRPAELAYAAPGRRTLALTNAASGAARLVVLGGPPFPEEIVMWWNFVGRTHDEIAAARADWENEAERFGRVEGYPGDRLPAPALPNATLSPRRNPRP

SEQ ID NO: 14599 - protein, 252 aa, Streptomyces coelicolor A3(2)
MRLADRTALVTGATSNIGRAIAEAFAAEGAHVVVSGRSAERGREVVDGIRAAGGRADFVHADLDGSAAASRALAREATRVLGGRVDVLVNNAGIYPPGTTTDTDEETFDRVYAVNVKAPFFLTAVLAPAMVRAGGGTVINLGSWIARLGVPVGALYSSTKGAVETLTRAWAAEFGARGVRVNAISPGVVQTPPPGEVHPAEVMMRGTPAGRMGTPEAIASAAVYLAGDESSFVHGTVLDVDGGRTAAAVIAA

SEQ ID NO: 14600 - protein, 264 aa, Streptomyces coelicolor A3(2)
MNLDLGGRTALVTGSSQGIGAAIAAGLARAGATVGVNGRDAGRLAESVEKLRAEVPDGTFVPVAADLGTEEGAERALEALPDVDILVNNLGVFGAAPALEISDAEWRRYFEINVLAGVRLTRAHLPRMRDRGWGRVLYIASDSAVVIPSEMIHYGVSKTALLGVGRGFAKEAAGSGVTVNCVIAGPTHTEGVEDFVYQLVDRDLPWDEAQRVFMREHRPQSLLQRLIEPEEIANLVVYLSSPLASATTGAAVRVDGGYVDSILP

SEQ ID NO: 14601 - protein, 266 aa, Streptomyces coelicolor A3(2)
MTDTRRFTDYAALVTGAARGIGAATARRLATEGARVLLTDVDLVGARRTAAELADDGLDATAFACDVSDRESVETAVAHAVETFGGLDVLVNNAFACTPDAPLFEDEPDDVWARDLDVTLTGAQRCCRAALPHLAASGRGAIVSIGSVNGVQDFGNHAYSAAKAGLASLTRTLAGHAGPRGVRVNLVTPGTVRTTAWEGRDEELAAVRGLYPLGRVGEPEDVAAAVAFLASRDAAWITGTTLAVDGGLTAVNTGFRQAIARAEGSD

SEQ ID NO: 14602 - protein, 362 aa, Streptomyces coelicolor A3(2)
MAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEAVGRPETYRQAFYARDLAGTVVLVGVPTPEMKLELPLLDVFGRGGSLKSSWYGDCLPSRDFPMLVDLHLQGRLDLGKFVTETIRLDEVEQAFDRMHAGDVLRSVVVL

SEQ ID NO: 14603 - protein, 321 aa, Streptomyces coelicolor A3(2)
MSNLDREAVPSPCGGRGFVVTEPVRELLSPRNVKLGESTEVRRLLPNLGRRMVGAWCFVDHYGPDDIADEPGMQVPPHPHMGLQTVSWLHEGEVLHRDSTGSLQTIRPRQLGLMTSGRAISHSEESPRPHARLLHGAQLWVALPDAHRHTDPHFEFHAELPRVTAPGLAATVLLGTLDTATSPGTTYTPLVGADLALTGSTDVRLPLERDFEYAVLAMSGEAHVDGVPLVPGSMLYLGCGRDELPLRADSDAGLMLLGGEPFEEELIMFWNWIGRSQEEIVQARRDWMEGSRFGEVKGYDGAPLPAPALPAVPLKPRGRTR

SEQ ID NO: 14604 - protein, 339 aa, Streptomyces coelicolor A3(2)
MAPTARTPTARTRDDRRATTRTARLRTRIPEPDEEPDLLGQYLTQIGATPLLTAEDEVRLATRIEAGVRAREELETADTGEPAPTPRRRRTLEETVHDGQEAKDHMVRANLRLVVSMAKRHAHRGLPLLDVIQEGNLGLIRAVEKFDHTKGFKFSTYATWWIRQAIERGLATHARTVRLPVHVVEQLQKLAKVERKLRAGLDREPTTEEVAAESGIDVDKVVWLRRVGRDAVSLDTPVDETGDTVVGDLIPDTEVLRAPEVAEFQALAAELREAVGTLAPRESLILSLRYGLHDGRPRTLQQVAQHVGLTRERVRQLEKESLAHLRAPENRERLLDWAS

SEQ ID NO: 14605 - protein, 203 aa, Streptomyces coelicolor A3(2)
MHGPEPTRSAAAGRVLALVTLTFTLVGIPVGAARADACAYASTGPDGTDAVAVAGSASWPTFPPCPKPTPTPTPPPDPEPTPPPPEPTPPPAPKPPPPKPPAPEPEPPPPPAPRPAPPRPAPEPSPTPTPAPTPPPVRPAAPAPAPSVTPTPTPRPSLSPVHYPRHRAARAPQRSSRGTTSPLVFVLLITVPAVVAVAALRAR

SEQ ID NO: 14606 - protein, 387 aa, Streptomyces coelicolor A3(2)
MRVGLLSREFPPDVYGGAGVHVEFLARELARLVDLDVHSWGEGRTDGVLRHRPWSALDGANDALRTFSVDLAMTAALEGRELVHSHTWYANLGGHLAKLLHGVPHVVTAHSLEPLRPWKAEQLGGGYELSGWAERTAFEAADAVIAVSGAMREDILGCYPDLDASRVHVVHNGIDTRLYRPDHGTDVLDRVGLDRSRPYVLFVGRITRQKGVPQLLRAVRDIDPAAQVVLCAGAPDTPEIDQEFRDLFAGLSRAREGVHWIPRMLPRTEVIQLLTHAAVFVCPSVYEPLGIVNLEAMACGTPVVASRVGGIPEVVTDGVTGVLVPREDGADDAFEAGLARALDSVLGDPAGARRMGEAGRARAVEEFGWDAVARRTVRLYEEILKQA

SEQ ID NO: 14607 - protein, 266 aa, Streptomyces coelicolor A3(2)
MTSPSVLQAPHASSLDLHGRTALVTGAAGGIGRACALRLAAAGAEVRAVDRDAAGLEALAGSCGDLAGSVEPQVLDLTDLDAAERAAAGTDVLVNNAGLQLVRPLEEFPPDVFHTVLTVMLEAPFRLIRGALPHMYGQGWGRIVNISSVHGLRASAYKAAYVSAKHGLEGLSKTAALEGAAHGVTSNCVNPAYVRTPLVERQIADQARAHGLPEEQVLSDVLLRDSALRRLIEPDEVAEAVAYLCGPYTVGLTGTSLVLDGGWTAH

SEQ ID NO: 14608 - protein, 238 aa, Streptomyces coelicolor A3(2)
MSTMGPLGGISVIFDLDGTLVDSEPHYYEAGRRTLAEYGVPDFSWADHEAYVGISTQETVADWKRRYGLRATVEELLAVKNRHYLGLARTSARAYPEMRKFVELLAGEGVPMAVASGSSPEAIAAILARTGLDAHLRTVVSADEVARGKPAPDVFLEAARRLGTEPARCVVLEDAAPGAAAAHAAGMRCIAIPYVSGQADAPEFATAELLVRGGQEEFTARAAHDWLRTDGNATRETI

SEQ ID NO: 14609 - protein, 253 aa, Streptomyces coelicolor A3(2)
MTELPEPSGKVALVTGASRGIGYGVAEALVARGDRVCITGRNEDALKEAVDRLGPDRVIGVAGKAHDEAHQAVAVERVMEAFGRVDFLVNNAGTNPVFGPIADLDLNVARKVFETNVISALGFAQRTWHAWQKDNGGAIVNIASVAGLSPSPFIAAYGVSKAALINLTAQLAHEFAPRVRVNAIAPAVVKTKFAAALYEGREEEAAAGYPLGRLGVPSDIGGAAEFLTSEQSAWVTGQTLVVDGGIFLNAGVA

SEQ ID NO: 14610 - protein, 556 aa, Streptomyces coelicolor A3(2)
METTLRGVGVSHGVAIGEVRHMGTAVLEPPAKQIPAEDAEREQGRARKAVEAVAADLMARGNLAGGEAQAVLEAQAMMAQDPELLADVERRITVGSTAERAVYDAFAAYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIPEGTVVAVDGSTGEIFVNPAEEKKARLAAEAAERKAALAAATGPGATSDGHKVPLLANIGGPADVPAAVEAGAEGVGLFRTEFLFLDDSANAPSEEKQITAYRQVLEAFPEGRVVVRVLDAGADKPLDFLTPGDEPNPALGVRGLRTLLDHPDVLRTQLTALAKAAEGLPVYLEVMAPMVADRADAKAFADACREAGLRAKFGAMVEIPSAALRARSVLQEVEFLSLGTNDLAQYTFAADRQVGAVSRLQDPWQPALLDLVALSAEAAKAEGKSCGVCGEAAADPLLACVLTGLGVTSLSMGAASLPYVRATLAKFTLAQCERAAAAARAADSAEEARTAAQAVLSGE

SEQ ID NO: 14611 - protein, 483 aa, Streptomyces coelicolor A3(2)
MQHVRFLNDIQPSYDLTYDDVFMVPSRSAVGSRQGVDLGSPDGTGTTIPLVVANMTAIAGRRMAETVARRGGLVVIPQDIPIEVVTDVVSWVKSRHHVLDTPIVLAPHQTVADALALLPKRAHNAGVVVDEDGKPVGVVTDTDLNGVDRFTQLEEVMSKDLILIDADLDPREAFNTLDAANRRYAPAVDKDGRLAGILTRKGALRATLYTPAVDAQGRLRIAAAVGINGDVAGKAKQLLDAGVDTLVIDTAHGHQESMISAVKVVRDLDPRVPIVAGNIVSAQGVRDLIEAGADIIKVGVGPGAMCTTRMMTGVGRPQFSAVLECAAEAKKYGKHVWADGGVRHPRDVAMALAAGASNVMVGSWFAGTYESPGDLQHDANGRAYKESFGMASARAVRNRTSEESAYDRARKALFEEGISTSRMFLDPARPGVEDLIDAIIAGVRSSCTYAGAGSLEEFTEKAIVGIQSAAGYAEGKPLHASWS

SEQ ID NO: 14612 - protein, 260 aa, Streptomyces coelicolor A3(2)
MSEDIVCRRLVGRTAVVTGAGSGIGLAATRRLASEGAHVVCGDVDETRGRAAAEETGGIFVQADVTDPEQVEALFAAAYDTYGSVDVAFNNAGISPPDDDSILETGLEAWQRVQEVNLTSVYLCCKAAIPYMRRQGRGSIINTASFVARMGAATSQISYTASKGGVLAMSRELGVQFAREGIRVNALCPGPVDTPLLRELFAKDPERAARRLVHIPVGRFAEAEEIAAAVAFLASDDSSFVNATDFLVDGGISGAYVTPL

SEQ ID NO: 14613 - protein, 233 aa, Streptomyces coelicolor A3(2)
MTSTVPALGTRTAEGSALQAVLLDMDGTLVDTEGFWWDVELEVFASLGHTLDDSWRHVVVGGPMTRSAGFLIEATGADITLAELSVLLNDGFEQRIGRDLPLMPGAARLLAELSAHEIPTALVSASHRRIIDRVLTSLGPRHFALTVAGDEVPRTKPHPDPYLAAAAGLGVDPARCAVVEDTATGVAAAEAAGCHVVAVPSVAPITPAARRTVVASLEEVDLTFLRGLMTQMR

SEQ ID NO: 14614 - protein, 253 aa, Streptomyces coelicolor A3(2)
MTAHPLFDIGGRTALVTGSSRGIGLALARGLAEAGCRVILNGRDGDRLAKAAAGLPGEVHTAVFDVTDGPSVTAGIAEAEERVGPLDILVNNAGMQLRAPLLEFADADWHRILDTNLTTAFLVGREAARRMTERGHGKIVNICSLQSEVVRPGIAPYAATKGALKMLTKGMCADWGPYGVQVNGLGPGYIETELTRPLVEDEEFSTWVRGRTPAGRWGRTEDLVGGLLFLASPAADFVGGQILYVDGGMTSVL

SEQ ID NO: 14615 - protein, 324 aa, Streptomyces coelicolor A3(2)
MMTTARTSPPAPWHRRPDLLAAGAATVTVVLWASAFVSIRSAGEAYSPGALALGRLLSGVLTLGAIWLLRREGLPPRAAWRGIAISGLLWFGFYMVVLNWGEQQVDAGTAALVVNVGPILIALLGARLLGDALPPRLLTGMAVSFAGAVTVGLSMSGEGGSSLFGVVLCLLAAVAYAGGVVAQKPALAHASALQVTTFGCLVGAVLCLPFAGQLVHEAAGAPVSATLNMVYLGVFPTALAFTTWAYALARTTAGRMGATTYAVPALVVLMSWLALGEVPGLLTLAGGALCLAGVAVSRSRRRPAAVPDRAAPTAEPRREDAGRA

SEQ ID NO: 14616 - protein, 365 aa, Streptomyces coelicolor A3(2)
MAVRTAVRAAVVPAPGAPLEVTGIELPEPGPGRVRVRLAAAGVCHSDLSLSNGTMRVPLPAVLGHEGAGTVVAVGEGVTHVAPGDEVVLNWAPSCGACHACSLGEVWLCAHALAGAADVHARRADDGTDLHPGLNVAAFAEETVVAASCVLPAPEGIPLTEAALLGCAVLTGYGAVHHSARVREGETVAVFGVGGVGLATLQAARIAGASKIVAVDVSPEKEELARAAGATDYLLASDTTAREIRALTGKQGVDVAVECVGRAVTIRTAWESTRRGGRTTVVGIGGKDQQVTFNALEIFHWGRTLSGCVYGNADPARDLPVLAEHVRAGRLDLGALVTERIALDGIPAAFDNMLAGKGGRALVVF

SEQ ID NO: 14617 - protein, 234 aa, Streptomyces coelicolor A3(2)
MSRSVLVTGGNRGIGLAIARAFADAGDKVAITYRSGEPPEGFLAVKCDITDTEQVEQAYKEIEETHGPVEVLIANAGVTKDQLLMRMSEEDFTSVVETNLTGTFRVVKRANRAMLRAKKGRVVLISSVVGLLGSAGQANYAASKAGLVGFARSLARELGSRNITFNVVAPGFVDTDMTKVLTDEQRANIVSQVPLGRYARPEEIAATVRFLASDDASYITGAVIPVDGGLGMGH

SEQ ID NO: 14618 - protein, 311 aa, Streptomyces coelicolor A3(2)
MSLAPGGALLVVGDVVTDIVARHRGPLAPGTDTAAAVRRLPGGAGANVACWAAHEGCGDVRLLGRVGTDASAWHERELTACGVRPLLVVDSAAPTGTVICLVDTADSAERTFLTDSGAALRIGPGDWSDTLLDGVGRLHLSGYLLFSEPGRALVSVALAAARARGVPVSLDPASAGFLTELGVDRFLGLVEGVDVLLPSRDEACLLTGLPDVADAAAKLSRHVPLVIVKQGAKGALVARSGTVGARVAAVTAAPRDSTGAGDAFTGAFLAALLAGAEAEEATAAGCRAGARAVERVGGRPPRAAGRGPGDG

SEQ ID NO: 14619 - protein, 528 aa, Streptomyces coelicolor A3(2)
MDQLALLFMLLLGALLSVPIGARLGLPAPVLMTLLGIVLALLDFVPNVDIPPELILPGLLPPLLYAAVRRTSWRQFAANKRPIFLLAVALVFVTMVCVASVAHAIVPGLPIAAAFALGALVAPPDPVAATAVAGQLGLPRRLVSILEGEGLFNDVTAIVLYHVAIAAAVGGSFSPWRAGFDLVLSAVVAVAIGLVLGWGSNKLMSVLGDPTLQIGLTLLVPFVSYVAADELHGSGVLAVLTTAMFLAEYASDADDVMTRLGGHTVWDVVDTLVTGVAFGLIGLELHNAVRTASGRWTELLGWAAAILVVVVLVRLLWLLPATWLTQRLHARRDQDEDIPTSWRETVVMWWAGMRGVASVALALAIPLETDDGAAFPHREEIVFIAFGVIMGTLLLQGLTLPWLVGRLGVRADTEREQEFERDLALRAAKAAKQRLKEIESVEELPEELSEQMLRRAFDIGIRISPDLGDEERREAQEQRARRIKRVRRIQGEMLSAARHEVLAARSEPGADPEIVDRVLRHLDVRSLR

SEQ ID NO: 14620 - protein, 396 aa, Streptomyces coelicolor A3(2)
MRGGQRRASRLRPPTYRRRPPPAASILEVAPVQTQTLTQTDTAAGGAEPDAERGVLLAMPAQPGAGAALPHPGAPVDVPEHPEPPPPTRTESGGPSSDLFRQYLREIGRIPLLSAAEEVDLARRVEAGLFAEEKLRCSPGLDDRLALDLDRLVVLGRLAKRRLIEANLRLVVSVAKRYVGRGLTMLDLVQEGNLGLIRAVEKFDYARGYKFSTYATWWIRQAMSRALADQARTIRVPVHVVELINRVVRVQRRMLQERGCEPTPQEVAAHLDLAPERVGEVLRLAQEPVSLHAPVGEEDDVALGDLIEDGDAASPVESAAFLLLRQHLEAVLSTLGERERKVVQLRYGLADGRPRTLEEIGRLFGVTRERIRQIESKTLSKLRDHAYADQLRGYLD

SEQ ID NO: 14621 - protein, 247 aa, Streptomyces coelicolor A3(2)
MGMYSNRNAVIAGGGSGMGFAMAELLVAGGARVVITGRSQATLDAARERLGENAVAVRGDVASLPDLDALTDRVKAELGTLDALFVNAGIATLTPLESTTEEAYDELFDINVKGAWFTVQKLAPLLNTGAGVVLTTSVANVIGMTDTSVYAAGKAALRSMARSFSRELLPRGIRVNAVSPGPVDTGALDAAMTAEEAERFKAERVADNPMRRFGTPGEIARAAAFLAFDATYTTGAELAVDGGATQL

SEQ ID NO: 14622 - protein, 255 aa, Streptomyces coelicolor A3(2)
MTTQRFTGKTALVTGAGSGIGRAVALALAAEGAHVVVAGRARGPLDETAALVEQAGGKALAVTADVTRREDVDALVSAAVEHFGSLDVAVNNAGVFRGGVPVADLSEEDWHTQLDINVTGVFLALRAEVRHMRAQPGGGTIVNIASTFGAHKRSPGATAYAATKAAVSALTRGAALDHIGDGVRINAVSPGATATSMSLRPGETEAGRAERMRQETPLGRVSAVAEVAAAVLYLASDDAASVVGTDLVVDGGQTA

SEQ ID NO: 14623 - protein, 909 aa, Streptomyces coelicolor A3(2)
MSENKDPQVANAAKFVYDFTEGNKDLKDLLGGKGANLAEMTNLGLPVPPGFTITTEACKTYLDSGEEPAALRDEVSAHLDALEATMGKKLGQADDPLLVSVRSGAKFSMPGMMDTVLNIGLSDKSVQGLAKQAGDDRFAWDSYRRLIQMFGKTVLGVDGDLFEEALEAAKTAKKVAVDTELEAADLKKLVTKFKKIVKTEAGRDFPQDPREQMDLAIKAVFESWNGERAKLYRRQERIPHDLGTAVNVCSMVFGNLGPDSGTGVAFTRDPASGHQGVYGDYLQNAQGEDVVAGIRNTVALADLEQIDKKSYDQLMQIMETLENHYLDLCDIEFTIERGQLWMLQTRVGKRTAGAAFRIATQLVDQGLIDEAEALQRVNGAQLAQLMFPRFDDEAKVEKVGRGIAASPGAAVGKAVFDSYTAVKWSRSGEKVILVRRETNPDDLDGMIAAEGILTSRGGKTSHAAVVARGMGKTCVCGAEELEVDTKRRRMTVPGGHVVEEGDVISIDGSSGKVYLGEVPVVPSPVVEYFEGRMHAGAEDADELVEAVHRIMAFADRKRRLRVRANADNAEDALRARRFGAQGIGLCRTEHMFLGDRRELVERLILADTEAVREESLKELLPLQKQDFVQLFESMDGLPVTVRLLDPPLHEFLPDITELSVRVALAESRQEPHENELRLLQAVHRLHEQNPMLGLRGVRLGLVIPGLFTMQVRAIAEAAAERKAAKGDPRAEIMIPLVGTVQELEIVREEADQVIAEVEAATGAKLKLSIGTMIELPRAALTAGQIAEAAEFFSFGTNDLTQTVWGFSRDDVEASFFTAYLEKGIFGVSPFETIDKDGVGSLVAAAAKAGRATRPDLKLGVCGEHGGDPESVHFFHEVGLDYVSCSPFRIPVARLEAGRAASRSKGSDHR

SEQ ID NO: 14624 - protein, 320 aa, Streptomyces coelicolor A3(2)
MAATRPAVIALTALAPVSWGSTYAVTTEFLPPDRPLFTGLMRALPAGLLLLALARVLPRGAWWGKAAVLGVLNIGAFFPLLFLAAYRMPGGMAAVVGSVGPLLVVGLSALLLGQRPTTRSVLTGVAAASGVSLVVLEAAGALDPLGVLAALAATASMSTGTVLAGRWGRPEGVGPLALTGWQLTAGGLLLAPLALLVEGAPPALDGPAVGGYLYLALANTALAYWLWFRGIGRLSATQVTFLGPLSPLTAAVIGWAALGEALGPVQLAGTALAFGATLVGQTVPSAPRTPPVAAGAGPFSSASRNGRKDSMDLTGAALRR

SEQ ID NO: 14625 - protein, 245 aa, Streptomyces coelicolor A3(2)
MGKSLTGKIAVVTGGSTGIGFATARAFRDEGARVFVTGRRKDALDAATAELGPAVTGVVCDVSVPADLDAFYGTVRDQAGRIDVLVANAGIGVAAPFGEVTEELIDSVFAVNVKGTIFTLQQALPLLSSNASVILTGSTASTRPTQGLEVYGASKAAVRNLARGWAHSSRTHGFRVNVVSPGGTRTPGLLELVPPEALQQAEGGIPLGRLAEPEEIAALTTFLASDASSYVNGAEFFADGGYAQV

SEQ ID NO: 14626 - protein, 485 aa, Streptomyces coelicolor A3(2)
MTTVDNRQDFKVADLSLAAFGRKEITLAEHEMPGLMAIRKEYAEAQPLAGARVTGSLHMTVQTAVLIETLVALGAEVRWASCNIFSTQDHAAAAIAVGPNGTPDNPQGVPVFAWKGETLEEYWWCTEQALTWPNTPTGGPNMILDDGGDATLLVHKGVEYEKDGKVPSVDTAESDEHRVILELLTRTVGESPQKWTQLASEIRGVTEETTTGVHRLYEMHRDGTLLFPAINVNDAVTKSKFDNKYGCRHSLIDGINRATDVLIGGKTAVVCGYGDVGKGCAESLRGQGARVIITEIDPICALQAAMDGFQVTTLDEVVDKADIFVTTTGNKDIIMAKDMAKMKHQAIVGNIGHFDNEIDMAGLAQTPGIVKDEVKPQVHTWTYPDGKVLIVLSEGRLLNLGNATGHPSFVMSNSFADQTLAQIELFTKPDEYPTDVYVLPKHLDEKVARLHLDSLGVKLTTLRPEQADYIGVKVEGPYKADHYRY

SEQ ID NO: 14627 - protein, 498 aa, Streptomyces coelicolor A3(2)
MASSLTKDSVTPGTPGTEKTFFGHPRGLATLFMTEMWERFSYYGMRALLPLYLVAPGGLGLGAGTATAIYSVYLSLVYLLTMPGGWFGDRVWGPRKTVAIAGGVIMLGHLTLALPSSGTFYAGLGLVAIGSGLLKANISTMVGQLYDGPDDPRRDGGFTVFYMGINLGAFAAPLTIGTIGENVNWHLGFALAAVGMGLGVLQFLIGSRHLAPHSSAVPKPLSVEEKTSTLRKAAFWAALAVVFYAIVGFSGHYTLNWILVPLTLLGVIIPVLVLTNIKRDKSLDRAEQSKMSAYIWFFVAAAVFWMIYDQGGSTLSLFADSSADNSVFGWSFPVSWYQSVNPVIIMALAPVFATVWLALNRRGKEPSTVVKFCGGLVLVGASFFLFLAPLGIAEGGHKAAAMWLVAIYFVQTCGELMLSPVGLSVTTKMAPVKYASQMMGVWFLAVTAGDATTGLLSIAGVDLNKTGIVAAEATLAVVAGVAIWMYRKRVKELMGDVR

SEQ ID NO: 14628 - protein, 426 aa, Streptomyces coelicolor A3(2) [sequence omitted]

SEQ ID NO: 14629 - protein, 332 aa, Streptomyces coelicolor A3(2)
MATRAVARRKSAAGETSGSATSVRANGGELADRDLVGMYLDEIARTPLLDAAKEVELSQTIEAGVFARQVLEGYEETGADATREELQALIDESERAKDVFIRSNLRLVVAVARRYPRSGLPLLDLIQEGNAGLVRAVEKFDYRKGFKFSTYATWWIRQAITRSIADQSRTIRLPVHLVEELGRIRRVQREFNREHGREPEPAEIAAELGSTPERVTDVLDWARDPVSLNMSVDDEGETQFGDLLEDTSAVSPEQSVLTLLRSEELDDLIGRLDPRTASIIKMRYGIDDGRERTLTEVGKEHGLTRERIRQIEKHALLELKKLARDTGFEAAA

SEQ ID NO: 14630 - protein, 258 aa, Streptomyces coelicolor A3(2)
MTGLGRLDGKRTLVIGGGGAGIGRSIVRSCAAAGAAVAVADVDAARATEAADELRAAGHVAHALSGDVRSREQLEDVIVGAADRLGGLDVLITVVGGQVAFVPAVRLHEMADADWDTVYELNLRYVARAVRRVLRLFLEQGTGGNIVGIGSVTGFMAAPMQAGYGAAKAGLHSLARTVAAEYAADGIRMNVVAGGAISTAVNAGPSDAWVPEIPAGRYGTSEEMAAAAVYLASDESRYVTGQQIVLDGGVSVRGPFPE

SEQ ID NO: 14631 - protein, 475 aa, Streptomyces coelicolor A3(2)
MSLHQGPRPSRDSDRDRRRLAVNPFHAAANPLGGMTEAPPAHRLPDSPLPPESAYRLVHDELMLDGNARLNLATFVTTWMEPQAGVLMSECRDKNMIDKDEYPRTAELERRCVAMLADLWHAPDPSTAVGCSTTGSSEACMLAGMALKRRWALRNADRYPAKDVRPNLVMGVNVQVCWDKFCNFWEVEARQVPMEGDRFHLDPQAAAELCDENTIGVVGILGSTFDGSYEPVADLCAALDALQERTGLDVPVHVDGASGAMVAPFLDEDLVWDFRLPRVASINTSGHKYGLVYPGVGWALWRDAEALPEELVFRVNYLGGDMPTFALNFSRPGAQVVAQYYNFLRLGREGYRAVQQSARDIAGSLAERVAALGDFRLLTRGDQLPVFAFTTADDVTAYDVFDVSRRLREGGWLVPAYTFPPHREDLSVLRVVCRNGFSADMADLLLADLERLLPELRRQPGPLTRDKGAATGFHH

SEQ ID NO: 14632 - protein, 251 aa, Streptomyces coelicolor A3(2)
MISSFDLTGRTAVVTGGGRGLGLGISRALLNAGADVVVLSRSALDDRLRRTAADLGRSVSHVGVDLRDREGVAAAGAEVLAGHQVDILVNNAGAQIRHPAEDFPLDAWDAVLDVNLRSVVQLCQIFGRPMIQRGEGKIINLASLLSFQGGFTVAAYAASKGAVAQLTKALCNEWAGRGVNVNAIAPGYMATEMNTALLEDPVRLEQLSVRIPAGRWGGPDDVGDVAVFLASRAAAYVHGQVLAVDGGWLAR

SEQ ID NO: 14633 - protein, 794 aa, Streptomyces coelicolor A3(2)
MAELPTSHLAAAVLTDGNRALVAVIAVVALAALVLAGVLVRQVLAAGEGTDSMKKIAAAVQEGANAYLARQLRTLGVFAVVVFFLLMLLPADDWNQRAGRSIFFLIGAAFSAATGYIGMWLAVRSNVRVAAAAREATPAPGEPEKDLALVSHKATKIAFRTGGVVGMFTVGLGLLGACCVVLVYAADAPKVLEGFGLGAALIAMFMRVGGGIFTKAADVGADLVGKVEQGIPEDDPRNAATIADNVGDNVGDCAGMAADLFESYAVTLVAALILGKVAFGDFGLAFPLLVPAIGVLTAMIGIFAVAPRRSDRSGMSAINRGFFISAVISLVLVAVAVFVYLPGKYADLDGVTDAAIAGKSGDPRILALVAVAIGIVLAALIQQLTGYFTETTRRPVKDIGKSSLTGPATVVLAGISLGLESAVYTALLIGLGVYGAFLLGGTSIMLALFAVALAGTGLLTTVGVIVAMDTFGPVSDNAQGIAEMSGDVEGAGAQVLTDLDAVGNTTKAITKGIAIATAVLAAAALFGSYRDAITTGAADVGEKLSGEGAPMTLMMDISQPNNLVGLIAGAAVVFLFSGLAINAVSRSAGAVVYEVRRQFRERPGIMDYSEKPEYGKVVDICTRDALRELATPGLLAVMAPIFIGFTLGVGALGAFLAGAIGAGTLMAVFLANSGGSWDNAKKLVEDGHHGGKGSEAHAATVIGDTVGDPFKDTAGPAINPLLKVMNLVALLIAPAVIKFSYGADKSVVVRVLIAVVAFAVIAAAVYVSKRRGIAMGDEDDADPEPKSADPAVVS

SEQ ID NO: 14634 - protein, 325 aa, Streptomyces coelicolor A3(2)
MPAVTVENPLTLPRVSAPADAVARPVLTVTTAPSGFEGEGFPVRRAFAGINYRHLDPFIMMDQMGEVEYAPGEPKGTPWHPHRGFETVTYIVDGIFDHQDSNGGGGTITNGDTQWMTAGSGLLHIEAPPEQLVMSGGLFHGLQLWVNLPAKDKMMAPRYQDIRSGSVQLLTSPDGGALLRVIAGELDGHDGPGITHTPITMVHATLAPGAEVTLPWREDFNGLAYVMAGRGSVGAERRPVHLGQTAVFGAGGSLTVRADEKQDAHTPDLEVVLLGGRPIREPMAHYGPFVMNTKDELMQAFEDFQKGRLGTVPAVHGMSGEGPGA

SEQ ID NO: 14635 - protein, 326 aa, Streptomyces coelicolor A3(2)
MAAEKMALAKAINESLRRALESDPKVLIMGEDVGKLGGVFRVTDGLHKDFGEDRVIDTPLAESGIVGTAIGLALRGYRPVVEIQFDGFVFPAYDQIVTQLAKMHARSLGKVKMPVVIRIPYGGGIGAVEHHSESPEALFAHVAGLKVVSPSNAADAYWMMQQAIQSDDPVIYFEPKRRYWDKAEVDKEAIPGPLHTARVVREGTDLTLAAYGPMVKLCREVADAAAEEGRSLEVVDLRSISPVDFDTIQASVEKTRRLIVVHEAPVFLGSGAEIAARITERCFYHLEAPVLRVGGYHAPYPPARLEEEYLPDLDRVLDAVDRSLAY

SEQ ID NO: 14636 - protein, 334 aa, Streptomyces coelicolor A3(2)
MTTVAVKPATMAQALTRALRDAMAADPGVHVLGEDVGTLGGVFRVTDGLAAEFGEDRCTDTPLAEAGILGTAVGMAMYGLRPVVEMQFDAFAYPAFEQVVSHVTKMRNRTRGKMPLPLTIRVPYGGGIGGVEHHSDSSEAYYMATPGLHVVTPATVADAYGLLRASIASDDPVVFLEPKRLYWSKDSWNPEEPASVEPMGRAVVRRSGRSATLITYGPSLAVCMEAAEAARAEGWDLEVVDLRSLVPFDDETVCASVRRTGRAVVVHESGSFGGPGGEIAARVTERCFHHLEAPVLRVAGFDIPYPPPMLERHHLPGVDRILDAVGRLQWEAES

SEQ ID NO: 14637 - protein, 143 aa, Streptomyces coelicolor A3(2)
MRLALAEAGRAAAGGDVPVGAVVLAPDGRTVLSAGHNEREATGDPTAHAEVLAIRRAAGELGEWRLSGCTLVVTLEPCTMCAGALVQSRVDRVVYGARDDKAGAAGSLWDVVRDRRLNHRPEVIEGVLADDCARLLTDFFRDR

SEQ ID NO: 14638 - protein, 254 aa, Streptomyces coelicolor A3(2)
MHDLTGKNVIITGGARGLGAEAARQAVAAGAHVLITDVLDDDGENAARELGDRARFLHHDVTSEEDWSRAADFAVTEFGALHGLVNNAGISTGTPLESESVDHFRKVLDVNLTGVFIGMKTVVPALKEAGGGSIVNISSAAGLMGLALTAGYGASKWGVRGLTKIGAVEWGTARVRVNSVHPGMTYTPMTAAVGIERGEGKYPNTPMGRVGEADEIAGAVVFLLSDAASYVTGAELAVDGGWTTGPTVAYVMGQ

SEQ ID NO: 14639 - protein, 496 aa, Streptomyces coelicolor A3(2)
MIRQRPENRNGARPVRCSQPLEGDPGSSDRHARSEEERLVSQYVSRLGRRSPAASPRLRLNRKPRRVAMLSVHTSPLHQPGTGDAGGMNVYIVELAQRLAAINIEVEIFTRATTAALPPAVELAPGVLVRHVDAGPYEGLAKEELPAQLCAFTHGVMQAWAGHRPGHYDLVHSHYWLSGHVGWLAAQRWGAPLVHAMHTMAKVKNANLADGDTPEPAARVIGETQIVAASDRLIANTAEEADELVRHYAADPDKVAVVHPGVNLERFRPFPKGRVPGPGQHGNARAAARARLGLPQDALIPLFAGRIQPLKAPDILLRAVAVLLDERPELRSRIVVPVVGGPSGSGLAKPEGLQKLAARLGIADVVRFRPPVGQEQLADWFRAASVLVMPSYSESFGLVAIEAQAAGTPVLAAAVGGLPVAVRDGHTGRLVHGHDPAAYARVLRDFADNPDLTPRMGDAAARHAQSFGWDSAAATTADVYTAAIQSYRRRVRSHHG

SEQ ID NO: 14640 - protein, 249 aa, Streptomyces coelicolor A3(2)
MGQLEGRTAVVTGGGTGIGLASAVRLADEGAHVFITGRRKEALDKAVEIIGAGRVTAVAGDVSDPADLDRLYEAVRARGRGLDVVFANAATASLVPLEEITEERFEEIFGVNVRGTLFTVQKALPLLNDGASVILNASTAADNGAEAFSLYAASKAAVRTFARGWANELKGRGVRVNAISPGPVDTPGITNLFGESNAPTVHTKLAGDTAIGRMGRPEEVAAVVAFLASDQSSFVLGANWYVDGGENQI

SEQ ID NO: 14641 - protein, 501 aa, Streptomyces coelicolor A3(2)
MTANVDGVPEKFATLGLTYDDVLLLPGASAVLPNAVDTSSRISRNVRVNIPLLSAAMDKVTESRMAISMARQGGVGVLHRNLSIEDQANQVDLVKRSESGMVANPITIHPDATLGEADALCAKFRISGVPVTDGAGKLLGIVTNRDMAFETDRSRQVREVMTPMPLVTGQVGISGVDAMELLRRHKIEKLPLVDGDGILKGLITVKDFVKAEQYPHAAKDAKGRLLVGAAVGASPEALDRAQALAEAGVDFLVVDTSHGHNSNALSWMSKIKSSVGIDVVGGNVATRDGAQALIDAGVDGIKVGVGPGSICTTRVVAGIGVPQVTAIYEASLAARAAGVPLIGDGGLQYSGDIGKALAAGADTVMLGSLLAGCEESPGELQFINGKQFKSYRGMGSLGAMQSRGQGRSYSKDRYFQAEVASDDKLVPEGIEGQVPYRGPLANVLHQLVGGLRQTMGYVGAATIEEMESKGRFVRITSAGLKESHPHDIQMTVEAPNYSRSK

SEQ ID NO: 14642 - protein, 374 aa, Streptomyces coelicolor A3(2)
MTEIEIGRGKRGRRAYAFDDIAVVPSRRTRDPKEVSIAWQIDAYRFELPFLAAPMDSVVSPATAIRIGELGGLGVLNLEGLWTRHEDPQPLLDEIAELDTDNATRRLQEIYAAPIKEELIGQRIKEVRDSGVVTAAALSPQRTAQFSKAVVDAGVDIFVIRGTTVSAEHVSGSHEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADSVMMGSPLARATDAPGRGNHWGMEAVNEELPRGKKVDLGTVGTIEEILTGPSRNPDGSMNFFGALRRAMATTGYSELKEFQRVEVTVADSQHRR

SEQ ID NO: 14643 - protein, 509 aa, Streptomyces coelicolor A3(2)
MANSTHTPAERAHRTIHAGGEWLAASSGATREILDPADAVAFAVVAEGDEKDTDLAVAAARRAFDAGDWPHTPVAERAALLRRVAGLLVRDREKLGLLESRDAGKTVEEGRVDIDCVADAFRYFADLVAGEAPGRVVDAGSPEVHSVVVHEPVGVCAMITPWNYPLLQASWKIAPALAAGNTFVIKPSEITPMTTIALIDLLVEAGLPTGVANIVTGPGHTVGARLAEHPDVDLVSFTGGLTSGVKVAQAAAVTVKKVALELGGKNPNVVFADACATEEGFDTAVDQALNAAFMHSGQVCSAGGRLIVEESVRERFVAELARRAERIRLGRGTEEGVECGPLVSAQQRAKTEDYVASALAEGAELRCGGKRPEPSPQRPESGYFYEPTVLDHCHREMRVVREEVFGPVLTVETFRTEDEAVALANDTEYGLAGAVWTADAGRARRVAGRLRHGTVWINDFHPYLPQAEWGGFGKSGVGRELGPAGLAEYRESKHVYQNLAPKPVRWFSG

SEQ ID NO: 14644 - protein, 343 aa, Streptomyces coelicolor A3(2)
MTEHHLPSELDVPSEAPDRNLAMELVRVTEAAAMAAGRWVGRGDKNGADGAAVRAMRTLVHTVSMNGVVVIGEGEKDEAPMLFNGERVGDGTGAEVDIAVDPIDGTTLTANGMTNAIAVLAAAERGSMFDPSAVFYMDKLVTGPEAADFVDINAPVAVNIRRIAKAKRRTPEDVTVVILDRPRHQGLIKEVRETGARIKLISDGDVAGSILALREGTGIDLLLGIGGTPEGIISACAVKCLGGTIQGKLWPKDAEERQRAVDAGHDLDRVLTTDDLVSGDNVFFVATGITDGELLRGVRYRSETATTDSIVMRSKSGTVRRIDSEHRLSKLRAYSAVDFDRAK

SEQ ID NO: 14645 - protein, 261 aa, Streptomyces coelicolor A3(2)
MATQDSEVALVTGATSGIGLEIARRLGKEGLRVFVCARGEEGLRTTLKELREAGVEADGRTCDVRSVPEIEALVAAVVERYGPVDVLVNNAGRPGGGATAELADELWLDVVETNLTGVFRVTKQVLKAGGMLERGTGRIVNIASTGGKQGVVHAAPYSASKHGVVGFTKALGLELARTGITVNAVCPGFVETPMAASVREHYSDIWEVSTEEAFDRITARVPIGRYVQPSEVAEMVAYLIGPGAAAVTAQALNVCGGLGNY

SEQ ID NO: 14646 - protein, 377 aa, Streptomyces coelicolor A3(2)
MATEDAVREALATVNDPEINRPITELGMVKSVEIGADGAVAVAVYLTVSGCPMRDTITQRVSDAVSRVEGVTRVDVELDVMSDEQRKELATALRGGQTEREVPFAKPGSLTRVYAVASGKGGVGKSSVTVNLAASMAADGLKVGVVDADIYGHSVPRMLGADGRPTQVENMIMPPSAHGVKVISIGMFTPGNAPVVWRGPMLHRALQQFLADVYWGDLDVLLLDLPPGTGDIAISVAQLVPNAEILVVTTPQQAAAEVAERAGAIAVQTHQKIVGVVENMSGLPCPHCGEMVDVFGTGGGQTVADGLTRTTGASVPVLGAIPIDVRLREGGDEGKPVVLSDPDSPAGAALRSIAGKLGGRQRGLSGLSLGITPKNKF

SEQ ID NO: 14647 - protein, 530 aa, Streptomyces coelicolor A3(2)
MDVMPLLLLVAGSAAVAAAGRRVPVPVPLLLVAAGLAVSYVPGVPDYTLDPHIVLPLLLPPLLYTAATDSSYLDLRAQARPVALLSVGYVLFATFVVGCAAYLIVPGLPLTAALVLGAVVAPPDAVAATAVARRVGLPSRITTILQGESLVNDATAITAFKVALAAAVGEGATWAGGIGEFLIAAVGGVGVGLVLMVPLHWLRTHLTEALLQNTLSLLIPFVAYAVAEQVQASGVLAVVVVALYLGHRAWEVDFATRLQEEAVWKMVAFVLESAVFALIGLQLPVVLKGLGEYEGADAAWYALAVFLVVAVARFVWVYPATYLPRLSARVRAREGELSWKGPFVIGWAGMRGVVSLAIAFSIPLTVHGGEPFPERNLILFLTFTTVIGTLVVQGVSLPPLIRLLKFPAHDVQAETLAEANAQAQASRVAELRLDDLLADERNALPAPLADRLRMVLERRRNAVWERLGQVNPVTGETVDDTYRRLSREMISAEREVFVRLRDGRYIDDEMLRTLLRRLDLEEAAAYREAT

SEQ ID NO: 14648 - protein, 463 aa, Streptomyces coelicolor A3(2)
MSRSAHPAGPRHADVLPEGHYTAPADDLNALDPKVWARTVGRDADGVVTVGGIPVTQLAEEYGTPAYLLDEADFRERARAWRTAFGDDADVFYAGKAFLSRAVVRWLDEEGLNLDVCSGGELATALSAGMPAERIAFHGNNKSPEEIERAVRAGVGRIVLDSFQEIVRVAHIAQSLGKRQRVQIRITVGVEAHTHEFIATAHEDQKFGIPLAGGQAAEAVRRALKLDGLEVIGIHSHIGSQIFDMSGFEVAAHRVVGLLKDIRDEHGVELPEIDLGGGLGIAYTSDDDPREPHEIAKALTEIVTRECEAARLATPRISVEPGRAIVGPTAFTLYEVGTVKPLEGLRTYVSVDGGMSDNIRTALYDAEYSVALASRTSDAEPMLVRVVGKHCESGDIVVKDAFLPGDLAPGDLIAVPATGAYCRSMASNYNHALRPPVVAVRDGAARVVVRRETEEDLLRLDVG

SEQ ID NO: 14649 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 14650 - protein, 280 aa, Streptomyces coelicolor A3(2)
MPQHTSGSDRAAIPPAARDGGSVRPPAPSTLDELWRSYKTTGDERLREQLILHYSPLVKYVAGRVSVGLPPNVEQADFVSSGVFGLIDAIEKFDVDREIKFETYAITRIRGAMIDELRALDWIPRSVRQKARNVERAYATLEARLRRTPSESEVAVEMGIAVEDLHAVFSQLSLANVVALEELLHAGGEGGGRLSLMDTLEDTAADNPVEVAEDRELRRLLARAINTLPEREKTVVTLYYYEGLTLAEIGNVLGVTESRVSQIHTKSVLQLRAKLAGFGR

SEQ ID NO: 14651 - protein, 418 aa, Streptomyces coelicolor A3(2)
MSDSPAPLADPHLVYDPVAGDGPKDVVVLGSTGSIGTQAIDLVLRNPDRFRVTALSANGGRVALLAEQAYRLKARTVAVAREDVVPALREALTAQYGTGEPLPEILAGPEAATQLAASDCHTVLNGITGSIGLAPTLAALEAGRTLALANKESLIVGGPLVKALAKPGQIIPVDSEHAALFQALAAGTRADVRKLVVTASGGPFRGRTRDELAAVTVEDALAHPTWAMGPVITINSATLVNKGLEVIEAHLLYDIPFDRIEVVVHPQSYVHSMVEYTDGSTLAHATPPDMGGPIAVGLGWPERVPDAAPAFDWSKASTWEFFPLDNEAFPSVDLARHVGQLAGTAPAVFNAANEECVEAFRSGALPFLGIMETVTRVVEEHGTPRTGTSLTVADVLEAETWARARARQLAAQTAEARA

SEQ ID NO: 14652 - protein, 1829 aa, Streptomyces coelicolor A3(2)
MESGAATRATKTRAKGGQSLSNQGKSRGGGARSGSTTVDTAALNRLLAALVSMREGNFRRRLTVSGDGVMSEIAAVFNEVADRNLHLTGELARVRRVVGREGKLTERLETGACEGSWAAAIDHSNALVDDLVRPVSEVSRVLSAVADGDLSPRMELRTQNDEGTGQPLRGEFLKVGRTVNNLVDQLSTFTDEVTRVASEVGTEGKLGGQARVRGMSGSWKDLTDSVNTMAYRLTAQVRDIALVTTAVAKGDLSRKVTVHVAGEMLELKNTVNTMVDQLSAFSSEVTRVAREVGTEGALGGQAQVPGVAGVWKELTDSVNTMAGNLTAQVREISHVTTAVANGDLSKKVTVPARGEVAQLAETINQMTETLRIFADEVTRVANETGGEGQLGGQANVPGAAGIWKDLTDSVNTVFRNLTTQVRDIAAVTTAVASGDLSQKVTVDVAGEMLELKNTVNTMVDQLSAFGAEVTRVAREVGVEGELGGQAQVPGAAGTWKDLTDSVNTAFRNLTGQVRNIAQVTTAVANGDLSQKVTVDVSGEMLQLKNTVNTMVDQLSSFADQVTRMARDVGTEGRLGGQARVDGVSGTWKELTDSVNSMAGNLTSQVRNIAQVTTAVARGDLSQKIDVDARGEILELKNTINTMVDQLSSFAEQVTRVAREVGTEGRLGGQAQVPGVAGVWRDLTDSVNGMAGNLTAQVRNIAQVATAVARGDLSQKITVDARGEILELKNTLNTMVDQLSSFAQEVTRVAREVGTEGILGGQAEVQGVSGTWKDLTQSVNGMANNLTMQVRNIAEVTTAVAKGDLSKKITVDAKGEILELVTTVNTMVDQLSSFAEQVTRVAREVGTEGILGGQASVPGVVGIWKDLNDNVNLMAKNLTVQVRNISQVAAAVANGDLTRTVTIEARGEVAQLADTFNTMVRTLRSFADQVTKVAREVGTDGILGGQAQVPGVSGTWKDLTESVNQMASNLTGQVRNIAMVTTAIAKGDLTKKIDIDARGEILELKTTINTMVDQLSSFAEEVTRVAREVGTEGQLGGQARVRDVDGTWRDLTESVNEMAGNLTRQVRAIARVATAVTRGDLNLKIDVDASGEISELQDYINKMIANLRDTTIANKEQDWLKGNLARISGLMQGRRDLQDVASLIMSELTPVVSAQHGAFFLAMPLVDGQEQAGAEGDAYELRMLGSYGYSMGSMPTSFRPGEALVGTAAQEKRTILVENAPSGYLKISSGLGEAPPAQVIVLPVLFEGQVLGVIELASFTPFTHIQKDFLNQIAEMIATSVNTISVNTKTEVLLSQSQELTEQLRERSEELEQRQKALQSSNAELEEKAELLAQQNRDIEVKNTEIEEARQVLEERAEQLAVSMRYKSEFLANMSHELRTPLNSLLILAKLLADNADANLTPKQVEFAETIHGAGSDLLQLINDILDLSKVDAGKMDVSPTRIALVQLVDYVEATFRPLSAEKGLDLSVRVSPGLPATMHTDEQRLLQVLRNLLSNAVKFTDSGSVELVIRPARDEVPTAIREQLLEAGSMNDPDAELIAFSVSDTGIGIAASKMQVIFEAFKQADGTTSRKYGGTGLGLSISREIAQLLGGEIHAQSEPGRGSTFTLYLPLHPSELPPHGYQQPLPSVEAGELPASSGAVAELPGAEAETPAEVKSYQDAQNGAAALFRRRRKSSADTEGRPEVRERQPGAGQEAVPQAHRGIRFGGQKVLIVDDDIRNVFALTSVLEQHGLSVLYAENGREGIEVLEQHEDVAVVLMDIMMPEMDGYATTTAIRRMPQFAGLPIIALTAKAMKGDREKAIESGASDYVTKPVDPDHLLTVMQQWMREE

SEQ ID NO: 14653 - protein, 511 aa, Streptomyces coelicolor A3(2)
MSASTSRTLPPEIAESVSVMALIERGKAEGQIAGDDVRRAFEADQIPATQWKNVLRSLNQILEEEGVTLMVSAAEPKRTRKSVAAKSPAKRTATKAVAAKPVTSRKATAPAAPAAPATEPAAVEEEAPAKKAAAKKTTAKKATAKKTTAKKAAAKKTTAKKEDGELLEDEATEEPKAATEEPEGTENAGFVLSDEDEDDAPAQQVAAAGATADPVKDYLKQIGKVPLLNAEQEVELAKRIEAGLFAEDKLANSDKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 14654 - protein, 395 aa, Streptomyces coelicolor A3(2)
MIPNQWYPIVEAQEVGNDKPLGVRRMGQDLVLWRDIDGNLVCQGARCPHKGANLGDGRMKGNTIECPYHGFRYGADGACRVIPAMGSEARIPGSLRVPTYPVREQFGLVWMWWGDERPTADLPPVAAPAEVTDNRKLYATKRWTRPVHYTRYIESLLEFYHVTYVHRDHWFNYIDYLLLYGTPSKFGLDGRERYLAATRITNHRVETEAEGQTIRYSFDHCQEDDPTNTTHYVITFTFPCMVHVQTEQFETTSWLVPIDDQNTEHILRWYEYEQVKPVLRFEPLRRLLPWASLYMEKWVQDPQDVRIMEHQEPKISAGGVNKFIPVDEMNAKYISMRAKLIADASAAPSSPARAAEPEPEAAGRGGSAARATGNGRGAAGGRRGTKPKEDAAARP

SEQ ID NO: 14655 - protein, 402 aa, Streptomyces coelicolor A3(2)
MSPLTAADLGAPLAAALAAATEDRLVYDLAGIERRHDTLRNELPGVHVRFAMKACPVDEVLAALAGRGAGADAASPGEVEQALRAGVPAGRVHYGNTVKSDRNIAEAHRLGVRTFATDSLQDVAALAVHAPGARVFCRVATGGAGALWGLSNKFGCPPGDAVRVLVAARDAGLVPAGLSVHVGSQQMTSEAWHGAVDDLGDVLRALGRHGIRVDHVNLGGGLPALGYRDRHGAPLDPPLDKIFAVIREGMDELRRIHGGHLDFVVEPGRHLVADHGAIRAHVVRLTERRAADGERQHWLYLSCGKFNGLYEMDALQYRLVFPGHPDGPCVPAVVAGPTCDSDDAYSHEEGLVPVPAALASGDPVWVLSCGAYATSYTTRGFNGFAPLPYAFAGRPERTGADD

SEQ ID NO: 14656 - protein, 406 aa, Streptomyces coelicolor A3(2)
MRIAMVSEHASPLAALGGVDAGGQNVYVARLAEELAGRGHDVTVYTRRDATDLPARVPLPGGAVVEHVPAGPPVTVPKDELFPHMPAFGAHLARAWARERPDVVHAHFWMSGMASQIGAAPHGIPLVQTFHALGTVKRRHQGMRDTSPYERIGIERQLGRTCERVLATCTDEVVELGDMGVPARQVSVVPCGVDAEHFHPAADTGRTPERRLRHRLLACGRLVPRKGYDQAVRALAHIPDAELLIAGGPPAGALETEPEARRLTGIARRAGVADRVRLLGAVDPDDMPALLRSSDLVLCTPVYEPFGIVPLEAMACGVPVLATDVGGHRDSVADGVTGRLVAPQDPGAVAAAARELLADERLRRQYGRNGRERVLRHYTWARVADGAEQVYRLTRSEHALSTEVAS

SEQ ID NO: 14657 - protein, 440 aa, Streptomyces coelicolor A3(2)
MTSPSAPSSAERPRLPGALDGPRLAAAAAEHGTPLWLYDAATIRAQIDRLRRFDVIRYAQKACSNLHILRLMREEGVHVDAVSEGEIERALAAGYRVGGDDEPIVFTADLLNRSTLRRVVELGIPVNAGSPQMLDQVGRAAPGHPVWIRINPGFGHGHSRKTNTGGEHSKHGIWHEHLEESLALVDRHGLDLVGLHMHIGSGVDYGHLESVCETMVKQVRMAGRDIRAISAGGGLSVPYTPGDPEIDTDRYFELWDAARRELVSELGHPVRLEIEPGRFLVAGAGVLAAEVRAQKPVGSNYFVLVDAGFNDLMRPAMYGSNHRVSVLDADGAPRASDARDTVLAGPLCESGDVFTQVEGGDVEPVPVPRTDVGDLVVFHDTGAYGASMSSTYNSRPLIPEVLVDGAETRLIRRRQTVAELLAPELEPGPALSPRPSRDPR

SEQ ID NO: 14658 - protein, 367 aa, Streptomyces coelicolor A3(2)
MKFGAAVLRAYENPFTVEEVVLAEGPAEGEILVRIAGCGMCRTDLAVRRSGGRSPLPAVLGHEGSGVVVETGGTGTGLSAGDHVVLSFDSCGHCRNCMGAAPAHCDSFAALNLFGGRREHAARFTDTTGTALAPRWFGQSSFAEYALVPARNAVRVDPALPLELLGPLGCGFLTGAGAVLNSFGVGPGDTLAVFGAGAVGLAAVMAAHAAGAATVAVDRHPGRLALAERLHAVAVPATPTGLSDRILRLTGGGTTYALDTTGSAGLINEALRSLRPTGRLGLVARLHGTLPIEAGTLDRGRAIFHICEGDAVPGLLIPRLTALWQAGRFPFDQLIRTYPLADINEAEHDCETGRVVKPVLIPDGRRP

SEQ ID NO: 14659 - protein, 246 aa, Streptomyces coelicolor A3(2)
MRPRLYWTRRTDRDQPGDPVTHRSSSNDRTALVVVAHHRADSLTAHTARRTADRLEASGYRVDLLDLHAEGFDPRMTTADQPDWGDREKAYSDEARAHMRRVLDADVVVAVFPVYWQSVPALLKGWIDRVWNYGFAYGRSKPRLAGKRMLWLGLAGATADDPITEAMHALLETSLSEGIASYCGFSHSAVGLLTDAEERPQRVDAEGGLLVGDAVAGAEREAQYADFDRRAREAVEKFLAAEGVAA

SEQ ID NO: 14660 - protein, 615 aa, Streptomyces coelicolor A3(2)
MNTGELVDLGQQLRVDSVRAAAAAGSGHPTSSMSAADLMAVLLANHLRYDFERPAHPGNDRFVLSKGHASPLLYSAFKAAGAIDDEELLTFRKQGSRLEGHPTPQRLPWVETATGSLGQGLPVGVGIALSGKRLDHTDYRVWVLCGDSELAEGSIWEAAEHAGHEHLDNLTVIVDVNRLGQRGPTRHGHDLDAYARRFRAFEWHTIEVDGHDVDAVDRAYGEALSTKGQPTAIIARTLKGKGVRAVEDREGQHGKPLPEAEEAVAELGGPRDIRVRVHAPEDARSLRSTGTGQTELPRYGLGDEVATRNAFGEALAAVGTARGDVVALDGEVGDSTRAEFFAKEHPERYFECYIAEQQMVAAAVGMAARGWVPFATTFAAFLTRAYDFVRMASISGAGINLVGSHAGVAIGQDGPSQMGLEDLAMMRAIHGSTVLYPCDANQAARLVAEMAGLEGIRYLRTSRGESKVIYGPDEEFPVGGSKVLRSSDADRLTVVAAGVTLHEALAAADALGADGIPVRVIDLYSVKPVDRATLRAAAEETGCLVTVEDHRREGGIGDAVLDAFSDGRPVPRLVRLAVTTMPGSATPAEELHAAGIDAESIEAAARMLVEQAIVP

SEQ ID NO: 14661 - protein, 277 aa, Streptomyces coelicolor A3(2)
MSSKVPPIILNNGVEMPQLGFGVWQVPDDDAQTAVALALEAGYRSIDTAAIYGNEEGTGRAIAASGLAREDLFVTTKLWNSDQGYDSTLRAFDTSMAKLGLEYLDLYLIHWPMPAKERYVDTYKAFEKLLADGRVRAIGVSNFLPEHLERLTAETSVIPAVNQIELHPHLQQHAAREVHAEQGIATEAWSPLGSGKGILDIPAIVAIAQKHGRTPAQVVLRWHLQLGNVVIPKSVTPSRIKENIDVFGFSLDTEDLAAISALNEDRRLGSDPADVNS

SEQ ID NO: 14662 - protein, 578 aa, Streptomyces coelicolor A3(2)
MTQDRPSDKEEHDRGTLPGSEAGLPGQEHRPRTDRVVFGVTAVLTLAFVIWGAAATDSLEDVSSSMLGGLLHNGGWAFTLAASGFVVFALWLAASRYGRIHLGAEGEEPEFRTVSWVAMMFSAGMGIGLMFYGVSEPLAHYTTPPPGTSPADSGDRMATAMATTLFHWTLHPWAIYAVVGLGIAYSTFRRRRRQTISAVFTPLIGEKHANGAGGRVIDILAIIATIFGSAASLGLGALQIGSGMEKLDWMDKVSTGLLVGIIAVLTVAFVASAISGVEKGIQWLSNTNMVLALVLAVFVFIAGPTILILDLLPTSVFAYLGDLPQMAGRTEISGGKGVADWLGSWTVFYWAWWISWTPFVGMFIARISRGRTIRQFIGGVILVPSTVSLIWFAIFGGSAMRLQEQNRLGDDSTPEGQLFGVLQEYPIATATSLLVMILVGIFFVSGADAASIVMGTLSQKGALEPSRWVVVVWGVVTGAVAAIMLLIGSGEADALTGLQNLTILAAAPFVIVMIFMCVALMRDLRRDPLMVRGEMANEAVELAVIEGHKQYEGDFEIRIGPGPGTDVEGDPIGKHHKD

SEQ ID NO: 14663 - protein, 656 aa, Streptomyces coelicolor A3(2)
MTILENIRGPRDLKALSEAELGELSDEIRDFLVHAVARTGGHLGPNLGVVELTVALHRVFESPDDRILWDTGHQSYVHKLLTGRQDFSKLRSKGGLSGYPSREESAHDVIENSHASTVLGWADGLAKARQVQGERSHVVAVIGDGALTGGMAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTEKGRGYEPALRDEEDHFHTVGVMDPLTCEPLGPAGGPSWTSVFGEEIVRIGEERADVVAITAAMLHPVGLAPFAERFPDRVWDVGIAEQHAAVSAAGLATGGLHPVVAVYATFLNRAFDQLLMDVALHRCGVTFVLDRAGVTGVDGASHNGMWDMSVLQVVPGLRIAAPRDADQLRTQLREAVAVDDAPTLLRFPKESVGPAVPAVDRIGGLDVLHTADRSEVLLVAVGVMAPVCLGAAELLEARGIGCTVVDPRWVKPVDPALAPLAARHRLVAVVEDNSRAAGVGSAVALALGDAEVDVPVRRFGIPEQFLAHAKRAEVLADIGLTPVDVAGRIAASLALAEPAGDRAGGPAVEQPGDGRMSGDGRIVMPAQGEN

SEQ ID NO: 14664 - protein, 363 aa, Streptomyces coelicolor A3(2)
MRRARAAVVREPGAPFTVLEVELEDPRPREVLVRMTAAGVCHTDLGIQAGWPRRLTPMVFGHEGAGRVEAVGAEVTGLVPGDTVCLTFASCGGCGQCTAGHPAYCDAARDLNLSGGRGDGSTPLRLDGAPLHGGFFGQSSFATYAVVHEHGVVRVPADLPATLAAPLGCGGQTGAGTVLNRLRPEPGTSLVVLGAGGVGLSALMAAVAVGCDPVLAVDPVASRRDLARALGARAALPPDDALVAAVRQLTDGGAHHVVDTTGRPGMLDRAVAALRPRGALALLGLGGEVTFDMMRLMTKGVRLHGVMEGDSDPARFVPELIALHRRGLFPVDRLVTTFAFEEIGAAVAAMRDGSAVKPVLTFS

SEQ ID NO: 14665 - protein, 403 aa, Streptomyces coelicolor A3(2)
MLSSQSAQIVRDTLPTVGASLGTITDLFYRRMFEERPELLRDLFNRANQASGVQREALAGAVAAFATALVKHPDERPDAVLGRIANKHASLGITSDQYTLVGRHLLAAVAEVLGDAVTPAVAAAWDEVYWLMANALIAMEARLYARSDVEDGSVWQSMEIVERHEETPDTASFVLRPADGSPTRPFVPGQYVSVRAELPDGAHQIRQYSLSSAPGGGTWRFTVKRERSLDGQVPDGEVSTWLHTHARPGDVLRVSLPFGDLLLPEGDGPLLLASAGIGVTPMLAMLEHLATAAPDRPVTVVHADRSPALHAHRLELTALVERLPHASLHLWYEDTADHPDASADHVNEGWADLTGLSPVPGTTAFLCGPLSFMKAVRTDLLAHGLSPRAIHYEVFGPDLWLSK

SEQ ID NO: 14666 - protein, 255 aa, Streptomyces coelicolor A3(2)
MSPNQSHETFSGHVVIVTGAGTGIGRATAVAFAESGAHVLAVGRREALLKETAAAHSHIDVLAIDICGDEAPGKVVDAAVERWGRLDHLINNAGATAVMPLAEAEKQTIVDLLALNVVAPSLLAREALPHLRRTSGSIINLSSTYGHRPMAGGAHYSATKAAVEQMTRSWALELADEGVRVNSVAPGPTRTDVMLHAGLTPEAANDMYAYERDRIPTHHIAHADEVAHWILRMADPAGRHATGQVITVDGGLELI

SEQ ID NO: 14667 - protein, 260 aa, Streptomyces coelicolor A3(2)
MTTTGSALSGALPFAGLTALVTGGASGIGLATARLLTAQGARVAVLDLSEPQPAGFAAALRADIRDDASVVAAVDAAVSRLGGLDIVVNNAGIGAQGGVEDNSDEEWHRVLDTNVVGMVRVTRAALPALRASRHAAVVNVGSIAATAGLPQRVLYSAGKGAVVAMTRAMAADLLPEGIRVNAVNPGTADTPWIGRLLDRAADPAAEYTALAARQPHGRLVAADEVAAAIAYLASPAAGSTTGTCLAVDGGMDGLRLRKEG

SEQ ID NO: 14668 - protein, 1331 aa, Streptomyces coelicolor A3(2)
MTSDSAGPVDAVPGDQELRRLLAGLTAVRDGDFGTRLPDDADGLMGDIAKVFNGMVDQLSVFTSEVTRVSREVGTEGALGGQARVPGVSGTWADLTDSVNAMAGNLTSQVRDIAQVATAVARGDLSQKIDVDARGEILELKNTINTMVDQLSAFADEVTRVAREVGTDGRLGGQADVQGVRGTWRDLTDSVNFMAGNLTNQVRNVAQVATAVAKGDLSQKITVDARGEILELKNTINTMVDQLSAFADEVTRVAREVGTAGNLGGQARVRGVSGTWKDLTDNVNVMASNLTGQVRSIAQVATAVARGDLSQRITVDAEGEVAALADVINTMVDTLSAFADEVTRVAREVGTDGRLGGQANVPNVAGTWKDLTDNVNSMANNLTNQVRNIALVTTAVARGDLSKKIDVDARGEILELKTTINTMVDQLSAFADEVTRVAREVGTEGRLGGQAEVEGVSGTWKRLTENVNELAGNLTRQVRAIAEVTSAVAEGDLTRSVTVEASGEVAELGDNINAMVESLRETTRANQEQDWLKTNLARISGLMQGHRDLPVVAELIMDELVPLVSAQYGAFYLAEDGDDGPELRLVGSYGYPEDTARPNRIAFGRTLVGQAARSRRTIMVNELPPGYLTISSGLGEVVPAALVLLPIVVEGQVLGVIELASVAAFSQINRDFLEMLMETIGVNVNTIVANARTDELLAESQRLTGELQARSAELQTQQEELQHSNAELEDKASLLAAQNRDIEAKNLQIEQARQELEARAQQLSLASKYKSEFLANMSHELRTPLNSLLILAQLLAQNPSRNLTPKQVEYAGIIHSAGSDLLQLINDILDLSKVEAGKMDVSPERVTLRQLIEYVEATFRPMTSQKGLEFTVVTAPGAPADLLTDDSRLRQVLRNLLSNAVKFTERGGVELAVEPAPDDEVPGGVVRGGPVVAFRVKDTGIGIPEQNLESIFGAFQQADGTTSRKYGGTGLGLSITREIAQLLGGAVTVDSTPDRGSTFTLYLPVARPDFEDLLARAPEHLAADASSDVLDRPAPVAELTGGHRRRPRRLLVVEERPRGLLTLVAESVVADLTHGRDDAGDRPPLDVITAVGAEEAAGALAAEPCHCVVLELGMPDGEASRFLRALRGDSALASVPVLVHSGHRADAAVAEDLRSRAAGGTLEFLAGLDELRERIALHLAAEEPGDVLSLVRPEEPPRPDPRAGQGPPAGRTVLVVDDDARNLFALSGILELHGFRVLHAENGRRGIEALVDHPEVALVLMDVMMPEMDGYTATAEIRRIPRYAELPIIAVTAKAMPGDREKSLASGASDYVTKPVDTQDLIACVRRWLPA

SEQ ID NO: 14669 - protein, 276 aa, Streptomyces coelicolor A3(2)
MISIPAYTLNDGTSLPALGLGTWPMKDEEAERAVRAALETGYRLIDTATNYRNETGVGRGVASAGLPREEIVVTTKLPGRHHGYEETLASFEESRARLGLEYVDLYLIHWPLPRVDKYVDSWKAMVKLREDGLVRSVGVSNFTAEHIERLERETGVLPSVNQIELHPLLPQDELRAYHERKGIRTESWSPLGRGSDLLDDPAVAAVAAAHGVTPAQAVLRWHTQLGAVPIPKSADPARQRANLDVFGFELDAEQLRAVADRVHRRIGGDPEVHEEF

SEQ ID NO: 14670 - protein, 263 aa, Streptomyces coelicolor A3(2)
MSTTGTTPATTGYAAEFAGRTALVTGAASGIGLATARRLGAGGARVVVADFNAEGAEKAAAELRAGGVEAAAVELDVTRPESVEAAVGFAVDTFGSLDLAVNNAGIGGPSAPTGEYDVAAYQRVVRTNLDGVFYSMRYELPAIEAAGKGGSIVNVASILGSVGFAGSPAYVAAKHGVVGLTKAAAAEYAARGIRINAVGPGFIDTPLLKTMDEAAYKGLVALHPAGRLGRSEEVAELIAFLLSDRASFVAGSYHLVDGAYTAV

SEQ ID NO: 14671 - protein, 398 aa, Streptomyces coelicolor A3(2)
MLSEQSVPVVRATLPAVGAAIGDIAALFYRKLFDAHPELLRDLFNRGNQANGEQQRALAGSVAAFAGLLLENPDERADVLLSRISHKHASLGITPDQYTIVHRHLMAAVVDVLGDAVTPEVARAWDEVYWLMANALIALEARLYTEKGVAEGDVWRTMEIVDRVEESADAVSLVLGSADGRPVVPFRPGQYVSVQVELADGARQIRQYSLSAAPGRSDWRITVKRVRGDGQPDGEVSSWLYANARKGDALNVSLPAGDLALAEHDGPLLLVSAGIGVTPMLSMLDHLAAAGATRPVTVVHADRTPDHHAHRQEQLDLIRTLPGARLHLWYEEPGDRAPEASTGRADLTGLDLPADLTVYLCGPVPFMRAVRGDLLRRGVPAEAIHYEVFGPDLWLGQQ

SEQ ID NO: 14672 - protein, 434 aa, Streptomyces coelicolor A3(2) [sequence omitted]

SEQ ID NO: 14673 - protein, 310 aa, Streptomyces coelicolor A3(2)
MKTFTLPGTDMVVPNIVLGLMRIQDMDDDEVRTLVHTARDAGITFLDHADVYGTGSHGCERRFAEALKLSPSEREQFVIQTKAGIVKDGPYFDFSHEHIVESVNGSLEALGTEYLDILLLHRPDALVEPEEVARAFDELSAAGKVRAFGVSNQTPRQLDLLRKYVRQPIVANQLQLSVTHAPMIAQGIAANMQGLDQSVVRDDGIVDYCRLHDITVQAWSPFQAGFFDGPFLGSPRYPELNAVIDRLSEKYGVPAEAIAVAWITRHPARMQVVLGTTTPERVEAAALGSDLPLTRPEWYELFRAAGYTVP

SEQ ID NO: 14674 - protein, 332 aa, Streptomyces coelicolor A3(2)
MNSPEGDVDALRRGVDPLAEGDRPAGSPRVGVLSAREVPLGGPRAMRVRRTLPQRARTLIGAWCFADHYGPLEVATSGGMVMSPHPHTGLQTVSWLFGGEIEHRDTLGTHALIRPGEMNLMTGGHGIAHSEVSTPRTTVLHGVQLWVALPEEHRHTARDFQHHVPAAVQVDGAEVRVFLGSLAGLTSPVRTFTPLLGAEIVVEPRATLTLGVDAAFEHGLLVDSGDVRLSDTVLRPAELGYVPRGAETLTMVNETDAPARTILLGGPPFEEEIVMWWNFIGRSHEDIVKAREDWEAASTDRFGVVEDFPGGRLPAPTLPNAVIRPRRNPPTR

SEQ ID NO: 14675 - protein, 254 aa, Streptomyces coelicolor A3(2)
MGELAGRTALVTGASRGIGQAIATRLAAEGVTVIVHFGTDEAGAAATLDAMEHAGGSGFAVRAELGVDGDVETLFAGVEAGLGGRPLDIVVNNAAAAPAGALGVTTRAEFDHLFAVNVRAPYFIIERALPLLREGARIISISSVATRMANSSQTSFAMTKGAIETMTKTLAAQLGSRGITVNAVAPGATKTASNGAVFDVPGLTEQISGMTALSRLGAPDDVADVVAFLASDAARWVTGQILDASGGLFLGPCI

SEQ ID NO: 14676 - protein, 492 aa, Methanosarcina mazei Goe1
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 14677 - protein, 255 aa, Methanosarcina mazei Goe1
MKNLFDLTGRVAIVTGASSGLGVEFARALANQGADIAIVARREEKLKEVQKEIEKIGVTCRYYICDVMQTDQIKSAVEKIEKDFGKIDILVNNAGLGLVDAADKTSDEMWRNMIDTNLNGVFFFAREVGKVMLKQKYGRIINIGSIHSTVSMKGMPVTAYCSTKGGVLMLTKSLATEWAKEGITVNAIGPGYFALGMAEGVVADPEFAKIIEFMCPMGRAGQTGDLDTTVVYLASEASKYITGQIITVDGGWTAL

SEQ ID NO: 14678 - protein, 329 aa, Methanosarcina mazei Goe1
MFDIWKPEIFHGRRKEKNFFEGWYFKVVDHSEKNACAVIPGVSITGDPSKSHAFVMFLDARAQRMRYFRYPLDELKASDKKFELSIGGSFFSSERMNLTLGQGRGLITARISFKGTYPWPVKLLSPGVMGWYAFVPGMECYHGILSMDHSIEGFIEVDGIRTDFTGGKGYIEKDWGVSMPSSWIWMQTNHFDREGVSLSGSIAKIPWFGSYFTGYIFGFLYDKKLYKFTAYSGAKVTLLDVTADNTRIRLENKTYRLDIDADRSKGVDLPAPKLGEMTAKVNESLNSSINVDLLKKKGSGTELIYSGTGRNAGLEFVGNITELIKGLKK

SEQ ID NO: 14679 - protein, 353 aa, Methanosarcina mazei Goe1
MEIDYINGLKTDEIFGMSKYQSEINSRLGNIKLNRIEYPDISKTPGVNKIVEYFVYPFIVKKEVTKNNVKHVTRQDLAFLLELIDLKKTIVTCHDIIPIAYYHTQNPIWKLNAKGLRKAEKIITVSEFSKNDIIKHIRYPEDKIEIIPPAVNHNLYYQNRNKSILKKYGIKEDEKVILYVGAEEPRKNIQVLINSFDKLKSKISQIKLLKVGTPNYLGVREKLLKQIESLNLQKDVIFAGYVPESELAKIYNAVDLFVFPSLYEGFGIPPLEAMACGTPVITSNSSSLPEVVGDAAIIIDPYDANKFAEKMYEVLINDGLKEEIVRKGLRRSKMFSWEDSARKTLKVYKEFRP

SEQ ID NO: 14680 - protein, 676 aa, Methanosarcina mazei Goe1
MDMLIYLTPICALIGLIFAGISYKNVRNEGEGNELIKKITAAIHGGAMVYLNRQYRAIAVFVVFIAIVLALVLPNGVLTAACFVFGAVLSATAGYAGMLTATIANGRTTNAATRGIGPAFKVSFASGTVMGMSVVGLGLFGLSLSFIILGNIYTDMDLFTLLNIIAGFSFGASSIALFARVGGGIFTKAADVGADLVGKVEAGIPEDDPRNPAVIADNVGDNVGDIAGMGADLYESYVGSIIATMLLAASTAAATFPGIPVMNVVMVPLVIAAVGILASVIGTFFVRTNKTESSAIHMAFNMGLIAAIVLTVIASYVVTGHLLGGYGLNVFFSTVAGLVAGFLIGQITEHYTSYDKKPTLTVAHSCQTGSATNVITGFAKGMESTLWPAVIISIAIYIAFQLAGLYGIAIAAVGMLATLGISLSVDAYGPVADNAGGIAEMSHQKKEVRQITDTLDAVGNTTAAMGKGFAIGSAALTALSLFASYAIAVGLTSIDVMNPNVFIGLIIGAMLPFLFSSMTILAVGNAAGEVVVEVRRQFKEIKGLMEGKADPDYSKCITISTHSALKEMIPPGILAVIAPILVGLVLGAGALGGLLAGSVVSGFMLAITMSNAGGSWDNAKKFIELGNFGGKGSDAHKAGVTGDTVGDPFKDTAGPAINILIKLMSIVALVFAPLFI

SEQ ID NO: 14681 - protein, 105 aa, Methanosarcina mazei Goe1
MQMIRAIIRPGMEPKVVESLEKEGCISLTKMEVFGRGKQKGIHIADVHYDELQKTMLMMVVEDEHRDRVVQTIMEAARTGKYGDGRIFVNPVEEAYTIRTGKPGL

SEQ ID NO: 14682 - protein, 130 aa, Methanosarcina mazei Goe1
MEEKSVKEITAIIRMNRVQKTKDVLLECGFPSFTVRRVMGRGKQKGLCFEFNPPLPEPEKEAETCIHFIPKRMFTIVVDDENVNEVVRKIIEVNQTGHPGDGKIFVSSISEAYRIRTGESGEATVNKEMV

SEQ ID NO: 14683 - protein, 117 aa, Methanosarcina mazei Goe1
MVAMKYVIAMIRPERLDAVKRELQKIEVSRLTVSSVSGYGAQKGYMEIYRAMEYDANLLEKIKIEIAVNDEFLEPTIEAIKTGAKGSDGYVGSGKIFVLPLENVIRIRTNETGPEAI

SEQ ID NO: 14684 - protein, 479 aa, Methanosarcina mazei Goe1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 14685 - protein, 397 aa, Methanosarcina mazei Goe1
MSVEKYLTSFQLEIINTGTLSKGSPLPESAVKELMKEKSEKAFSEGFPGFRMNVSITRKGGSLNPDPEKLEENLKEINRDNERKLTYLCTFPLEELSGSELLRLVEEKGVLVKRKGGWECLMHTCNINGQKELETTLLRAKKDAEATNRAKNSFIMNMSHELRTPLNSVIGFSDLLLEGAFGPMNTKQSKYVNNILISGKNLLEIINNLLDISRLEAGEKTLKYEDVDVASLIGEVRMNLLSPASVKKINVELKIDPSVGNVEADISKLRQILYNLVSNAIKFTPARGKVVISACKKEGVLEVKVSDNGIGISEDSYEKIFMPFTQADSSAARGYGGAGLGLFIVRNFVDLHGGDISVNSEVGKGSTFTFTIPAKPENTSLQENETKKWNHLQKEKN

SEQ ID NO: 14686 - protein, 115 aa, Methanosarcina mazei Goe1
MTRMCKIEAIIKPLKLHQVKDALEEAGFASLTVTDVKGRGQQKGIVQQWRGKKYCVDLLPKTKIEIVVPEEKIEEIIQVIQSTAYTGEIGDGKIFVIPIETVVRIRTGERNGDAL

SEQ ID NO: 14687 - protein, 302 aa, Methanosarcina mazei Goe1
MKKRYKNPEKSGSCGNFIQAIKMTDKVQPLESLSKKPEEPKIVVNLRRIKRKIMVMSGKGGVGKSTVAANLAVGLALRGHRVGLLDCDIHGPTVPTIFGLESARPGVSEEGILPIEVLPNLSVMSIGFLLENKDSPIIWRGPAKMGAIKQFLEEVFWGALDFLIIDLPPGTGDEPLSVAQLIPNCDGSVLVTTPQDVALISVRKSITFSEKLNVPIIGLVDNMHGLICPHCGKPIEVFGSGGVEKASKDFNIPILARLPIEPGVAEMEDRGTVVQDQLKHGTEWQKNFDNVVDAVEKILEKE

SEQ ID NO: 14688 - protein, 347 aa, Methanosarcina mazei Goe1
MAEERHHTEHIPQWKKDEIENIKELIQSHKVFGMVRIEGILATKIQKIRRDLKDVAVLKVSRNTLTERALNQLGESIPEMTRYLDNQTALIFTNESPFKLYKLLEQTKTPSPIKAGAIAPEDIIVQKGPTSFPPGPILGELQSAGIPASIDAGKVAVKETKVVCKAGEAVPQKLATMLSKLEIYPLIVGLDLRAAYDDGTIYEPELLAVDESKYFSDIIRAAQNAFNLSVNTAYPTGATIGTLLAKAYAESKSLGVNAVILEPGVMDSLLAKAHVQMTSVASEAAEKDANAVDDDLREVLGAAASAAAAATVAAPAAEEEKKEEEPEEEEEDHAEEDGMAGLGALFG

SEQ ID NO: 14689 - protein, 401 aa, Methanosarcina mazei Goe1
MRVLEVCQEFPNRYYPQLGTFIKQSIDSIANQGVELTVISPKAFVLPFSAFPYHNFSKLPGIEHTEKYDLHFPRYFYAVPKKYFYPLTGMSYSYFVSGYAMKNINPKPELIHAHFSYPDGYGMMKLAKKWEVPLVISALGTIERKVAYEGSYTSKQIIEAMNFADRILSVSEDLKTHIVNLGIDENKVDVVPNGVDTEIFRPAGKEYARNVLNLPQEKKIVLFIGALRKIKGVDYLIEAAKSFVNKNTDLYMVGRDDGLRKSLEKRAEELKISGFIKFTGPVTHEEIPLWISAADMLVLPSLSEGRPNVVLEALSCEVPVVATDVGGIPELMVEGETGYLVPSKNPVQLSEKINKLLENESRREKMGKFGRKSIIQRGLTWESHAKKTVDIYSELLARSSK

SEQ ID NO: 14690 - protein, 222 aa, Methanosarcina mazei Goe1
MNSKKFKIHDSSKIYGNSVIGKDTVVLENVILGYPEHKILMEILKQNIKIEDFDFPGCTIGANSIIRAGSTIFSSVKTGNNFKTGHNVMIRENTQIGDNVLIGTNVIIDGNVKIGNNVSIQGNVYIPTNVLIEDNVFIGPCAVLANDKYPIRKKYELKGPVLRRGASIGANATLLPGVEIGEGAMVAGGALVTKDVPPWKLALGVPAKIQELPEDLKELNRI

SEQ ID NO: 14691 - protein, 398 aa, Methanosarcina mazei Goe1
MNEQGLSEREIFSYLENAKSEDTDYYRVFSSMCTRPHKIAIEANRLFIEANLGDLGLFAGAHKLEQEVVRMLGNLLHASSIDVPSGGLCQSSVCGYLTTGGTESNIQAVRGMKNLVTAGKKEFKGTPNIVIPASAHFSFDKVADMMGIEVRRASLDSEFRVDMASVEKLINENTIGLVGIAGNTEFGQIDPIDKLSEVALENELFLHVDAAFGGFVIPFLEKPQPFDFKVPGVTSIAIDPHKMGLSTIPSGALLFRSPSFLDSLKVSTPYLTTKSQFTLTGTRSGASAAATCAVMKYLGYEGYRKNVQYCMELTSKIVEEARKLGFEPLIEPVMNVVALKVPNPDLVRERLLKKFGWNVSITRTPRALRLVLMPHNSPEDIELFLEDLKKVTAEIKSP

SEQ ID NO: 14692 - protein, 213 aa, Methanosarcina mazei Goe1
MKVLYIFAHPEPKSFNAAMKDTAIAALKDKGHEVKLSDLYAMEFNPVLKASDFTERKNPDIFNAFLEAIKASKTGAFSSDIKEEMEKVKWADLLAFQFPIYFTSMPAIMKGWIDRVLAPGFGFNPITSSAYDTGLLKGKAAMLAFTTGAPKEMYSEGGAHGDIHRHLESITHCVFEYMGMKVLPSFIVYEASAMKQEKGIEELERYKKRISEL

SEQ ID NO: 14693 - protein, 884 aa, Methanosarcina mazei Goe1
MSKFVYFFGKDVTDGKSSMKDLLGGKGANLAEMANLGVPVPPGFTISTEVCVLYLKEGKYPEEVLRQVEEAIDKLEKLNGKKLGDPEDPLLVSVRSGARVSMPGMMDTVLNLGLTDKSVIGLANKVNDERFAYDCYRRFIAMFGDVVLGVEFRKFDSLIDDKKKELGVKSDTDLDSKALQELAERFKEVIKLEKGFEFPQDPKVQLQMAINAVFDSWNNQRAITYRKLNAIDDSWGTAVNVQTMVYGNRGNTSGTGVAFTRNPSTGEKKFFGEYLINAQGEDVVAGIRTPDYIDTLGNKIPEAYAQLVDICQKLEAHFKDMQDIEFTIQEGKLYMLQTRTGKRTAAAAVKIATEMVAEGLINKETAVKRVNAEHIDLLLHPRIDPKAKLEVIAKGLPASPGAAVGKVVFTAEDAEEMAENGEKTILVRTETSPEDIGGMAAAQGVLTVRGGMTSHAAVVGRGMGKPCVVGCGEISIDMKNALFMVNGFTIKEHDYITIDGSVGSVIIGKVDLIDAEINEDLKKLLIWADKIRTLGVRTNADNPADAALARELGAEGIGLCRTEHMFFGEDRIPAVREMIMAEDEKSRKKALKKLLPMQKEDFLGIFRSMEGLPVTIRLLDPPLHEFLPDKEELDTKLRELETSGDCGKIDGVKKVIQRVVSLKELNPMLGHRGCRLGITYPEIYNMQVRAIMEAACELTAEGMEVVPEIMIPLVGIVKELSLSREEVCKTAEAVMAEKGMKIDYKVGTMIELPRAAIVADQIAKEADFFSFGTNDLTQTTFGFSRDDVSKFVPIYQKAGILEHDPFAVLDQEGVGEIMKIGISKGRSVKPKLKMGICGEHGGEPKSIAFAHEIGIDYVSCSPYRVPIARLVAAQSTMEMRDAKK

SEQ ID NO: 14694 - protein, 420 aa, Methanosarcina mazei Goe1
MVSKNLPFTKEDILKIMEKYPTPFHIYDEKAIRENARRMKSAFKDIPGFKEFFAVKALPNPFILKILKEEGFGADCSSLPELILAEKAGMTGDDIMFSSNDTPAEEFIKAKELGGFINLDDISHIPYLEKSAGLPEIVCFRYNPGPLKEGNAIIGKPEEAKYGFTREQMFEGYRILRDKGVKRFGMHTMVASNELNSDYFVETARILFELIVEISKELGIQFEFVNLGGGIGIPYRPEQEPVSLEAVAKGVKEAYDATITANGLAPLKIYLECGRVITGPYGYLISQVRHLKSTYKDYVGLDSCMANLMRPGMYGAYHHITVFGKEKKAPAHKYDVTGSLCENNDKFAIDRMLPEVEIGDILAIHDAGAHGHAMGFNYNGKLRSAELLLREDGSVVQIRRAETIEDYFATLNFEQLKNFR

SEQ ID NO: 14695 - protein, 189 aa, Methanosarcina mazei Goe1
MSPKNCYRNNLEELKMATGPRYKVPFRRRREGRTNYHLRLKLLLSGQDRVVVRKSARNVQIQLLAPTPEGDITYSSAVSSELAKYGYTGATGNTTAAYLTGLLFGLKSLQKGYEGGILDIGLQASSAGSRVYAALKGIVDSGFEIPCSSDVFPSDERIRGEHIAEYREESSDLPEQFEATKEKIFAEFS

SEQ ID NO: 14696 - protein, 813 aa, Methanosarcina mazei Goe1
MELTAAYIKAGLEQNERCIWLVPDFQSAEKAKNLLSNSDLDIENRIEKSRLKIIPLKEKDDPSIKQTETSRIYFDWKAGNPQKEIIKFIHAGNWRYLRINLEVGAFGKSITTSLKELRCVLAENMPEKKIRPLFMIKEEDLSAEEVFNLIEAGEKLVIKREGKWKFLKIKQESPDKKFKTLIENSGDSILIHDMNGKVLEANHVACETFGYTRSKMIGKHIKDLRTSIHLIEFGQQIEKLKQTGYFTFEMDSLRRDGTVIPQEVNNRLIEYDGETAVLSIGRDISKRRQTEKALRDSERKYRMLFEEFPGGIAQFDKYGTIIVCNENFVNFTGSGENEKLIFNLLNPPEEKKQEEKGFTCLPEVPIHCDIKYISSLEDEIIPGEITYKPLISENSRFNGGIILVEDLTEVKRLEAVRLQQTETLRKLVGSIPVPAFCKDRNGVYIACNKGFENLLRVQKQDIIGKHIYDFIPHKIAENYHAMDIGLVKHKRNHVYETSLKFPDGSVHQVMLNKFIFSGVTEEDSVLLGIMIDITERKQAEERMLQAKMVAEAANRAKTTFIVNMSHELRTPLNAVIGFSDLLLSETVGPLNEKQKRYTENISKSGNHLLDVINDVLDISKLELGNIELYYETVDVAGIIEEVQRVLSPLSADKNIIIESYIEKDLKTVIADRVKLKQILYNILNNAIKFSSENGKVNIYAEPREDMIEISVEDEGIGIQESDYEKVFQPFVQIDESISRKHGGVGLGLALVKRFVELHGGKVWVKASPGGGSIFTFRIPKNPQNKIREYMSPVQIPYNLEIEREKEKIKEEAN

SEQ ID NO: 14697 - protein, 362 aa, Methanosarcina mazei Goe1
MPHPKTVEKMFECAGPIEYKLLPRLIHVTEAAAIAAAYQMGRGDKHFADQVAVASMRRMLNKLDMQGIIKIGEGERDEAPMLYIGEEVGTGVGDLEVDIAVDPLEGTNLCADGCPGSVAVMAMAERGGIFHGPDIYMDKIVVGPDVVRYEKEHPDERIDLDAPVRQNLEIVAKALGRNVEELVVVILDRPRHAQKITEIREAGARVRLVTDGDLMPGVATAIRGSGIHMVMGAGGSGEAVLTAAAIKILGGKILARLVLPSVANGKSKEKIQEEIEEKMPRLEKMGITLEKLNDVLDTERLVPGKDVIFSSTAVTPGHFLRETRLFGGGDARVHTISMGASGAVRFTDSIYIKDKQETPLYL

SEQ ID NO: 14698 - protein, 411 aa, Methanosarcina mazei Goe1
MTEKELIESGNMKMEWARNHMPVLAIIREKFEKEKPLKGLKVGMALHVEAKTAVLVETLAAGGAQVAISGCNPLSTQDDVAAALDTRENINCFAKYGCCTGEYYEAIDRVLDIEPDITIDDGADLIFKLHKERQEMLAKILGGCEETTTGVHRLHAMEKDGALKMPVIAVNDAMTKYLFDNRYGTGQSAWDGINRTTNLLVAGKNVVVAGYGWCGRGVAMRATGLGASVIVTEIDPIRALEARMDGHRVMKMSEAAKIGDLFVTATGNRDILTADNFKVMKDGAILANSGHFNVEIDMEALDSLAKSTRTVRHNIKEYDIGNRRINVIAEGRLVNLAAGDGHPAEVMDMSFANQALCVRYIAENKLSSGVHGVPRELDTYVAKLKLESMGIATDELTSKQECYMSGWECGT

SEQ ID NO: 14699 - protein, 454 aa, Methanosarcina mazei Goe1
MKIKSIDPYTEEVNWTYDALSFGDCEDQIEKSRAAFLKWGSLSVKERTAYISRVAEILRQNRRIYAGIITKEMGKPVRQSLAEIEKCAWLCDYYAENAAGFLEDELVETEAEKSYVTFEPLGVILGIMPWNFPFWQTFRFAVPTLIAGNVCLLKHASNVPGSALEIEKVFTGAGLPQDVFKSLLIDSRTAMEIIDEDLVDGISLTGSVRAGSEIGELAGRTIKPFVLELGGSDPFIVLEDADIDRAAEVGVRARFINTGQSCIAAKRFIVVEDVVVDFIEAFELHMQELKVGDPMDEETDIGPVAKKEFIDSLERVLKDAKKKGAEPRVYGEEHKKGFFFRPTIVPAASTDMKVLNMEVFGPIAPVVMVKDEDEAVKIANSTDFGLGAEIWSADLKRAEHLAKRIKSGFVTINGRVKSDPRLPFGGVKKSGIGRELSHYGLKEFVNIKTVVINK

SEQ ID NO: 14700 - protein, 299 aa, Methanosarcina mazei Goe1
MDRIISVVGHTALDYIVDVENIAGKNESSPVIDYEEYPGGGAANIAVAIAKLGGKSQLISPVGTDFSSSGYEKLLKEAYVDLSRLYTIEDRKISKAFIFTDREDNQTTYFYWGASSKFKELEPEPVDFVHLATADCVYNAKIAQIAGFVSFDPGQDLVTYSKENLETILAHTDILFANKHEIKRVSEMTGKSFSELRDMIDVIVVTYDAEGSIIYRGGDQWSIPVVSVKALDPTGAGDAYRAGFLLAYTREYSLPTCGKIGSTVASFAVQSRGCQTSLPTWEEMKSRYEASFGNLGAEI

SEQ ID NO: 14701 - protein, 702 aa, Methanosarcina mazei Goe1
MLPECDGYEICRILKNDPDYKFIPIIVISGFFEKPNKLKATRCGADDFIQKPIDRFELKTRIKSLIRIKKNYEALQESESRYRQFFNNSPAVTLLVDPESYRIVDANDPACAYYGYTYEEMTAKKISDINVFSEEKNKEITRQVFLEKRGHFYSCHKLASGEIRHVEVYINTVNIRDKELFFINVYDITASKKAERELIESEEKFKQVVELSVDGIIIGTDSGKIVDCNGAACRIFGYDKEEILKLQVIDLFPGDLNIIAHDITSCNKAAGEKTVERINQKKDGTSFPAEVAARRVKLGNEEGLIVYVRDITERKKAEKALKESEENFRTLVNNTLDGILILDFEGRVLAANAAIGKMLGMELEKVAGIDIMKYLAPESVPVAVEDQINVLNGRGGYLSVYKSTSCNGEPLWIEGLGTKIIYRGQPANIVVIRDITARKKAEEALINAKTAAEAANRTKSEFLTNMSHELKTPLNSIIGFSDLLIEGIAGPLNEKQSRYAGFISSNGKNLLNIINGILELSKVESEGDELTLQEFSVNESINKSISTALPQILKKNIKLNYNSDSDPLCIFADENKFRQIMESLLNNAVKFTPEDGLIDISSKQEGGIVTIKVKDTGIGIPEDSLDKIFKPFIQLESSLSRTFEGTGLGLTLAKKYVEMHGGNISVESKTGKGSSFKVELPVNRQKTVRTTIQKLDQQIVES

SEQ ID NO: 14702 - protein, 716 aa, Methanosarcina mazei Goe1
MFGINISKKIFIITLLIFAVLITSFALTYNMQLSNFLTLEEADTLNDVERLQNAIYTQQGYLDNMVQDWACWDDTYRFIEDRNQEYINVNLQNETLAGVKVNIMLFINETGSLVYAKSINFSTVEEKPVPEELLKLVESGQLSIKSEDDVIRGYVLLDEAPMFISCHPILTTKYEGPVKGTLVFGKYFDDDVLSSEENTDSSISILRVDEDLPPDFQGKFQQFTEAPDSTIVEPLSKEVIAGYFGLMDISGKSAVIIRTDFPRILYLNNENTLNYMYFFLLLTGLVTGVGVKFALDNFFVSRLIDIDNFVTKVRSEKDLSRRLPLEGNDELYRLSREINGMLSEIELAEQELKSQEREKKVLLDSLNELAIFVDPDFKIIWANKAALEHMKIDLEKAKGMCVKTTPDINGSLFGHMQLEKIFNSGNKESGEFSLENGTYWFVQAIPVTDDSGKIIGILGTFRDITERKAIEKLLQEKQVAEIANRTKSEFLANMSHELRTPLNSIIGFSDLLCDQIYGKLNEKQLKYTNNISKSGKHLLNLINDILDLSKVEAGKMELDYREFELADRLNSVKSLLSPIAARKNIKIEINVNKDLTTICADEARFVQIMYNLVDNAIKFSFENNPVRIEARRKGEFLETTVTDIGIGIKPEDQHKLFQPFSQVAAFSSKKFQGTGLGLSLVKQIVNLHGGYVWFRSIPGEGSTFAFAIPINGNKKD

SEQ ID NO: 14703 - protein, 805 aa, Methanosarcina mazei Goe1
MPEDKNKYIRWFEETTIEDIPTVGGKNASIGEMYRELTSKGVRIPNGFSVTASAYWHMLETGGILEKLKKTMEGLDTFDVSDLAKRGKVARDLILDAGIPDDIWQEIKGAYDRLCEQYGEYTDVAVRSSATAEDLPTASFAGQQETYLNIRGYPGLKDACIRCFASLFTDRAISYRVTHGFDHFKVALSIGIMKMVRSDLASSGVIFTLDTETGFRDVVFITGAYGLGENIVQGQVNPDEFYVFKPTFREGYKPIIQKKLGSKEIKMIYGRGDSKVLTRNVEVPEADRQRFCINDEEVLKLAEYAIDIEDHYSNKYDESRPMDIEWAKDGITGELFIVQARPETVQSQREKDVLETYVIEEKSEVLVKGRSVGDRIASGKARVITDVSDLPSFRPGEILIADTTTPDWEPVMKTAAAIVTNKGGRTCHAAIVSRELGIPAVVGAENATEVLNTGREITVSCAEGEDGLVYAGLLPFRKNTVSLKDLERPQTEIMMNLGNPESAFSFSMIPNDGIGLARLEFIITSYIKVHPMALVHPEQVKDPRELREIERLTRGYEKKEDYFIKQLARGVGMITAAFYPKPVVVRMSDFKTNEYASLLGGRYFEMEENNPMIGFRGASRYFDERYREGFALECRAMKKVRDEMGLKNLILMVPFCRTVEEAKKVIAEMEKNGLRRGENGLQIYVMCEIPNNVLLVDEFSEYFDGFSIGSNDLTQLTLGVDRDSEMLAAEFDERDPGVLKIMSMAVQGAKRNERHSGICGQAPSDFPEIAEFLVKEGIDSISLNPDSVMKITLKVLETEKELGKR

SEQ ID NO: 14704 - protein, 807 aa, Methanosarcina mazei Goe1
MITSESVAVDELEIRLKKQTTELKKFDKGISAEISESTQPEEDFLNSEEKFRILAENSPDIIVRFDIQSRQLYFRQAAVDIYSYSQEEIKGKTHNELGSDPEKAKFWKEHNEKVFSTGKTETMEFDCILPQRKKYYFNTLIAPEFVNDEVASVLTISRNVTDVKKTESTLKETLDNLEEMIKKRTEEIEKAYRSLKESEKCLAEAQKIAHLGSWNWNIVSNELYWSDEIYRIFGLSPQEFGATYDAFLSYVHPEDRDCVNNAVKGALEGKPYSIDHRIILKGGEERIVHEQGEVIFENGNVPVRMAGIVQDITERKKIEKALGMANAYNRSLIEVSLDPLVTIGPDGKITDVNRATEIVTGYFRSELIGTDFSDYFTEPEKAKEGYQYVFQKGLVRDYQLEIRHKHGHITPVLYNASIYRDENGRVTGVFAAARDITELKKAEEKIKALANAVESSNDAIITGTLDGTITSWNKGAEQIYGYLAEEVMGKNVSILEPDNLKGEIKQLFDKIKQGKKVKRYETLRLKKDGIAVNVSVTLSPIFDVSGNPVAFSGIARDITEKKITENLLHEKQMAEFANRTKSEFLANMSHELRTPLNSIIGFSDMLYEQAYGELNQKQLRAISNISNSGKHLLNLINGILDLSKIEANKMELDYKEFELASSLDLIRNILSPIADKKNIEIETGVDSSISKICADEDRFIRIMFNLVDNAIKFSFENSLVKIGTRKKGELVEITVEDTGIGIKTEDQNKLFKPFSQVNSFSSKKFQGTGLGLSLVKQIVNLHGGYVWFKSEQGKGSTFAFAIPITKG

SEQ ID NO: 14705 - protein, 428 aa, Methanosarcina mazei Goe1
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 14706 - protein, 854 aa, Methanosarcina mazei Goe1
MGIFSLRRWTELENTLVLYREAECDLEEKDRMYRALFEQSSDAVIISDGKKVLDINKKGCEIFGFGQKRPFNVSLMSFIQAEYLPELQQAFKETFRQGSSNFEMRYQKPEGEIVDIKVNLSLIDRKDNIVQLVAQDITVSKNIERSEQENRERLKAILDNTLCGILLIESSSRKIINANPIALKTAGYSDKELIGMTCYRLIDQHGEENCAALSLDQAGDLSESILLTATGKTLPILRSVVPVSIGGTGYFVESFIDLSDRKQAEEELLQAKIAAESANRSMSEFLATMSHELRTPLTAIIGFSELMLGGSTGEFDELNKKFLGNISTSGKHLLSLINSILDLSKIEAGKMELQSDYFSLQDIFSNTKNILSPLALKKNISMDFNVEPGFFVYADRTRFKQIMYNLVSNAVKFTQKGGSVEVLGIVSEKGVRVSVSDTGIGISKDEIKQLFKPFKQIDSTLSRKYEGTGLGLVLSKKFVEMHGGRIWVESEPGKGSTFTFEVPVKTLKSGEIFRAHETAETAHETAETCETNAIEAPVITGKAVESGKPVEPIVLNELTESGAEIPVKMPKMEDISVDFKSCGSDVSAPLVMVVEDDRLSRELLVFTLKEAGYRVVQAATGEEALSLAQKLKPFVITLDLMLPEMNGWDVLENLKKDSVTSGIPVLVLSITEKNDCKMLWGAFDHLVKPVDKSVLLSSLDRLKTNLKKDSPKILIADDQESMLELMSSMIEFEGYVISLAQGGKEAIDKASTEIPDAIILDLNMPDVSGFEVIKALKKNPQTVDIPVIVCTSKDLSMQEMKMLNSSVSFVMQKEDLNKRKLLELIRRLEPENCGIFTSPAYQEVFQSDSFRTEG

SEQ ID NO: 14707 - protein, 310 aa, Methanosarcina mazei Goe1
MVIIMANLRRVRKIRKSMPTIEGAGVHLKRAFGFRHVPEFDPFLLFDEFHSEKPEEYIMGFPRHPHRGVETITYVLQGEIRHEDSLGNRGVIRPGEVQWMTAGSGIIHQEMPQGDESGNLWGFQLWANLPSSHKMMEPRYQGVKSSRIPELLMEKGLKVRIICGEVNGVEGPVKEIATDPEYLDITVPAEEKFFHITAPDHTVFAYVIEGSGYFDREKDPCAFEVEGERYLHPAGDCIIYPETLVLYGAGDSIEVTAGDEGVRFLLMSGRPIGEPVAWYGPIVMNTKEELRAAFEEYRQGTFARDAERQT

SEQ ID NO: 14708 - protein, 321 aa, Methanosarcina mazei Goe1
MFPYGGNVFQEVVIMVDNLRKIRKIRKSIPTIEGAGVHLKRAFGFQHVPAFDPFLLFDEFRSEKPEEYSMGFPWHPHRGIETITYVLKGEIRHKDSLGNSGIIRSGEVQWMTAGSGIVHQEMPHGDENRALWGFQLWANLPAAHKMMKPRYREIKINRIPELFMGKGLKVRIICGEVNGVEGPVRGIVTDPEYLDVAVPPEEKFFHITVPGYTVFAYIIEGSGHFDREKGACAFEVEGGRYLDQAEDCIIDKESLVLYGDGDSVEVTAGDKGVRFLLISGKPIGEPVAWYGPVVMNTKEELRVAFEEYRQGSFTRYREKRK

SEQ ID NO: 14709 - protein, 707 aa, Methanosarcina mazei Goe1
MDISKKLLIVTFSIFALFTVLLITASHSILLESFSDLEEQDTAKNTGKIEQAIAWEIMSIDRTARDWAFWDDTYDFVNTLNPQYIESNLDGNTLYSLDLNLMLFVNKSGSLVYPMSVDLINETVVPVPEGIKEGIDSGVLIAHNDTDYIHGVVLLDNGPMLVVCRPILTGPGKSPHAGTLIFGKYLDDSYRMFLENRTKTSLELYTLNQQMPPDFQKAFNIIASGEKSPVIILGNERVAGYFALRNTIGEPVAIVRADYPRELYEQGEKTLYYIYIFLLISGIATGAATKFSIDRLLVSRLITIDNFLRKVKRDKDTSKKLEMEGEDEIHRLSKGINDMLFSIRLAEQELRASEYEKKFILDSLEEIVVLRDPEFNVRWANQAALKNRDLLMIENKEKALDIPVNDRKTPQELQLPGAPIWTDHEFTSPEGKTWLLRLKPICGETGNIIAYLETGVEITERKKYEIELFRAKQDAEVANYAKSEFLANMSHELRTPLNSIIGFSDLLHDKVYGELNARQLKAVGNISGSGKHLLNLINEILDLSKVEAGGFELHYSTFWLADVFAEVRDMLFPFAASKGIKLELEIEKDLPGIYGDRERITQVLSNLMTNAVKFSNENSCVRVKASQNNNFIEVSVSDEGIGIAAEDHDKLFKPFSQIDSSSSRKYQGTGLGLALVKEIVQLHGGAVWFKSEVGKGSTFGFSIPLHV

SEQ ID NO: 14710 - protein, 715 aa, Methanosarcina mazei Goe1
MAIDISKKVLIITLLIFTVLTASFTFTHNMQLSNFLELERADTFENVERVQNAVATEQSYLDYIVQDWACWDDTYQFIEDKNPEYIRVDLQNQTLSGINVNVMIFVNNSGKVVYVKSVNTSTAEEAPVPRKLLAMIEDGGLLTEGENDSISGFVLLDEDPMFIACHPILTTKYEGPSRGTLIFGRYFDDALLESFKKVTRSSLLMYRADEEMPQDFQNKIKNFSQNSDNIVVDPLNKNQIAGYFGLKDIKGDIALILRADFPRELYLHGERTLNYMYFFLLLTGLMTGVGVKFVLDKLFISRLVEVDDFVTRVRSEKDLSQRLSLEDNDELYRLSREINGMLNEIYLAEQELKAQAREKKVLLDSLNELAVFVDTELKIIWANKAALEYMNMGLEKAIGVCLKVAPGISGPLVEHLNLEEIFTTGEKKSGEYTAQDGRVWFAQAIPVPDEQGKIIGILQTCRDVTERKEAERLLHEKQIAEIANRTKSEFLANMSHELRTPLNSIIGFSDLLYEKVYGELNEKQARAVGNISRSGKHLLNLINDILDLSKVEAGKMELDYKEFELAGKLNAIKSLLSPIADRKNIEIDIEVDKGLTHIRADEARFVQIMYNLMDNAIKFSHENGLVKVRAERKGDLVEITVKDKGIGIKEEDQCKLFKPFSQVDSFSSKTFQGTGLGLSLVKQIVNLHGGEVWFNSKIGEGSTFAFTVPIDGNNN

SEQ ID NO: 14711 - protein, 390 aa, Methanosarcina mazei Goe1
MRKEPYDFPLDDYISREEFNKIKKFSRDKETPFLIVDLQKIERSYDELVEHMPFAKIHYAVKANPLDKVVLALKRKGSNFDVATIYELDQLIRLGVEPERISYGNTIKKEKDIAYAYDNGVRLFVTDSESDLKKLARRAPGSRVFFRILTESDGADWPLSRKFGSHPDLIYKLILKAEKLGLEPYGLSFHVGSQQRDIGQWDNAIAKCKYLFEAVAEKGIHLKMINLGGGFPAKYQSQAHDLETYAHEIRRFLHEDFGEELPEILIEPGRSLVADAGIIVSEVIMIAKKARFNQYKWVYLDIGKFGGLIETLDECIKYPIFCDKKGCAEEVILAGPTCDSMDILYEHHKYSFPHTMRDGNRVYIFTTGAYTQSYSSICFNGFPPLKAYVI

SEQ ID NO: 14712 - protein, 892 aa, Methanosarcina mazei Goe1
MPDLFKGLFGKKSNELFIILAVGLLFTFFASYFGLFESIVLFVEEYNPRKLGGLLTLSVYLAFALGIFSLRRWMELENALVLQEKTEESLKEKDKRYRALFEHSNDAIIILNGEKVLDLNKKGREAFGLGARELDNISIGSLLSEKDLPAVRDALKTTLENGSACFEMKFRKQNGEVIDVEVSSSFLSLEEGEIQCVARDITTRKKAEKNERESRERLKKIIDNALCGILLVDASTHEIVDANPAAVEAIGLPGHRLTGNVCHKFICPVEEGKCPITDFKQSVDKSERMLLNGKGESFPVLKSVVPVKIGENEYLIESFIDLSERKKTEEELLQAKLAAESANRAKSEFLTNMSHELRTPLTAIIGFSDVMLGGISGEFSEQNKKFLNNIANSGKHLLTLINNILDLSKIEAGKMELEFEMFSVSEVFNDTRAVTSALALKKDISMKYNVDSEILVYADRVRFKQIIYNLVSNAIKFTPDRGSVIVSALKTEDSVRISVSDTGIGISEENQKLLFQPFRQIDASINRHYEGTGLGLALVKKFVNLHGGRVWAESEPGKGSTFEFELPLKCGITSETRINNPDASKKIASSPAEKTVPENHVSDKPAFEKPEREENIKPEANNKSRLPEIIEPSGDSGEKNLVMVVEDDEMAKELLTITLSEAGYRVVTVSSGREALLLARELKPSVITLDIMLPGVSGWDILKNLKHDSATSDIPILVISMNDEKNCSILWGAVDHLIKPVEKERLLSSLQKVKGAINAKSSPRVLIVDDEPTIVELFSSIIKEEGYEPVCAYGGKEAVDKIRNGHPDIIILDLMMPHFTGFDLIKVLKENPETIDIPVIVCTAKELTFEEKDQLNRNVSYIMKKGNITREVLLSVLQKVEDKKFKSKQTNS

SEQ ID NO: 14713 - protein, 277 aa, Xanthomonas campestris pv. campestris str. ATCC 33913
MPSAARPRPVVFRTSGTRRGPITRLMSPGDLGQLVKPFVFLDLFTVKPTVGGAPMGMHPHSGIATLTYLMEGEVGYEDSTGKHGTLPTGGVEWMRAGNGVWHDGMPVGGASAVGFQLWVALPAAEENAPAQSLYLSPEQVPSVGPARVLLGRYGQAQSLIPAPADMTYLRVQLADGERWRYVPPAGHDVAWIAVHGGQLEAAETIASGHMAVFKDGEQAIEVTAVGPTTFVLGSAVKHPHDLVMGHYSVHTNAASLAQGEAEIRRIGAQLRSQGRLG

SEQ ID NO: 14714 - protein, 338 aa, Xanthomonas campestris pv. campestris str. ATCC 33913
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 14715 - protein, 509 aa, Xanthomonas campestris pv. campestris str. ATCC 33913
MNALPSAKSLNTDPQSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEAEALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 14716 - protein, 251 aa, Xanthomonas campestris pv. campestris str. ATCC 33913
MSNPFSLEGKVALVTGANTGLGQGIALALAEAGADIAAAGIQAPTETEEKVKAMGRRFVAIEANLISIEPVQRILDETLAGLGRLDILVNNAGLIRRTDAVDFSEQDWDDVMNVNLKSAFFMSQAAGRHFITQGSGKIINIASMLSFQGGIRVPSYTASKSGIAGITRLLANEWGSKGVTANAIAPGYMATDNTAQLRADQDRNKSILDRIPAARWGVPADLGGAAVFLASSASDYVNGAIIPVDGGWLAR

SEQ ID NO: 14717 - protein, 114 aa, Xanthomonas campestris pv. campestris str. ATCC 33913
MRMKLITAIIRPFKLDEVREALSAAGVSGITVTEVKGFGRQKGHTELYRGAEYVVDFLPKIKIETVVTDDRLDAVVEAIQNAAGTGKIGDGKIFVTAIEQVVRIRTGEIGADAL

SEQ ID NO: 14718 - protein, 267 aa, Xanthomonas campestris pv. campestris str. ATCC 33913
MTVPAFGLGTFRLKDQVVIDSVRNALALGYRAIDTAQIYDNEAQVGQAIADAGVPRDQLFVTTKIWVDRFSRDTLQPSLQESLRKLGTDYVDLTLIHWPSPKDQVPMREYLEALADAKAQGLTRAIGVSNFTIALTRQAIEILGADAIATNQIEVHPYLQNRTLIAFLREQGIHVTSYMTLAVGEVLKDPVIQAIARRHDATPAQVTLAWALQQGYSVIPSSTKRANLESNLKAQSLHLSEQDMAEIAALDRGERLANPKAIAPDWD

SEQ ID NO: 14719 - protein, 350 aa, Xanthomonas campestris pv. campestris str. ATCC 33913
MDVAVPALPLHCTFEAADWQRLAQHWHAVALSSEVSEAPFKAMLLDEPLVLYRLGAELVAARDVCPHRGVPLSMGSADGAGVVCAYHGLRFGAGGRCNHIPASPNQNIPAKMRLHTYAVAERYGLIWVCLAKPAGVSAAEVQIPPMPGWDEDGFQQIVCPGFDIAGSAARQLEGFIDVAHFAFVHTATFAQPDKREVPAYTTTETPTGFNADYLSSVANYSVDMPLPDVDPGFQWLRHFEVHLPFTATLTIHFPVPGKRLVIMNAASPVSKHKTRLLVPIARNFDTHLPVEDVHAFNLRVFEEDRAMVEAQRPEYLPLDPLLEVHIPADRSSIAYRRGLRSQGYSDFFLR

SEQ ID NO: 14720 - protein, 503 aa, Xanthomonas campestris pv. campestris str. ATCC 33913
MDPQPAGGSTMHALPSIATPTTATPAWHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 14721 - protein, 358 aa, Xanthomonas campestris pv. campestris str. ATCC 33913
MSQSKPLFPLNAWYAVAWDHEVKHALTPRKLCNLDVVLYRTTAGAVVALEDACWHRLVPLSMGKLRGDDVVCGYHGLVYNAQGRCVHMPSQETINPSACVRGFPVAEKHRYVWVWPGDPAQADVALIPDLHWSHDPAWAGDGRTIHAKCDYRLVLDNLMDLTHETFVHGSSIGQDEVAEAPFEVVHGDRTVTVSRWMHNIDPPPFWAGQIARHLNYHGKVDRWQIIHFEAPGTIAIDVGVAITGTGAPQGDRSQGVNGFVLNTITPETDTTCHYFWAFMRNYALHDQSLTTLTREGVTGVFGEDEAVLEAQQRAIEAHPDHAFYNLNVDAGGMWARRVIDRLIAREQRAGDLSLRMVG

SEQ ID NO: 14722 - protein, 252 aa, Xanthomonas campestris pv. campestris str. ATCC 33913
MSTPPPQPQRVLIAGGSRGIGLAIAQAFVQSGAQVSLCARNPEGLANAAAQLAADGAPVHTFACDLADAAQIERYVHAAAQAFGGLDVVVNNASGYGHGNDDESWQAGLDVDLMAAVRCNRAAVPYLRQSGNAVILNISSINGQRPTPRAIAYSTAKAALNYYTTTLAAELARERIRVNAIAPGSIEFPGGLWEQRSRDEPALYARIRDSIPFGGFGQVQHIADAALFLASPQARWITGQVLAVDGGQSLGV

SEQ ID NO: 14723 - protein, 327 aa, Xanthomonas campestris pv. campestris str. ATCC 33913
MSSPITLIEAITQALAWELEHDPAVLVLGEDVGVNGGVFRATAGLQQRFGSARVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLASEGISAEVIDVATLRPLDFDTIAESVAKTGRCVIVQEAPRTAGFGAEIAAQLAEKSMYDLLAPVERVTGYDTHIPLFRLEMKFLPSVERIVTAARRAVAAG

SEQ ID NO: 14724 - protein, 767 aa, Xanthomonas campestris pv. campestris str. ATCC 33913
MAARAGGLRGWSTLVALAALVAASAAALQWLGVAGPWRIVTTAASVLALVCGICTAVAAYRASRTLSALTRQLDDTNTAQARMQQELQRHGELEQELLRAKQAAEAASLAKGEFLATMSHEIRTPLNGIIPMLELISRGQLSLDQRDMLQTATGSSLQLLRIVDDILDYSKLEANKLELEITTFNLRELLDGVAQLMQRTAEGKQLRLGLDIEPSVRLLVRGDPIRLRQVLGNLIGNAIKFTERGSVDIQLRRLGETRAQHLLRFQVRDTGIGIAADQQARLFRSFAQADASTTRLYGGTGLGLAICKRIIDLMGGRIGVESEPGRGATFWFEIPLLKVIGDLQQTTGADAARVMVISSDARLSQRLKRLLDSWGISHVLMETTQEALERVRRHTDDEGFRCVIADHETLRYSARAVHRALARPEDLSGSRLIWLYGDEPVPDELQANATLVPRQSPDETLRALVLPPEPKPSVAPTLASAMIPEPLPPPVAHARDVRILLVEDNPVNLLVAQKLLGVLGFEADTATDGEAALSSMESTRYDMVFMDCQMPVLDGYAATRRWRAMETESGGRPIPIVAMTANAMAGDRERCLAAGMDDYLSKPVAREQLNACLQRWLPRQALLPGPSTGAPSADAESAASAAQARALPILESGVIDELYEVAGADTIRILQLFLEDAPGIIEGLEAAASNRDSMHLRDLAHTLKSSSANVGAQALANAARRIELAARTGTIERPSVMVALVIAEYARARLALLGQVTRLQAASRAAG

SEQ ID NO: 14725 - protein, 602 aa, Xanthomonas campestris pv. campestris str. ATCC 33913
MSFDPLSNGGLARRRFVHGLALGGVAAATGLWRSEARATPAYATPAVLRGGAAALQIGRMPVNLTGRARSAITVNQSLPAPTLRWREGDTVSVRVRNALADQFTSVHWHGLLLPANMDGVPGMSFDGIAPGQEYLYRFALRQSGTYWYHSHSMFQEQAGLYGAIVIDPLAPPPYRFDREHVVLLSDWTDLDPAALFRRLKQMPSHDNYAQRTVGDFVRDAREDGLRATLADRGMWGRMRMTPTDLSDVNANTYTYLLNGVAPAGNWTGLFKPGEKVLLRFINGSSMTYFDLRIPGLRMTVVAADGQYVHPVSVDELRIAAAETFDVLVEPIGQDAFTLFAQDMGRTGFACGTLAVRHGLQAPIPAQDPRAILTMQDMGHGDGMAHGAMHDMPAQHGASPADTHAGHTVQHDPSAHALQQHGHASASSRAPHHPASEDHNPLIDMRSNASAPRLDDPGVGLRNNGRRVLCYGDLHSLFDDPDGRAPGREIELHLTGHMEKFAWSFDGIAFASAEPLRLQYGERLRIVLVNDTMMQHPIHLHGMWSDLEDADGNFQVRKHTIDMPPGTRRSYRVRADALGRWAYHCHLLYHMEAGMMREVRVEA

SEQ ID NO: 14726 - protein, 309 aa, Xanthomonas campestris pv. campestris str. ATCC 33913
MSHFVHPNALCESDTIGEGTRVWAFAHVLPGARLGRDCNICDGVFIESDVVVGDRVTVKCGVQLWDGVRLGDDVFVGPNATFTNDLFPRSRVYPEKFLGTVVESGASIGANATILAGTTIGSGAMIGAGAVVTRSVPPNAIVVGNPARIVGYVSDKDATGSAPSPTGQGITDTAVPGVKLYRMPSFADMRGSLSVGDFETFLPFNAKRYFLVYGVPTQETRGEHAHKRCHQFLICVSGSVRVLADDGTRRIDVELNSPSQGIHLPPMIWGTQYKYSKDAVLLVFASESYDTDEYIRDYSDFKSLANAAR

SEQ ID NO: 14727 - protein, 480 aa, Xanthomonas campestris pv. campestris str. ATCC 33913
MNAVAKTVPHTDYKIADISLADWGRKELDIAEHEMPGLMSIRRKHAQTKPLKDVRITGSLHMTIQTAVLIETLKDIGANVRWASCNIFSTQDHAAAAIAATGTPVFAWKGETLEEYWDCTLDALTFTLPDGTLTGPELVVDDGGDVTLLIHKGYELENGSTWVDEPASSHEEGVIKALLKRVAVERPGYWARVVKDWKGVSEETTTGVHRLYQIAEAGKLLIPAINVNDSVTKSKFDNLYGCRESLADGLKRAMDVMLAGKVAVVCGYGDVGKGSAASLRAYGARVIVTEIDPICALQASMEGFEVNTIESTLGRGDIYVTTTGNKDIITVEHLQAMKDQAIVCNIGHFDNEIQVDALNALKGVEKINIKPQVDKYVFGNGNAIFLLADGRLVNLGCATGHPSFVMSNSFANQTLAQIDLWEKRDSYEKKVYILPKHLDEEVARLHLEKIGVKLTTLTKDQADYLGVDVAGPYKPDHYRY

SEQ ID NO: 14728 - protein, 636 aa, Xanthomonas campestris pv. campestris str. ATCC 33913
MNALAVRWNDWPITRKSLAVVTLPLLLLAVALMAIYSVERQNIAAENDVRQTLEVLSDLYEAHALLAETAAGVRGYRLVRRDEFLTPYRDAEPRLQRVAERLSQRITDPVQAQRFARIKPLFAEKMQGWRRLLAPDLSREEEIRQLWDGKYKLDILRAELRELRNYETAQLQVRTAKAQGLRQRNLIITLSAAMLGGLGAVFAVAWFASALSGRLRTLAANADRLGEGLPLAAQPRAGDELGQVGQRLAQASELLAARANEAQLARREAETANRAKTEFLSRSSHELRTPLNAILGYAQVLEMDLPEPGHRRHLQHILGAGRHLLGLITELLDIARIEADQLDLSPEPIAVRAAVHEALGLIAPDADKHGISLQPPAIDGPWTVRADAQRLRQVLLNLLSNAVKFNRTGGQVQVSAQPDGDQVRIVVADQGAGLTAAQIERLFTPFERLGAERSAVEGTGLGLALSKRLIEAMGGQIGVDSSRDGARFWISLPQGEPQSAEPARTLLPLSNAGSGVCRLLSIEDNPSNQALIRTLTERRPQWQLLEAASLAQARALLQHEVPDLILLDLHLSDGNGEELLRDLQAQPATAAVPVVVISADATSATLARVGNQGVRAYLTKPLDVAEFFAVIDRLLA

SEQ ID NO: 14729 - protein, 378 aa, Xanthomonas campestris pv. campestris str. ATCC 33913
MRYAIVTETYPPEVNGVALTVHGLETGLRARGHQVDVVRPRQAADSTPADTVLVRGASLPRYPGLKFGLPATRRLTRHWATTQPDAIYVATEGPLGWSAMRAARRLGIPVATGFHTRFDEYLPDYGAAWLQGTALRWMRRFHNQAEATLVPTRELQQFLRGSGFERVQLLARAVDSLQFDPSRRDAALRAEWGIEGEGFAAIYVGRIANEKNLPLAIRAFRKLQQLRPKARFVWVGDGPAREKIAHENPDFIFCGIQRGDALARHFASGDLFLFPSRSETFGNVTLEAMASGVATVAFDYGAAREYLRNGQTGAAVEDDAAFVQAALTLTENDDVRQRMGHAAAQAMKKLHPDNVVSDFEALLLGITAARGRYVVDAA

SEQ ID NO: 14730 - protein, 247 aa, Xanthomonas campestris pv. campestris str. ATCC 33913
MSKPLQGEIALVTGASRGIGAAIADTLAAQGATVIGTATSASGAAAIGERLAANGGHGRELNVTDAAAVDALIDAIGKEFGAVSILVNNAGITRDNLLMRMKDDDWQAIIDTNLTSVFRTSKAVMRGMMKARKGRIINIASVVGVTGNPGQTNYAAAKAGIIAFSKSLAKEIGSRGITVNVVAPGFIDTDMTKALPEDAKTALLQQIALGHLGQPDDIANAVAFLAGPPARYITGETLHVNGGMYMP

SEQ ID NO: 14731 - protein, 300 aa, Xanthomonas campestris pv. campestris str. ATCC 33913
MSSAKNQYAMQNPLTQFPQPTFPEQTQEAPGTIHELQPKADHGEQSYQGFGRLQGRKALITGADSGIGRATAIAYAREGADIVLNYLPEEEQDAAEVVQLIQAEGRKAIAVPGDLKDEAFCNQLVERAVKELGGLDLLINIAGKQTAIKDIADITTEQFDATFKTNVYAMFWLCKAAIPHLPPGASIINTGSIQSYQPSPTLLDYASTKAAIVNFTKGLAQQVAEKGIRVNAVAPGPVWTPLQPSGGQPPETIPEFGSETPMKRAGQPVEMAPLYVLLASQESSYVTGEVFGATGGLLLS

SEQ ID NO: 14732 - protein, 284 aa, Xanthomonas campestris pv. campestris str. ATCC 33913
MSESDTTHCPQVTLRNGRSVPALGMGSWNLVQGRHAPQQEIEALQTGQALGMRLIDTAEMYGNGRSEQLISQVIARGQPPYLVSKVLPSNASARGIARACEASLQRLGVRTLDLYLLHWRGGSDLAEVVAAFETLRDAGKIRDWGVSNFDVDDMQELWQIDGGQHCLVNQVLYHAGSRGIEFDLLPWCAQHAVTVMAYSPLGSRALLDHPVLHAIGARRGVAATAVALAWAIRSGQVIAIPESGTPAHVRANADACTLQLDARDLADLDSAFPPPTRKQPLDLL

SEQ ID NO: 14733 - protein, 304 aa, Xanthomonas campestris pv. campestris str. ATCC 33913
MQCVCHALGRHVMSHANEVPAIDAMAELESLRQQNQALREELDETNQGVLALYAELDQQAEQLRDVSELKSRFLSYMSHEFRTPLGSILSITRLLEDGMDGPLNAEQLKQVRFVSASTRELSEMVDDLLDLAKIEAGRVTISPGWFDLMDLFAALRGMFRPLTDANRTTLIFEDPPVLPMLYTDDKKLAQILRNFISNALKFTPQGHVRVFAQLQGDTHVRFSVQDTGIGIPAELHDALFEDFVQVDSPLQKRLTGTGLGLSICKRFAELLGGTVGINSVVGQGSEFFVVLPVTLAPQQEDGLA

SEQ ID NO: 14734 - protein, 1046 aa, Xanthomonas campestris pv. campestris str. ATCC 33913
MQNITTSRDRWIWVIAAGLMAGTLGVELVTPLGYAVWLTYFVAVGVTVFQNHVRVPLVVGVLSCVLLAIGFHLAPSSTNSSFSSVNRSIGGISFLAMALVVMQAIRARRQAETALWLQQAENTVEASLRGDQSPEALADAAVRALCDTLEAQVGALYRLEGERLRLTGGAALAEDVPSTLPTNLGQLGETLQRGSVRRVRGVDAGHLQIASSLGKSDCQELLLAPVTADGRIIGIVELGRTGAPGTAATREEELLARCGENIGVALRTALLRAQLVSLLEETQRQSEELQTQQEELRVANEELEEQSRSLQQSQSDLEQQQAELEQTNVQLEERTQALEAQKQALLVAQGQLVRNSNELSTASRYKSEFLANMSHELRTPLNSSLILAKLLADNKDHTLTAEQVKYAQAIHSSNNDLLALINDILDLSKIEAGHVELSDDTVAMSSVVQRLRDTFEPLARQKGLQLEISADAAAPTQLVVDNQRLQQILKNLLANAIKFTEHGQVSLAVQSHGNGRVRFVVCDTGIGIAREQSEVIFEAFRQADGSTRRRYGGTGLGLSISRDLALRMGGSISVDSEPGRGSCFTLELPVDGAPADAAAPAAAPATHLAPTPRSDTTQLFAARTSAVISAAPVTTPASNAAPSVRAEDDRDQRTRPGRLILAVEDETRFAQALVDLAHELDFDCVVAPNAEEALRLAAELRPSGILLDIGLPDASGLSVLERLKRNPATRHIPVHVVSALERSQIALELGAVGYLIKPATRELLAGAIRQLEETNARALRRLLIVEDDSALRANLELLLARDQLEIVAVGTIAEAMDQLGSATFDCMVTDLALPDGSGYDLLERMAGNDAVAFPPVIVYTGRALTRDEEQRLRRYSKSIIIKGVRSPERLLDEVTLFLHSVEASLPSDQQRLLREARRRDAVLDGATVLLAEDDVRNIFALSSVLEPLGVTLQIARNGREALEHLAKHEVDLVLMDIMMPEMDGITAMRQIRANRQWQDLPIIALTAKAMADDREHCLQAGANDYIAKPIDVDKLVSLCRVWCSRQ

SEQ ID NO: 14735 - protein, 347 aa, Xanthomonas campestris pv. campestris str. ATCC 33913
MVRDSVRGAVLRRPCSDPKACSPESASMTIVPRQPRVGAPFSDVLQRDAEVVLDGALATELEQRGCDLNDALWSARVLMEQPELIYQVHRDYFAAGAQCAITASYQATPQGFAARGLGLAQSQALIARSVALAAQARADHLAAHPQAAPLWVAGSVGPYGAYLADGSEYRGDYALPVAQMLDFHRPRIAALVDAGVDLLACETLPSASEITALRLLLEEFPQVHAWFSFTLRDAAHLSDGTPLAQVIPALDACPQVVAVGINCIAIEQVTAALQSLAALTSLPLVVYPNSGEHYDASDKRWHAGTTVACSLATQRAQWHAAGARLIGGCCRTTPADIAALVAARTAG

SEQ ID NO: 14736 - protein, 396 aa, Xanthomonas campestris pv. campestris str. ATCC 33913
MSGSSLRRVAVFGATGSIGASALDVIARHPERLRASVLSAGSKVDALLALCVLHRPAHAVIADAALYPALRDGLRAAGLTTQAHAGDQALDALAASDACDTVVAAIVGAAGLSSTLAAAAAGKRLLLANKESLVLAGELLTRTAAAAGAEIIPIDSEHSAIFQCLRSCDASRGVRRVILTASGGPFRGRQRAQLAEVTPAQAVAHPKWSMGPKISVDSATLMNKGLEVIEAHHLFGLPGEQIDVLVHPQSLVHSLVEFVDGSTLAQLGLPDMRTTLAVGLAWPERVESGVGGLDLLQQGRLDFEAPDTEAFPCLRLAWDALRAGGTAPAILNAANEVAVSAFLQGKVGFLAIPALVEHTLTTLQRQNADTLNALLFADAEARRTTERALAHHSLHA

SEQ ID NO: 14737 - protein, 620 aa, Xanthomonas campestris pv. campestris str. ATCC 33913
MVYRHGVQSPNAQWQAATLAGRRPHTGAVRSARNAARPTAAVASPGTPLLPLHRLPRRHTHASAAACGPFRTSNPVPRDGGQQAAAGTIGLVFCSTGLPLTTSTLPAPAADARLPRQIPFIIGNEACERFSFYGMRNILVQFLITSLLLQEVGAPERDAEAKHILHSFMIGVFFFPLLGGWLADRFFGKYTTIIWFSLIYCAGHACLALFEDSRSGFFVGLGLIAFGAGGIKPLVASFMGDQFDQSNKHRAKVVFDAFYWIINFGSLFASLLIPLALKHLGPSWAFGIPGILMFIATAVFWLGRKRYVRVPLPPKDPHGFGAVVRSALLAHAPGQGRPGLALAAISVLLALACLGLTEQLGLVICLCMALVLLLAGIGGGTWWQLERARGTHPDAAVDGVRALLRVLVIFALVTPFFSLFDQKASTWVLQGREMRMPAWFTASQMQALNPLLVMLLIPFNNLVLYPLLRRLGWEPTSLRRMTSGIAFSGVAWIAVGAIQVAMDGGEPMHIAWQILPYALLTFGEVLVSATGIEFAYSQAPPSMKGVVMSFWYLTTTVGNLWVLLSNVAVRNATVTSHIADTGLSEAAFLMFFFAAFAFLAALAFGLYARRYRMVDNYRPA

SEQ ID NO: 14738 - protein, 379 aa, Xanthomonas campestris pv. campestris str. ATCC 33913
MTHLPIPSAESSIPFSLPWLHPERAAKLTAALRERILIIDGAMGTMIQRHDLQESDYRGTRFAEGYDSAQGHVHGAGCDHAPQGHDLKGNNDLLLLSSPEIIAGIHRAYLDAGADLLETNTFNATSVSQADYHLEHLVYELNKAGAQVARACCDAVEELTPQKPRFVIGVLGPTSRTASISPDVNDPGYRNTSFDALRETYREAIDGLIDGGADTLMVETIFDTLNAKAALYAIEEVFEARGGRLPVMISGTITDASGRTLSGQTAEAFYASVAHGKPLSVGLNCALGAKELRPHVETLSQIADAYVSAHPNAGLPNAFGEYDETPAEMAETLREFAKSGLLNLVGGCCGTTPDHIRAIAEAVADLPPRQLPNALEQAA

SEQ ID NO: 14739 - protein, 430 aa, Xanthomonas campestris pv. campestris str. ATCC 33913
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 14740 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 14741 - protein, 726 aa, Xanthomonas campestris pv. campestris str. ATCC 33913
MKSPLPWLKRRLSGRADSEHAQNLIRIIITTLFISYLGWRYQHTHGDTLMATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVVAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 14742 - protein, 411 aa, Xanthomonas campestris pv. campestris str. ATCC 33913
MAIAFGDASMQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQGTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 14743 - protein, 1146 aa, Xanthomonas campestris pv. campestris str. ATCC 33913
MAIAAPAIVELLPEHRETTALLPHADESALALLSESPALSTALSLCLHAQVPMVLVCGEASHCLYNDACIPLLGALHPHVFGQPLATVTAQRLVLAGATDRQQHPEPSAWSCSPVLESGRPLGQLYIAAHPRGQPSQWHGNTLAATTLALPSPTDERSHDSFLLHLEDALQHVSEPRAIVDTSVRLLGEHLRVNRCAFGLAAEDHSVMHVISDYVQDMPSLKGDFPLEAAQGLRDALLENRTWFTTDAMAPGAPDYVVEQYRHSGLRASLAIPLHKHGQLVAAIGVHQRAPRQWASTDIELVRLVVARCWESMQRAKAQRQLAASEGRLRRLADTVPQIIFIADPAGQPDYFNQRWYEYTGLNPDTEASAAWQQAHSAAGLRMSGQAWALALNGERAYEIECELRRHDGQTRWHLARALPVRDEHGRISEWIGTYTDIHDRRGFEHKLRESEARFRALCETVPAMIWMADVDGNCVYWNPQWYEFTGQGEEQALDQGWWNAMHPDDAARVRHAFEQALDARGAFIAEYRIRRHDGQYRWCIDTASPHFGSDGRFLGHIGSLTDISDRKRIEDATASDRAILSLITTGAPLTVVLDAIALSVEARGETPLYCAVMVLDEEHQTLQFAAAPHLPRDYSGDFENAPIGPSGPPCARSAHSGLQVICEDIANDPRFEDHRALSAAMGIAACCVTPILGSNGAVLGTLNIYYAQPHLASLREQAMARSASHLAGIVIERTRVDAKLKASLQAETAARNQAEHASRVKDEFLATLSHELRTPLNAILGWSRLMQADAFEPAKLGKGLVVIERSARAQTQIIDDLLDMSAILSGKIRLQPEHFDIAGLARSTVELMQPTAQARQIRLELDAPLQGSLWFFGDAGRLQQVLTNLISNALKFTAPEGDVRVSLEVEEQRLRLCVRDTGIGIAADFLPHVFDRFRQADAGTTRRVGGLGLGLSISRQLIDLHGGSLGASSDGEGHGATFTVVLPFQHGVSDQRPAPEPAHTGPLPTAAHGRLDGVRLLLVDDDQDSREAVMHFLMLAGAQVQAAGSVDAAEAHLAAAHYDVLVSDIAMPLRDGYDLIRSVRSGRPELPRHIRAIALTAYVREEDRDRAIVAGFDAHMGKPVEPPGLIDLIERLVLPAGAVRTDPSA

SEQ ID NO: 14744 - protein, 792 aa, Xanthomonas campestris pv. campestris str. ATCC 33913
MNENILWLHELRLVDLARVGGKNSSLGEMIGNLAGLGVSVPGGYATTAEAFKDFIAHNDLSKRIFDKLETLDVEDVTALTVAGKEIRGWVIDAPLQPELDRDIRSAYEKLCAENGGGEVAVAVRSSATAEDLPDASFAGQQETFLNVTGADDVVHKVKEVFASLYNDRAIAYRVHHGFKHEDVFLSAGVQLMVRSGVGSSGVLFTLDTESGFRDVVFVTSSFGLGEMVVQGAVNPDEFYVYKPTLTAGKPAILRRSLGSKAIRMVYSDVPGERVRIEDTPVELRNTFSISDEDVQELSKQALVIEKHYGRPMDIEWAKDGVSGKLFIVQARPETVKSRSHATQIERFSLEAKDAKILVEGRAVGAKIGSGVARVVRSLEDMNRVQAGDVLIADMTDPDWEPVMKRASAIVTNRGGRTCHAAIIARELGVPAVVGSGNATDVISDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYINRLAEGIATLTASVAPNTVIVRLSDFKSNEYANLIGGSRYEPHEENPMIGFRGASRYVDPSFTKAFSLECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 14745 - protein, 171 aa, Xanthomonas campestris pv. campestris str. ATCC 33913
MSVSPDHHAQDAHLQIDQQWMTHALRLAERAERDYDEIPVGAVLVDPTGALLGEGWNFNIASHDPSAHAEIMAMREGGRRLANHRLIGCTLYVTLEPCAMCAMAMIHARIARVVFAASDPKTGACGSVFDLLADPRHNHRVQVSGGVLAAEAGLRLTNYFRAKRGKPPLVP

SEQ ID NO: 14746 - protein, 485 aa, Xanthomonas campestris pv. campestris str. ATCC 33913
MLRIQAEALTYDDVSLVPAHSIVLPKDVSLETRLTRDLRLKLPILSAAMDTVTEHRLAVAMAQLGGIGIIHKNLTPAQQAGEVAKVKKFESGVITEPFTVSPDTTIGEVIALTRARNISGVPVVDGSELVGIVTSRDMRFEKKLDDPVRHIMTKKDRLITVREGASDEEVLELLHRNRIEKILVVNDSFELRGLITVKDIQKKTDNPNAAKDGAKRLLVGAAVGVGGDTEQRIELLAAAGVDVVIVDTAHGHSQGVIDRVAWVKKTYPHLQVIGGNIVTGDAALALMDAGADAVKVGVGPGSICTTRVVAGVGVPQITAVDMVAEALQDRIPLIADGGIRYSGDIGKALVAGASTVMVGGLLAGTEEAPGEVELFQGRSYKSYRGMGSLGAMEKGSKDRYFQDASDADKLVPEGIEGRVPYRGPVGGIIHQLIGGLRATMGYVGCATVEEMRTKPKFVKITGAGQRESHVHDVQITKEPPNYRAG

SEQ ID NO: 14747 - protein, 321 aa, Xanthomonas campestris pv. campestris str. ATCC 33913
MCAWRPSSLHRSPMSDDVLAMLARQARSVPMRVHHLNCISTCPLGGHLMDGRTHGVLERGHLSCHCLLVETNAGLVLIDTGFGLRDVAEPRARLSAFFLALVKPDLREDMTAIRQIQRLGFDPRDVRHIVLTHLDFDHAGGLDDFPHARVHLMTRERDAALAQHTWMDRQRFRPQQWSTRGQWRTYDSTAGAAWMGLECVHDLQGLPPEILLVPLPGHTFGHAAVAVRTPERWLLLAGDAYFYHREMDPQPYCTPGLRFYQWMLEKDRTARLHNQQRLRALRQQHGAEVEVFCSHDVVEFERVAGLPAHLPAAALQHAPTA

SEQ ID NO: 14748 - protein, 250 aa, Xanthomonas campestris pv. campestris str. ATCC 33913
MELRMTSRVALVTGGTGGIGTAICKRLADQGHRVASNFRNEEKAREWQQRMQVQGYEFALFRGDVASSDHARALVDDVEAALGPIEVLVNNAGITRDTTFHRMTAEQWHDVINTNLNSVFNVTRPVIEGMRKRGWGRVIQISSINGLKGQYGQANYAAAKAGMHGFTISLARENAAFGITVNTVSPGYVATDMVMAVPEEVRAKIVADIPTGRLGRPEEIAYAVAFLVAEEAAWITGSNLDINGGHHMGW

SEQ ID NO: 14749 - protein, 454 aa, Xanthomonas campestris pv. campestris str. ATCC 33913
MSYDTVNPANGQVEHTQHTLDAAAIEARLAASAKAFPEWAALPLAERGALLRRVGEELTKRREDLQRIMTAEMGKLRREALAEIDKCAQGCAYYAEHAAEYLAPRAIPTEAQSSYVRYEPLGCVFAVMPWNFPLWQAFRFLAPGLMAGNVALLKHASNVPRCADAMKEVLDAAGIPPGVFDVLHIDNDQAAEVLRDDRIAAVTLTGSERAGRSLAANAGDQLKKCVMELGGSDAFVVLDDADLERTVQSAVQSRFDNSGQTCIAAKRFIVVDAIADQFVERFVAAAAQRVLGDPQQDATTLAPMARADLRDELHKQVQESVSKGAKVLLGGEPVAGSHAGYPATILDQVGPGMPAYEQELFGPVAAVIRVADEAEAVRVANDTTFGLGGSVWTADAKRGERVAQQLQCGAAFVNSVVKSDVRLPFGGIKRSGFGRELAEHGIHEFMNIKTIYVA

SEQ ID NO: 14750 - protein, 1364 aa, Xanthomonas campestris pv. campestris str. ATCC 33913
MPHGRWDLRRKYGRRASIGAVLLLSAGLIAAFLVGFAVHRHNELERERRFDMVVRVLARNISERMYTFEHGLRGARGAVIGAGSDVISRDRFTRYSRSRDYPREFPGVLGYGYIHRVAAADEAAFLDAARADGAPDIQRRLLAPWDGERFIVLYFEPESSGNRPLGLDVASEPRRRIAAIAAARSGQPTMTSPVSLSGYQTPSEGGFLVLLPVYREGMPLQTPQQRMDATTGWAYAPLSVKQMLESTLGDRDDVAISLSDREDTQHTFYRSGIAAPESMRRAAHTQLLPIYGRTWVLTARPTLHFIGSLNQNSPWLMGSLVLGTAILLAALLGLYFSNGLRREEVLRKQMELAALVSHSSEAIVAETPDGEITHWNPAAEAMFGYPADVAIGQDLTTLLSPQPYAMPQIDQDEAPPVAALSAAQTMRHRDGHQVFVLASKAPIIEHDNAVSGHSHFFRDISERVRSHQRIVDLNASLEHQVAERTSELVQFSVLQRAILAHAGYAIIATDSSGFVTMFNPAAEKLLGYSADDVIGRRKASQFIEADELQERALRLAEQTGTPVAGTLEAVAALTSLGRSDTSEWTYVSQDGRRLPVLLTLSTLRDDNDQVIGYLGVAVDLTEQKLHEKQLRLAMDAARSANQSKSDFLANMSHEIRTPMNAILGMLYLLQRSELPGAAQDMVTKIDRSARSLLEIINDILDFSKIEAGRIDLERAPFDLNQLFDNIADLMRSSLSAKPVEMIVEPLPRECRWLLGDALRINQVLVNLVGNAIKFTEQGEVVLSVRRFPSGDPNKIKLLFSVRDTGIGISKEKQSLIFSPFLQADTSTSRRYGGSGLGLTISRRLIELMGGALEVESVPGRGSEFYFVITLERTDPPKAQQEAALLPPESMPRVLIADDHDAALNNLVRIATELGWRVDAVASGQAAMQAIEDATEPYDIFLLDWRMPDIDGVAIARQVRARATPGRHPVIVMVTAYERRLLEQHPEQQDLDAVMTKPVTSAALHRLVEQLVDERPNARPATPTFVARRLEGAQLLLVDDSEINCEVAQRILEGEGAMVTVAHDGEQAVNTLKRAPDLFHLVLMDVQMPVVDGYEATRRLRQIPSLASLPVIALTAGAFRPQQEKALEAGMNGFIAKPFNVEELVTAIRHFLQPGSRRVSSLPHERAPAAGPEWAHTDPLLLDAARAQSLWREREPYERYLLKLLRDNPDPAETAAAHLRNNELPAIGALAHKLRGAAGSLALPALAGASGDLESRVEQGHDLTAALLALKDTMAQTTAAIHAFLQTSPSTQDTGQTGAALDDDSALILENALRSDDADKIDHALLICAPRLPPPLQEDLQRAVDDFDFRRAEATLRDWQANHPR

SEQ ID NO: 14751 - protein, 838 aa, Xanthomonas campestris pv. campestris str. ATCC 33913
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTDCVLGLATAQGGPTSHTAILSRTLGLPALVAAGGQLLDIEDGVTAIIDGSSGRLYINPSELDLDAARTHIAEQQAIREREAAQRALPAETTDGHHIDIGANVNLPEQVAMALTQGAEGVGLMRTEFLFLERGSTPTEDEQYQTYLAMARALDGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALQCETAEQVRALEAQREGQA

SEQ ID NO: 14752 - protein, 540 aa, Xanthomonas campestris pv. campestris str. ATCC 33913
MNDSGYGEPRAPLIGESQTLPVSKHRSDIFFAAVETTRMPMTVTDPYLPDNPIVFANRAFLEMTGYAADEIIGNNCRFLQGPETDRQAVADVREAIDNRREFATEVLNYRKDGSTFWNALFVSPVFDDTGKLVYFFGSQLDVSRRRDAEDALRQAQKMEALGQLTGGIAHDFNNLLQVMSGHLEFIQMMVSNGNGSPDRIAVSAEHAAAAAAKAATLTQQLLAFSRKQKLRGRVVNLNGLVSGMNNMAERALGGGITLRQALEERLWNCQIDTTQAEVALLNVLINARDAMANAERKEVMVQTQNVEITSHDLSMYHQLAPGRYVSIAVTDSGSGMPPEVVSRVMEPFFTTKEEGQGTGLGLSMVYGFVKQSGGTVRIYSEVGEGTTVRLYFPASSDYENALPSTKNRALDKGGNETILIVEDKEDVAVVAKMFLEGAGYRALSASSGREAIEVLEQHPEVDALFTDLIMPGGMNGVVLAREARRMLPKIKVLLTTGYADASIQRTDVGGAEFDVVNKPYTQKELLKRIRMLLDGPTGVG

SEQ ID NO: 14753 - protein, 693 aa, Xanthomonas campestris pv. campestris str. ATCC 33913
MPACDCDSSSQACGAATPRVHHGCCSHHFPLTPEPVCLPGLRMGRTIWLQHIDTMMIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDAALTTLPIGKAQLRHSGARIALLGFGATVDAAEAVGRELGLTVVNMRFVKPLDKAMLLELAKCHEAFVSIEDNVVAGGAGSGVSELLNAEGVLMPMLHLGLPDSFQHHASREDLLAEAGIDQAGIRAAVLKRWPQLMAKGQQALNAAAG

SEQ ID NO: 14754 - protein, 492 aa, Xanthomonas campestris pv. campestris str. ATCC 33913
MKAKPTLSFWQIWNMCFGFLGIQFGFALQNANASRIFQTLGAQVDDVPGLWIAAPLTGLIVQPIIGYLSDRTWTGWGRRRPYFMIGAVFTTLALLVMPNAPVLWIAAGTLWVLDASINISMEPFRALVGDQLPAEQRPSGYAMQSFFIGVGAIVASFLPWLLTRWGVDNTAPAGELPDSVRYAFYLGAAVLFLSISWTVLRTREYSPAELAAFEPAPAPAAAQLAATDQPSLQASVLWCLGGLLLAAAIAWQHGDRMLYVLAGLCIAYGVLLALARVLPRGGMLVAIMHDLRHMPQTMRRLAWVQFFSWFALFAMWIYTTAAVPQVHFGARDTVSAAYNDGANWVGVLFGAYNGFAALAATVIPLMVRAIGLRWSHLCNLWLGAAGLLSMLFIRDPYWLLLSMLGVGFAWASILSLPYALLSDSVPAAKMGVYMGIFNFFIVIPQLVAASALGFVLRVWLGGQPIYALAIGGLSLIVAGVCVVRVPSAQGGQ

SEQ ID NO: 14755 - protein, 312 aa, Xanthomonas campestris pv. campestris str. ATCC 33913
MSARIPTLDITRFDSDREAFVAELGAAYRQWGFAGIRNHGIAQSDIDAAYEVFKAFFALPDEVKRSYHVPGSGGARGYTAFGVETAKDSKHFDLKEFWHIGREIPDDSPYRAVMAPNLWPTEVPGFRERGYHLYQQLDQLGSRVLSALALHIGLPQDYFADKTDHGNSILRPIHYPPITSDDIPNVRAGAHGDINFITLLVGASAAGLEVRSNEGEWVPFTADADTIVVNIGDMLQRLTNHVYPSTIHRVVNPPGEEARKPRYSVPFFLHPNPDFLIDVLPSCISADNPSRYPEPITAHGFLEERLREIKLK

SEQ ID NO: 14756 - protein, 272 aa, Xanthomonas campestris pv. campestris str. ATCC 33913
MQGALAPHARIRNVIAVGSGKGGVGKSTTAVNLALALQQHGARVGVLDADIYGPSVPAMLGLSGKPDSPDNKSIEPLRAFGIEAMSIGLLVDQDTPMIWRGPMATSALTQLFNDTLWDDLDYLLIDLPPGTGDIQLTLSQKIPVAGAVIVTTPQDIATLDARKALKMFEKVEVPVLGIVENMAVHTCSNCGHREHLFGEGGGERMAAQYGVPLLGSLPLDIGIREQGDAGQPIVIAAPESAAAQAYLAAAARLSEELAKRPRASIPISASLL

SEQ ID NO: 14757 - protein, 296 aa, Xanthomonas campestris pv. campestris str. ATCC 33913
MTTLIAPRVHDIGGLQVRRAVPTLQARSVGPFVFVDHMGPAVLEPDHGIDVRPHPHIGLATVTFLWSGEIGHRDTLGSDQVIRPGDVNWMTAGRGIAHSERTPGPERAREHALHGMQTWIALPRSAEETAPAFHHHAATSLPQQRRNGVWLRVIAGRAYGEESPVRVFSGTLNVALDLDADAEIDLDTSHAERALYILEGEAQLDGADVPARHLIVPSAGTRGRLRAKTPLKAMLLGGEPLDGPRHLWWNFVSSSQERIEQAKDDWQAGRFGTIPGDDQEFIPLPETPAPKPVNYP

SEQ ID NO: 14758 - protein, 286 aa, Xanthomonas campestris pv. campestris str. ATCC 33913
MSDTTTSTAAHVLRTIRGMPTSDGAGVKLTRVIGTPQLPALDPFLMLDEFGTEQAEDYIAGFPSHPHRGFETVTYMLDGRMRHKDNHGNEGLLTPGSVQWMTAGRGLIHSEMPEQESGRMRGFQLWVNLPARDKMSDPKYQEYAPDKIPVAYPAAGVTVKVIAGAVGDVHGPIVQPATEPVYLDIALAPDTSWDYLLPAGHNAFAYAFEGAATVGEGEGARPLPAQELAVLGGGERLRLQAGAAGARLILVAGRPINEPVMRHGPFVMNTKQELMQAFVDFQEGRF

SEQ ID NO: 14759 - protein, 869 aa, Xanthomonas campestris pv. campestris str. ATCC 33913
MSASLSTDRWIVLKFGGTSVSRRHRWDTIGKLASKRANETGGRVLVVVSALSGVTNELTAIADGAADSAQRVAALELRHREFLAELELDADAVLGARLAALHALVGDARAASRTLDWQAEVLGQGELLSSTIGAAYLHANGLDMGWLDAREWLSALPPQPNQSEWSKRLSVSCQWQSDAAWRARFDAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGSAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDESDADGLLPILHAELIDSGAMPVSEGEVFGPRWRDIIGSVRPRPTPWWHAERAHLLTLSKAGTPRYVYHLPTVRARAQALAQIAAVDQRYYAIKANSHPAILMALEQAGFGLECVSHGELRRVFDTLPELSPRRVLFTPSFAPRSEYEAAFALGVTVTVDNVEALKRWPELFRGRNVWLRIDLGHGDGHHEKVNTGGKASKFGLSSTRVDEFVELARTLEVTITGVHAHLGSGVETGEHWRMMYDELAGFARRIGTVETIDIGGGLPIPYSAEDEPFDLELWAKGLAEVKAVHPGFRLAIEPGRYLVAEAGVLLAQATQVIEKDGVHRVGLDAGMNSLIRPALYDAWHDIENLSQLGAPADGSFDVVGPICESSDVFGKRRRLPAATAPGNVMLIADAGAYGYSMASTYNQRELPREEVIDAAAG

SEQ ID NO: 14760 - protein, 576 aa, Xanthomonas campestris pv. campestris str. ATCC 33913
MSLRLRGHAASRGNALGRARVRQSHTLEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARDRKSIEKWLASVAQGLLH

SEQ ID NO: 14761 - protein, 1194 aa, Xanthomonas campestris pv. campestris str. ATCC 33913
MRLFPSVLHWVVALLLLGLCVTVSPALATRAPVMPVPNQVTVADGLPSDVIGELAEDKQGYLWLASDDGLARFDGRNYRIWRMEEGLTGNAIWTICVDQDNRVWMGFENGGAGFLEAKTRTFKPLENAQFPELRQITVWSLAQTPNGDIWLGTAANGLYRRRPDGSMQQFLNVPGDSASLPADAVNALRVAPNGTLWIATPGGLVRWDGKQFTRVALPGSSQTVGRLRLERDGNTLWVTDGAGELFRLDAEGRFSPHPWQNMPANQRVYNVLLRDRRGRYWLDTNAGMALSETGTDVVRVPIYSFTAHSLVNRNWIDSYEDREGGLWFAALEGGLWHLLPHWDTFAVLAHRPKEPHSLANTSVLATVASASGGVWLVGSKGVLERLDPATGRLQTHLEHIDPLHPPDSVFEDTRGVVWIGVEGTLVRYDPRTRQVKRLPIRADVAPDAEGAADRPLWMAEDGQGQLWVSVLEYGLQLRDAQGSLVRTIVNGTHGLEPLTILDIGTGPDGQVWLSNNAGLRRWDPRADRFVPVPGAPSQATYVFRFAEGGVVWLGVVGEIRRYLWDGTQLKLLDTIGKDQEFPMVAPNGLVVHAGGVAWVSSQRGLIRIDPGSKLVRVYGVHDGLPNPLMINRTLVQATGGQIVGAAPDGVVVFDPTAMHPNTRRPPLLIERVGVRRGERGLDITGQEPLTILDDDRDLHIVARMPTFTHPDSSSYRFRLSGYDPDWIDVGPSGERLFSRLPPGDYTLEVQGRTADGIWSASQTLTFQVLPPWWRSPWGLVLLTLLALCVVVAVVLLYRRRLRRLNAWQLAVHKQELAEQASLAKTRFLATLGHEVRTPMTGVLGMSELLLKTQLDHKQRSYTESIRRAGSHLLRLVNDALDLARIESGRLELDLQPFSVRQLVAEVEALMAPLAQERGLRFSLEVGLLGDITASGDPTRIRQILLNLLSNAIKFTERGVVGLKLSTLGSYQGLRFEVADTGPGINADQKARLFQRFEQGDGAKTTSRYGGSGLGLAICQELAMAMGGHIEVISRLGAGTRFVVDLPLRWVASNAVLAGEVARDSANVAPLRILLVEDEPTIAEVIVGLLRAQGHSVVHAPHGLAALTEAADNAFDLALLDLDLPGLDGFALARQLRVFGYDMPLIAVTARSDEAAEPTAQQAGFDSFLRKPLTGDMLADTIAEALRRVRPREEL

SEQ ID NO: 14762 - protein, 1180 aa, Xanthomonas campestris pv. campestris str. ATCC 33913
MRKHASWVLAAVLLLMGASALAAEQIETPRMRRFGPGDGLPSRMVLALAQDRQGYVWAATSDGLARYDGIGLQVWQHDPLSARSIPGNEVETLLVDDRDRVWLGINGSPLAMFDAEREGFVSFPAVSNACAGQVWALAQAQGALWIGTSNGGLCRREEDGRLTVFRATPDAPDGLPSDTIMSMLTDARGRLWIGTGSGLVMRDGERFVRIAPERLSATVFKLSKDPDGTLWVGSSKGQYRVTPAGVLEPAPWKGAENVRAGTVVHDVHGGYWVAAADGFFRVAPGETALRVMDGDRGSGFLTAESGVLDLLQDRQGGLWLGLISQGLAYLPPDWQRFSTILQTQGKPLESLYLVNAAADGDSFLVTTGDGVYRLGAQGDVVPVVHSAALGGDTVQSVLPNADGSLWIALRDDVTHYVPATGKKRRLGLQVDQDKSQRPELMARGIDGEFWLSIVGGGVQRRAADGRLLAEFRFGTDLSEPGGMVQQLTIRPDGSAWVAAGDDPWVWQGERFRRVIDDAEHEVYALAFVSPREFWTGRPGALERYGWDGHKATLLERVGHAQGMPATEIRGLALGGTDTVWATTSRGLFAYRRGQPQVRMFGQRDGLPDSEFSMRPPVTGPSGQVLALTTSGIVLFDPTRPFAPVPQAQLVIQSVQVRRNDAERPQQVPHKRPIVLQARDRDLRISARLLSFVDPGLARYRYRVDGYDERWVEQGATGERVISRLPPGDYQVQVQARAGTGDWVAAPALTLQVQPPWWMSPAAQMVAVAVCLLLFGLGVWAWRRRVRRQQEWVLARQRQQLAEQASIAKSNFLATLGHEVRTPMTGVLGMSELLLATPLDAKQRGHVDAIRKAGAHLLRLVNDALDLARIEAGKLELVQQPFEPSQLTQELADFMHPIVEARGLRFHYRNQLPAALVVVGDATRVRQILINLLGNAIKFAERGEVGLTVSQHGDCLRFKVRDSGPGIGPEQQKRLFQRFEQGEGARTNARYGGSGLGLAISQELTVAMKGKIRVRSRLGVGTQFTVDLPLPIDRSPLRPVAGEARIPAGAPLRILLVEDDPTVAEVISGLLAGRGHRVVHAAHGLAALSEAVDGEFDVALLDLDLPGLDGFALAAQLRRLGHAFPLLAVTARADGDAQTQAQAAGFDGFLRKPVTADMLVEAIAAVQAVARERDRATPLLG

SEQ ID NO: 14763 - protein, 1186 aa, Xanthomonas campestris pv. campestris str. ATCC 33913
MRLLLFVVLAVLAGVPALAEVPAIPRFRIVGPADGLPSTMITAIAQDRAGYLWMTTGDGLIRYDGAGFKVWRNDPADPRSLRSNLLQAIYIDAQDRIWLALGGAGVAMLSADRATLTAYLPEKVPELSFGDVYAIAGRGDEIWFGMSTGNVLRLDAKGTFTSLDLAKMDDPLAPSAVYALALDDRDRMWIGTLGGLAYHDGLAAHRVHPDGDDSGINALQWVGQRLWAATDTGLRYMDPSGVWHTPSWAPMFAAGNRVWTVADAGDGEFWLGTEQGLWHTRPGQPPVPVNNGDSPLVSNRHVTTIWRSRHGGIWVPLHGRGLAYLREDWRRTAAFKQVNDQGKGLSCSLAPAARSGGLWQFDGNGRLLRYDTSSGALIQTGIQAADLGTMQITTALEDSRGKLWLASGEYGLSRLDLRTGALEHFSDEGPAEAALWIGEPGDGTVWAAYEQVIQQRDLATGRLLETIDQQHPHGLTEVVSPQIRKGPDGRMWLSAFGGMYAWQAATRRFVSVPGLKTDETLQAFVVEDATHLWLYRAGSLERWSSDGAVWKRERRIRSAEGFPAMDAYGLERDGVGRLWMSGPRGLWRIDPRTPQARIRSFGVRDGLTSLEFSHRCLMMARNGVLVGGTADGYTVLIDTQAPDVPSFTPAMRLETVSVQLADRRRMLPIRGGFSLSPDDRQLRINMRLLSFVDPMANRYRTRLSGFDTGWVDHDASGMREFSSLPPGDYVLEMQGIDPLGNASKVQTLEFIVNPPWWRSRFGIAVMVLVGMMLGVLLAAAYRRRVRMRAQWQLAQHKRELAEQASQAKTRFLATLGHEVRTPMTGVLGMSELLLQTPLDGRQQGYASAIQSAGKHLLRLVNDALDLARIEAGKLALDDRDFDLRQLIRQVVDLVRPSAEQKQLAFECHLDESLPRALHGDANRVQQILLNLLFNAVKFTERGQVRLRVLPLQAGGGGIRVEVSDTGPGMSEEQRGRLFQRFEQAEGGRTTTRHGGSGLGLAICRELAAAMGGSVGVSSALGQGACFVVELPLRWVSTPAPSTTAVARAVPPVHQAPLQLLLVEDDVTVAQVIVGLLQGRGHHVTHVLHGLAALAEVSARSFDAGLCDLDLPGLDGAALVAQLRARGVCFPIVAVTARADADAEPQALAAGCNGFLRKPLTGDLLAQALAQVLADDAMDKAPPETPV

SEQ ID NO: 14764 - protein, 454 aa, Xanthomonas campestris pv. campestris str. ATCC 33913
MPMNGQSSSRRSVAHLAGALRSSPPLAWSFLYFFCLLSGYYVLRPVREAMGASADVAAIFPAGMIAFFGAHGMPLKDFTLQVLFTCTFLITLLLQPIYGALVSRYPRRVFLPVVYGFFIATLLLFYVLFDTGVPGRGMAFFLWTGVFNLFAVAVFWSFMADVFSNAEARSYYGYIGAAGTIGAFLGPILTRTLVERIGIAHLMLVSAGFLGMCVVCLLRLRLWAVAREQERQVTSGEVPMGGDVLGGLKLIVREPLLRWLAVMVVFGVGVGTLLYNEQAALVRRLYTDAAASTAYYANIDLAVNALTLVLQLLVTRALLSRFGIAPALLIPGAAIIFGFAVLSASPLPMMLAIVQVMTRSSEFALAKPARETLYTRVDREWRYKAGATIDTVVYRGGDLSVVWIHKVVSAFGSSVVFGVGVLIACGMTVGALGVLHEARKLPAERDAAARRIRE

SEQ ID NO: 14765 - protein, 785 aa, Xanthomonas campestris pv. campestris str. ATCC 33913
MTDQTRLPNTSSLTHPRPDPAVILATDLDGTFLAGSAEHRHQLYRLVDQHPEIRLIFITGRGLEAVMPLLTDPTIPRPDYVVCDVGATVVDGHTLQPLQPLQSMIDAHWPGEQVVAQAMRAFPQLQRQDMPQERRCSYFCDPHTLAPLRAQIEQTARALGCDVLYSADRYLDILPPDTDKGRTLGALARQLELPRERILVAGDTLNDLSMYLAGFRGVCVGDSEAALTQATAQLDATYHASAPGCGGILEAIAHFGLLADDDPHVPAVQAPRKGGAELVMVYHRLPYDEVVEHGELVRRAPRSPNGIIPSLLSFFEGGQRGSWVAWSVDDPKRGPFQTHTEVDAQRYPTLTAARVPLSKSEVDIFYKRFSKEAFWPMLHVFWERARFREDDWQVFLAVNRKFAQATSAEAAHGATVWIHDYNLWMVPAYLRELRPDLKIAFFHHTYFPSADVFNVVPWRREIIGSLMCCDYVGFHIPRQVENFVDVVRGVMPVERLAQESCAPRFLTYGCAVGLDTMTTCLRVADRDVALGAHPVGTDLRRIRAALSKPDVRNDIFKLRREIGARKLVLSVERLDYTKGTLAKLEAFERLLDSQRQLLGKVTLLMVCVPAAREMTIYRTLQTQIEQAVGRINGRFSRLDWTPVRFFAQALPFEQVVAHYAAAQVMWITPLRDGLNLVAKEFVAVQGIEGGSGVLVLSEFAGAAAELKGAVLTNPHDPADLAAGLLQALAMPDDEAAGRLRQLYDSVEYYNIDHWGRDFLDAVARSRGAHARVPLAAASTVAEPVA

SEQ ID NO: 14766 - protein, 439 aa, Xanthomonas campestris pv. campestris str. ATCC 33913
MSSTAPPLSFARILALNAGFFGVQYSFGLQQSNMSPIYNYLGADHASLPYLWLAGPITGLVLQPFVGALSDRSVTRWGRRMPYMVLGALVCSLCLLAMPFSTALWMAVCLLWVLDAANNVAMEPYRALVSDVLAPPQRPLGYLTQSAFTGLAQTLAYLTPPLLVWFGMSQDAANAHHIPYVTIAAFVIGAGFSAASILLTARSVREPVVPAAEIARMRKAGTGLGATLREIGSALRDMPPTMRQLAPVMLFQWYAIFSYWQYIVLSLSTTLFGTTEANSHGFREAGLVNGQIGGFYNFIAFLAAFAMVPVVRRVGPKYTHAACLLAAGVGMWVLPGIENRWLLLLPMIGIGLAWASMMGNPYLMLADSIPPERTGVYMGLFNLFIVLPMLIQIVTLPLYYEPLLHGDPRNVIRLAGALMLAAAVAMLCVRIRKPKAVAA

SEQ ID NO: 14767 - protein, 369 aa, Xanthomonas campestris pv. campestris str. ATCC 33913
MKSRAAVAFGPGKPLEIVEIDVAPPQAGEVLVRITHTGVCHTDAFTLSGDDPEGIFPSVLGHEGGGIVEQIGEGVTGVKVGDHVIPLYTAECRKCKFCLSGKTNLCQAVRATQGKGLMPDGTTRFSYNGEPIFHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEQINEAFDLMHEGKSIRTVIHF

SEQ ID NO: 14768 - protein, 659 aa, Xanthomonas campestris pv. campestris str. ATCC 33913
MNVSEPQLAPVRTLRPVFVLAATVVCTFALLVALFPLDAGRILLDAQTWASRNVGWYYLLAMTLYLVFVLGVALSSYGNIKLGADHDEPEFSYLSWAGMLFAAGISITLFFFCVSEPLTHYLQPPQGGTGNGEASARQAMQLLFLHWGLHGWGVFALAAMALAYFAFRHNLPLALRSALYPLIGKRINGPIGYTVDALGIVATVFGLGADMGFGVLHLNAGLATLFNVPHTHWVQVALIVAMMGAAILVAVSGVEKGVRWMSDINMLLAIALLLFMLFAGPTHYLLNALMQNLGDYLGSVVGKSFDVYAYGGRPDWLGNWTVFYWAWWIGWAPFVGLFIARISRGRTIREFVLGVLLIPLGFTLAWLSIFGNSALDQLLHHGQAAWAQQAIDAPQTVLYSLLQDYPWSRVVITITVAISFVFFVTSADSGTVVLSTLSSHGGEPHDDGPRWLRVFWGVLTAVVTAGLLLAGSMDALKSAVVLASLPFSAVLLLMAWGLSRALSEESQRKRAQLYNPSPLIGQSRDHRGWRQRLGQAMHFAARDEVYRFMHEQVRPAIEAVAAQLQDEGWQVSSRLDDADMEISVDHGEQQGFRYQVVMRGYLTPSFAAQRLRNQRYYRAEVYLFEGSQDYDLVGYSREQIINDIIDQYERHLQFLHLTR

SEQ ID NO: 14769 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 14770 - protein, 368 aa, Xanthomonas campestris pv. campestris str. ATCC 33913
MKTRAAVAWGPHQPLSIEEVDLQPPRPGEVLVRLVATGICHGDAHALAHAPASSFPAILGQEGSGVVEEVGIGVTSVRVGDHVIPLDMPECGVCKFCRSGRTNLCQAIRSSQERGLMPDGSSRFSLDGRPILHHMGTSTFSEYTVLPEIAVARIHPDAPLDQVCLLGCTVTTGVGAVLNSIHVRPGDCVAVFGLGGIGLSVIQGAVLAQAGRIIVVDIAPGKFALARALGATDCLDPRDYGAPIQQVIVDLTDGGADHSFECIGDVGAMRAALECCHKGWGESVILGVADGAQEISTRPFQLVTGRVWRGSAFGGVKGRSELPGYVERYLRGDLQLAPLITRTLALDDINQALADLRAARGIKSIVLY

SEQ ID NO: 14771 - protein, 225 aa, Xanthomonas campestris pv. campestris str. ATCC 33913
MSATTPLPFWPQAVIFDMDGLMLDSERAITACLAQAADEHGLQIEPAFWLRMVGTGDAACRRLLGERIGTTAMEHVLARCQGLYDAAVSAGIAHRPGIIALLEFLGAHGMPRAVATSTQRPLALRKLAASDLLWRFDAVCTASDVAHPKPAPDIYLLAARTLGVDPAQCLVLEDSPTGVRAALAAGMAPIQVPDLLAPDAEVRALGHRIVASLMDAQTLLEARLA

SEQ ID NO: 14772 - protein, 630 aa, Xanthomonas campestris pv. campestris str. ATCC 33913
MVFEGDRPTDYIFRVTNEAFQRYTGLSEVANVSMRSLRADHEQEWFDRYGHVALTGNRIHFEMQAKALNRWYSVDAFRVGPPELKRVAVLFMDITERKRVERELAESEARFSALADGLPMPVWVLDAQGVVRFVNSAYGEFFGVDISSGTVSAWSELLHPEDVPVFQFELAASLEEQRGLHALVRARRHDGQWRWIEMTATPRYSADGRFIGLAGSSPDVTEQREIALAREQLLESERSARNEAESMARLKDEFLATLSHELRTPLTTILGWSELLLQRVEEGHPNYKGLSVIASSARAQKRLISDMLDLSSMLLGKVQLEVESLDLAEQVREALGAQEPVAEGKDQVLQLHVPPTPCLVLGDATRLQQVFWNLLSNAIKFTPAHGRIDVTVEHDDGHFIVSVRDSGDGIASEFLPHLFGRFRQADATTTRQHGGLGLGLAIVQQLVEMHGGQVGATSGGRGKGATFTVRLPEHQPDQAKRPRLELRRRLMSEQIVEARALNGLRLLAVEDQPDMLDYLRRLLEEQGAEVVTAGSATDALALIDHRGYARFDLMLTDIGMPGMDGYGLIRTVRENMGLDATALPAVAVTALARDDDRQRALASGFQEHLAKPYSVAQLVTAVRAAREPAE

SEQ ID NO: 14773 - protein, 583 aa, Xanthomonas campestris pv. campestris str. ATCC 33913
MRCGGSTPARKRGMFHHRCRVAVPHALPRRGRFFSGFCMHSIDVVLAMLLAVAASGYLIRILPFSLPLPLVQIALGAVVSGVFDAGHELEPELFFLLFLPPLLFLDGWRIPKQGLFRDKAAILELALGLVVFTVVGAGLLIHWLIPAMPLAVAFALAAIISPTDPVAVSSIASKVQIPKRLMHILEGESLLNDASGLVCFQFAVAAVLTGTFSVATASLTFLWVALAGLGLGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNLFKAQRRGEAHVSPPWRIVVAVSLAGVRGAITLAGVLTLPLVLEDGSPFPARQLAIFLAASVILVSLLVASVALPRLLRGLELPEEEDEQLKEDLAVKAASQAALEAVEKLRQRLVEDSAHAERYNAAANQVSQRYQRKLGAVDMAETDPEEAGAFEQALRQFRHAALVAERNELFKLARRREISDDLSRRLVRNLDLIESRKRA

SEQ ID NO: 14774 - protein, 288 aa, Xanthomonas campestris pv. campestris str. ATCC 33913
MPVPNYPRPPFKPQQQGFPGKTDKMDPRPDHGEDSYVGHGQLKGKRALITGGDSGIGAAVAIAYAREGADVAIAFLPDEQEDASRIGALIEKAGVRALLVGCDISDPNQAASLIDKVNSEFGGLDILVNNAGYQKYFQSFEEITLDEWRKTFDTNVHAVFNLVRLSVPLMKDGGSIINTASVQSKKPTPNILPYGATKGALANLTIGLAGVLAEKQIRVNAVLPGPIWTPFIPAGMDEESVESFGSQTPMGRPGQPVELASAYVMLASDTASYTSGTLLTISGGAVTL

SEQ ID NO: 14775 - protein, 624 aa, Xanthomonas campestris pv. campestris str. ATCC 33913
MANERPAQQSDIKLLISKGLEQGYLTYAEVNDHLPDDLVDPEQIEDIISMINGMGIDVHEVAPDAETLLLNDGNTGNREVDDTAAEEAAAALTALDTEGGRTTDPVRMYMREMGTVELLTREGEIAIAKRIEEGLSQVQAALGTFPLSTELLLSDYEAHKEGKKRLAEIVVGFNDLIEEADAAAAALAAAGPVAVDEDAVDEDADEDGDDDAAEEEAGPTGPDPVEVATRMENLANEYAKFKKAYVKYGAEHKNVAKAREDMAAIFTTLKLPLPLTDALVTQLRGVVNGIKDHERKVLHLATTVARMPRKDFIRSWEGNQTNLEWVEDALKRKQKWSSALRDVKDQIVSEQQGSIEMEKANYLTLAEIKDISRAMAYGEAKARKAKKEMVEANLRLVISIAKKYTNRGLQFLDLIQEGNIGLMKAVDKFEYRRGYKFSTYATWWIRQAITRSIADQARTIRIPVHMIETINKLNRISRQMLQQFGREATPEELAKEMDMPEDKIRKVMKIAKEPISMETPIGDDEDSHLGDFIEDTNVESPIDNTTNINLSETVRDVLAGLTPREAKVLRMRFGIDMNTDHTLEEVGKQFDVTRERIRQIEAKALRKLRHPSRSEQLRSFLDID

SEQ ID NO: 14776 - protein, 258 aa, Xanthomonas campestris pv. campestris str. ATCC 33913
MTAHRWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAGSYITGECIAVDGGFLRHGF

SEQ ID NO: 14777 - protein, 458 aa, Xanthomonas campestris pv. campestris str. ATCC 33913
MSVPHSSPSATPRFAAEVRTTGLLALPLVLGHVSTGLIGFVDNVIAGHHGTATLAAVTIGTSLLWLPMLVPIGTLISLTASVSQLVGAGREREIGPLFRQALWLSLGLGALMFGFLTAVPPLLPTFGIAPDIVPGATDFLHAVRWGGPALTFYFCMRYLSEGMHWTLPTMLLGFGGLLVLAPLGYVLTYGKFGFAEHGAQGLGMASAITMWVQAIAFALYLWRSRRFAHLELFTHLEGPRWRAIGELLRTGLPIGITVLMEGGLFIVTALLIGRLGSTEAAAHQIAINVSQLCFMIPMGVAEATTVRVGHAVGRGDPLGMRRAAWAGYAIVLGTQAVSASILLLGHDAIVGVYTNDAAVAALASVLLLFAATFQFPDGIQVLSAGALRGLKDTRVPMFLAMFSYWGLGMPLGAGLGLGLGWGPQGMWIGLILGLTAAAILMGLRFRQTSRRLTAGAAP

SEQ ID NO: 14778 - protein, 202 aa, Xanthomonas campestris pv. campestris str. ATCC 33913
MWGRRNSSNVRKVLWCLEEAGVAYTSIEVGGAFGGNDTPAYRALNPNGLVPALQDGALVLWESNAIVRYLAARHAPALYPHSPATRALGDRWMDWTTSTFAGVFRDLFWGVVRTPQAERDATRIATALQRSGELLAVADAALAQQPYLSGDDFAMGDIPLGSFIYAWFEMPIERPELPHLHAWYQRLRARPAYQRGVMTPLT

SEQ ID NO: 14779 - protein, 291 aa, Xanthomonas campestris pv. campestris str. ATCC 33913
MNQITSTALVANNLPIPSALGSLDAYIGAVHQIPVLSVDEEQNLARRFRDELDLDAARELVHSHLRFVVHVARGYNGYGLPLGDLIQEGNIGLMKAVKRFDPEMGVRLVSFAVHWIRAEMHEFILKNWRIVKVATTKAQRKLFFNLRKSKTRLGWLNASEVTAVAKDLNVSEREVMEMESRLSGRDIGFDASSDEDDDHGPPSPVSYLVANEEDPSQAYERHDSEDNQLQLLREGMAGLDTRSRDIVKRRWLDSESKVTLQELADEYGVSAERIRQIEANALKKMKALFVA

SEQ ID NO: 14780 - protein, 419 aa, Xanthomonas campestris pv. campestris str. ATCC 33913
MTGSTQARPLDGQRLLLCVGGGIAAYKSLELVRRLRDAGAQVQVAMTSGAQQFVTPLSFQALSGQPTRTTLWDSAAEQAMGHIELARWADRVIVAPATADLLARLAHGLADDLVTTLCLATTAPLTVAPAMNHRMWLHPATQANIATLRARGVAVVGPDDGPLAEGESGPGRLAEPAAIIAALAGDGLRQDAAAASPPVFVPSSAQLEGLRIVISAGPTFEDLDPVRYVGNRSSGKMGYALAAAAARQGADVVLISGPVHQTTPEGVQRLDVRSAAQMRDAVLGAFPADIYIGAAAVADYTPKRVVSQKIKKTGETLTLELVRTPDILSEVAAQTGALKLVVGFAAETHDVEHYARGKLAAKRLDLIIANQVGIAGGGFESDNNAATAYWQGGERAFPSSSKTDLAEQLLALIAERLQA

SEQ ID NO: 14781 - protein, 112 aa, Xanthomonas campestris pv. campestris str. ATCC 33913
MKMIMAIVKPFKLDDVREALAGCGVAGITVTEVKGFGRQKGHTELYRGAEYVVDFLPKVKLEVAVTDDQAEQVVEAIVKAAGTGKIGDGKVFVYDLGSVVRIRTGELDGDAL

SEQ ID NO: 14782 - protein, 364 aa, Xanthomonas campestris pv. campestris str. ATCC 33913
MRIVHPMNSAPARMPKSPLPTRLARRLVSPQLFDFWATRINPLWTLERPMARLVARTPASRDAVTLLFQPNGHWQGLQAGQHVSIGVEIDGRRLLRSYSPTVLADGRLAITVKAITGGLVSTYLAGEAPLGAVVSLDPAFGDMLLPTTPAPLLLLAAGSGITPMRALLQAAAAAGMPMDVDLLYWVRQRDEACFLDEFEALAAAHPRLRAQLLTTREGAAPAPRIDSFPLEQVTALQDRHVMACGPGGFVQAARARLQDRVARFQAEAFSVPVLDDGEAGQVQVQLSRSGRTLTLSRGQSLLEGLEAQGLRPKHGCRMGICNSCACARQSGTTRHLLTGERSSEPTAQVRLCISAASTDLILDL

SEQ ID NO: 14783 - protein, 245 aa, Xanthomonas campestris pv. campestris str. ATCC 33913
MSTSVPQRRALVTGGSGDLGGAICRQLAAQGRHVLVHANRNLARAEEVVASIVAAGGSAEAVAFDVADAQASADALAALLEAGPIHIVVNNAGIHDDAPMAGMNAQQWHRVIDVSLHGFFNVTQPLLLPMARARWGRIVSVSSVAAVLGNRGQTNYAAAKAALHGASKSLAREMASRGIAVNVVAPGVIESEMVGDSFAPEMIKQMVPAGRVGKPDEVAALVAFLCSDVAGYINGQVIGINGGMG

SEQ ID NO: 14784 - protein, 369 aa, Proteus vulgaris
MKSRAAVAFAPGKPLEIVEIDVAPPKKGEVLIKNTHTGVCHTDAFTLSGNDPEGVFPVVLGHEGAGVVVEVGEGVTSVKPGDHVIPLYTAECGECEFCQSGKTNLCVSVRETQGKGLMPDGTTRFSYNGQPLYHYMGCSTFSEYTVVAEVSLAKINPEANHEHVCLLGCGVTTGIGAVHNTAKVQPGDSVAIFGLGAIGLAAVQGARQAKAGRIIAIDTNPAKFELARQFGATDCINPNDHDKPIKDVLLEINKWGIDHTFECIGNVNVMRAALESAHRGWGQSIVIGVAGAGQEISTRPFQLVTGRVWKGSAFGGVKGRTQLPAMVEDAMKGEIELEPFVTHTMTLDEINEAFDLMHEGKSIRTVIRY

SEQ ID NO: 14785 - protein, 665 aa, Proteus vulgaris
MSSSPQKSQTWGKINPPVFFVSAFIILCVVAIAAIFPQRSEILLKTLQAQLFENASWFYILAVALILLTVAYLGLSRFGQIKLGPDHAQPQFSYLSWFAMLFSAGMGIGLMFFGVAEPVMHYLAPPVGDPQTVQAAREAMEITFFHWGLHAWAIYAIVALILAFFSYRHGLPLTLRSALYPIIGERIYGPMGHAVDIFAVVGTVFGVATSLGFGVLQVNAGLAHLFGFPVSPTMQVILIVVITGLATLSVVSGLDKGIRILSELNLSLAGLLLLLIGILGPTVLLLKSFVQNTGAYLSDIINKTFNLYAYEPQSSEWLGGWTLLYWGWWLSWSPFVGMFIARISRGRTIREFVTGVLFVPAGFTLLWMTFFGNSAIHLIRDNGAEMLAQVVQKDVALALFEFLNYFPFSSVLSFVAMLMVIVFFVTSADSGAMVVDTLASGGEIHTPVWQRIFWAFLMGAVAITLLLAGGLTALQTMTIATALPFAIILLIAIVGLLKALRIDIYKKDSQQLATLAPNTGRGGLSWERRLRKIAFFPKRNQVKRFMTEVIEPAMQSVVTELEKQGTEAAIHNEKDDRVTLEVQFGENLNFLYEIRLRDYLTPSFALVGMDDDENNESQKYYRAEVYLKEGGQDYDIMGWSEAQIIHDILDQYEKHIHFIHIVDKS

SEQ ID NO: 14786 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 14787 - protein, 382 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 14788 - protein, 382 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 14789 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 14790 - protein, 501 aa, Cytophaga sp. KUC-1
MSNTIQRPEFKAKYDNYINGKFTAPVKGEYFDVLSPIDGKVFTKAAHSGKEDLELAVDAAYEAFKTWGKTSVTERSILLNKIAQKIEDNLEYIATVETIDNGKPIRETLAADIPLAIDHFRYFAGVIRAEESSIAELDSQTVSIALSEPLGVVAQIIPWNFPILMAVWKIAPALAAGNTIVLKPAESTPISILVLMELIGDILPPGVLNIVNGFGAELGRPLVTNKKVAKAAFTGSTTTGRLVMQYATENIIPVTLELGGKSPNIFFPSVADHDDDFFDKAIEGAVLFALNQGEICTCPSRLLIHEDIYEKFIARVIERTEAIIAGNPLDKSTMIGAQTSLVQKEKIMSYIKLGKEEGAELLTGGDENHLGGDLEGGYYIKPTLFKGHNKMRIFQEEIFGPVLAVTTFKTTEEAIEIANDTMYGLGAGVWTRDAHEIYQVPRAIQSGRVWINQYHSYPAGAPFGGYKQSGIGRENHKMMLGQYRQTKNMLISYDKKKLGFF

SEQ ID NO: 14791 - protein, 204 aa, Escherichia coli
MKQLTILGSTGSIGCSTLDVVRHNPEHFRVVALVAGKNVTRMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPD

SEQ ID NO: 14792 - protein, 390 aa, Xanthomonas axonopodis pv. citri str. 306
MSLTSSPLRVLQVYKTSLPETMGGTEQVVRTLATQSHQHAVESEVVTLCADGRLAGISVQGPYTLHRFRRDFEVASMPVSLRLLRQFAALARRFDLIHYHFPWPFMDVLHLAGAARTPSVLTYHSDIVRQRRWLRLYRPLQQRFLERVDHIVATSPNYRATSPVLANFQTKLSVIPIGLDPSSHYTPDAERARAWRTRLGPRFFLFVGVLRYYKGLQYLLQAVRDTQIPVAIVGDGPEGARLRQQARQLGLSHVHFLGVLDDADKHALLSLCDGLVFPSHLRSEAFGITLLEAAMHAKPMISCEIGTGTSFVNVAGQTGLVVAPADPVALCDAMRYLWNHPQVADALGQEALRRYRQYFTGAAMVRSYAALYRQVHSAAGGAATLGEKQG

SEQ ID NO: 14793 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 14794 - protein, 509 aa, Xanthomonas axonopodis pv. citri str. 306
MNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 14795 - protein, 251 aa, Xanthomonas axonopodis pv. citri str. 306
MSNPFSLEGKVALVTGANTGLGQGIALALAQAGADIAAAGIQAPTETEAKVKALGRRFIAIEANLISIEPVQRIIDETIAGLGGLDILVNNAGLIRRTDAVDFSEQDWDDVLNVNLKSAFFMAQAAGRHFIAQGRGKIINIASMLSFQGGIRVPSYTASKSGIAGITRLLANEWASKGVTTNAIAPGYMATDNTAQLRADEDRNKAILDRIPAARWGVPADLGGTAVFLASSASDYVNGAIIPVDGGWLAR

SEQ ID NO: 14796 - protein, 350 aa, Xanthomonas axonopodis pv. citri str. 306
MDVAVPTLPLHCTFDAADWQRLAQHWHAVALSSEVSEAPFKATLLDEPLVLYRLGSELVAARDVCPHRGVPLSMGTADGGGVVCAYHGLRFGAGGRCNHIPASPSQNIPAKMRLHTYAVAERYGLIWVCLAKPAGVSDADIQIPPMPGWDEDGFQQIVCPAFDIGGSAARQLEGFIDVAHFAFVRTATFAQPDKREVPAYTTTETPTGFNADYLSTVANYSVDMPLPDVDPNFQWLRHFEVHLPFTATLTIHFPVPGKRLVIMNAASPVSKHTTRLLVPIARNFDTHLPVEDVHAFNLRVFEEDRAMVEAQRPEYLPLDPLLEVHIPADRSSIAYRRGLRSQGYSDFFLR

SEQ ID NO: 14797 - protein, 493 aa, Xanthomonas axonopodis pv. citri str. 306
MNALTSATAAATDTPAWHGCIFNGDWVPGRGGSLPIHEPATGALLHEVGKADLSDLAAAIAQAKQAQRAWSATPPRERAAVFHRAAQAMQARSAEAALLIARETGGILPKAQREVDESVVFYQQAAAMPLQASGQMLPTSAGQLSLARRLPLGVIGVISPFNFPLILSLRSVAPALAMGNAVILKPDPRTPYTGGVIIAQVLEQAGLPKGLLHVLHGDAQLGQALVESPDVPMIAFTGSTAAGRCIGEIAGRHLKKVSLELGGNNAVIVLDDADLDKAASAVAFGAYMHQGQICMATGRVLVHRSVAQALTQQLAEKARHLPVGDPVSGTVALGPIIDQRQLQRVVDIVNDSVAAGAVVEAGATHEGLFYAPTVLSNVRPGMRAFDEEVFGPVINITVFDTDDEAAELANQGEYGLAAGILSASVSRALALGEKLHTGLLHINDQTVADEVVNPFGGTGASGNGTSVGGPADWEQYTHWQWLTIKNEVPQYPF

SEQ ID NO: 14798 - protein, 358 aa, Xanthomonas axonopodis pv. citri str. 306
MSQSKPLFPLNAWYAVAWDHEIKHVLSPRKLCNLDVVVYRTTSGAVVALEDACWHRLVPLSMGKLRGDDVVCGYHGLVYNTQGRCVHMPSQDTINPSACVRSFPVAEKHRYVWIWPGDPAKADTRLIPDLHWSHDPAWAGDGRTIHAKCDYRLVLDNLMDLTHETFVHGSSIGQDEVAEAPFDVVHGDRSVVVSRWMRNIDPPPFWASQIARHLDYRGKVDRWQIIRFEAPSTIAIDVGVAITGTGAPEGDRSQGVNGYVLNTITPETDTTCHYFWAFMRNYALHDQSLTTLTRAGVTGVFGEDEAVLEAQQRAIDAHPDHTFYNLNVDAGGMWARRVIDRLIAQEQRAQDLSLRMVG

SEQ ID NO: 14799 - protein, 252 aa, Xanthomonas axonopodis pv. citri str. 306
MSNTALRPQRVLIAGGSRGIGLAIAEAFVRHGAQVSICARNAAGLAQAADALAAQGAPVHTLPCDLADATQIDAYVHAAAQALDGLDVVINNASGFGHGNDDASWQAGLEIDLMAAVRCNRAALPYLRRSDAAVILNISSINAQRPTPRAIAYSTAKAALNYYTTTLAAELARERIRVNAIAPGSIEFPDGLWDTRSREQPELYARIRDSIPFGGFGQVQHVADAALFLASPQASWITGQVLAVDGGQSLGV

SEQ ID NO: 14800 - protein, 327 aa, Xanthomonas axonopodis pv. citri str. 306
MSSPITLIEAITQALAWELEHDPAVLVLGEDVGVNGGVFRATAGLQQRFGSDRVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGEALPLDVCFVLRDGTDVTLVTWGAQVKEALEAADKLAGEGISAEVIDVATLRPLDFDTIAESVAKTGRCVIVQEAPRTAGFGAEIAARLAEQSMYDLVAPVERVTGYDTHIPLFRLEMKFLPSVERIVSAARRAVAAG

SEQ ID NO: 14801 - protein, 769 aa, Xanthomonas axonopodis pv. citri str. 306
MRERAAGLRAWSILAVLAALAAALGAGLQWSSLQGPWRAVSAVSAALAVVCGLCAAFAAHRAAHAQHALAQRLEEADLARERLQQELRRHGELEQELLRAKQAAEAATLAKGEFLATMSHEIRTPLNGIIPMLELISSGQLSLDQRDMLQTATGSSLQLLRIVDDILDYSKLEANKLELEITTFNLRELLDGVIQLLQRTAEGRQLRLSLDIEPSVRLLVRGDPIRLRQVLGNLIGNAIKFTERGSVDIQLRRLGETRAQHLLRFQVRDTGIGIAPDQQARLFRSFAQADASTTRLYGGTGLGLAICKRIIDLMGGRIGVESEPGRGSTFWFEIPLLKVIGDLQQATGADAARVMVISSDARLSQRLKRLLDSWGVSHVLMETTQEALERVRRHSDGEGFRCVIADHDTLRYSARAVHRALARPENASSARLIWLYGEEPVPAELQDHATLVPRLSPDETLRALVLPPEPKPAHATTLASAMIPEPLPPPMANAREVRILLVEDNPVNLLVAQKLLAVLGFEADTATDGEAALARMESTRYDMVFMDCQMPVLDGYAATRRWRAMETESGGRPVPIVAMTANAMAGDRERCLAAGMDDYLSKPVAREQLDACLQRWLPRQALLPGPSPAGQATHDPESASAAAQARALPILDNSVIDELYEVAGADTITILQLFLEDAPLIIEQLEAAAANRDSMQLRDLSHTLKSSSANVGAQAVSNAARRIELAARTGTIERPSVMVALVIAEYARARLALLGQVARLQADASTTNH

SEQ ID NO: 14802 - protein, 368 aa, Xanthomonas axonopodis pv. citri str. 306
MKTRAAVAWGPHQPLTIEEVDLQPPRPGEVLVRLVATGICQGDAHALAHGHAGSFPAILGQEGAGVVEDVGIGVTSVRPGDHVIPLYMPECGVCKFCRSGRTNLCQAIRSSQERGLMPDGSSRFSLHGRPILHHMGTSTFSEYTVLPEIAVARIHPEAPLEQACLLGCTVTTGVGAVLNSTHVRPGDCVAVFGLGGIGLSVIQGALLAQAGRIIAVDIDPAKFALARTLGATDCLDPRDYGAPIQQVIVDLTDGGADHSFECVGDVGAMRAALECCHKGWGESVILGMADDTQEISTRPFQLVTGRVWRGSAFGGVKGRSELPGYVERYLHGDIQLAPLITRTLALDDINQALTDLRAARGIKSIVAY

SEQ ID NO: 14803 - protein, 490 aa, Xanthomonas axonopodis pv. citri str. 306
MPRFPDQLLYIGGRYVPARGGHTLEVVNPATGEVLANVHNAGVDDLDAAVDSAKAGQQRWAALTTVERSRILLRAVALLRERNDALAQLETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDVAADIAMMANFYSSGQVCTNGTRVFVPRALRHAFEARLLARVQRIHIGDPLDERTTFGPLASAAHMQRVLEHIEQGKAEGARLLCGGERLQDGALVQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 14804 - protein, 659 aa, Xanthomonas axonopodis pv. citri str. 306
MSATAPHILPVRTLRPVFVLAATVVCTFALLVSLFPLESGRVLLDAQTWASRNVGWYYLLATTLYLVFVLATALSSYGNIKLGADHDEPEFSYLSWAGMLFAAGISITLFFFCVSEPLTHYLQPPQGGTGSGEASARQAMQLLFLHWGLHGWGVFALAAMALAYFAFRHNLPLALRSALYPLIGKRINGPIGYTVDALGIVATVFGLGADMGFGVLHLNAGLSTLMDVPHTHWVQVALIVAMMGAAIVVAVSGVEKGVRWMSDINMLLAMALLLFMLFAGPTQYLLNALMQNLGDYLGSVVNKSFDVYAYGGRADWLGDWTVFYWAWWIGWAPFVGLFIARISRGRTIREFVLGVLLIPLGFTLAWLSIFGNSALDQLLHHGQTAWAQQAIDAPQTVLYALLQRYPWSRTVITVTVAISFVFFVTSADSGTVVLSTLSSHGGEPHDDGPRWLRVFWGVLTAVVTAGLLLAGSMDALKSAVVLASLPFSAVLLLMAWGLSRALSEESQRKRAQLYSPSPLIGQSRHHGGWRQRLGQAMHFPARDEVYRFMHDQVRPAIEAVTAQLQEEGWKVSSRIDDGDMEISVDHGEQQGFRYQIVMRGYLTPSFAAQRFRNQRYYRAEVYLYEGSQDYDLVGYSREQIINDIIDQYERHLQFLHLTR

SEQ ID NO: 14805 - protein, 369 aa, Xanthomonas axonopodis pv. citri str. 306
MKSRAAVAFGPGKPLEIVEIDVAPPKAGEVLVRITHTGVCHTDAFTLSGDDPEGIFPSVLGHEGGGIVEQVGEGVTSVKIGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGAIDLDPFITHTMPLEEINEAFHLMHEGKSIRTVIHF

SEQ ID NO: 14806 - protein, 480 aa, Xanthomonas axonopodis pv. citri str. 306
MNAVTKITPHTDYKIADISLADWGRKELDIAEHEMPGLMSIRRKHAQTKPLKDVRITGSLHMTIQTAVLIETLKDIGADVRWASCNIFSTQDHAAAAIAATGTPVFAWKGETLEEYWDCTLDALTFTLPDGTLTGPELVVDDGGDVTLLIHKGYELENGSTWVDEPASSHEEGVIKALLKRVAVERPGYWGRVVKDWKGVSEETTTGVHRLYQIAEAGKLLIPAINVNDSVTKSKFDNLYGCRESLADGLKRAMDVMLAGKVAVVCGYGDVGKGSAASLRAYGARVIVTEIDPICALQASMEGFEVNTIESTLGRADIYVTTTGNKDIITVEHLQAMKDQAIVCNIGHFDNEIQVDALKALKDVQKINIKPQVDKYVFPNGNAIFLLADGRLVNLGCATGHPSFVMSNSFANQTLAQIDLWEKRDTYEKKVYILPKHLDEEVARLHLEKIGVKLTTLTKDQADYLGVDVAGPYKPDHYRY

SEQ ID NO: 14807 - protein, 489 aa, Xanthomonas axonopodis pv. citri str. 306
MEALSETLRGIAARGPLGLFIDGQWRASTGDRTVDVIAPHTEERLLRYTEPSPSDTEAAIAAARSAFDNGPWPQLSPQERSVVLKRVADHLRARMPELAEAWTGQVGATLGFSKRASQQAPDLFDYYADLIATHAFVQPRVRPSGGRVHVVQEPVGVVAAITPWNAPLVLLCYKVAAALAAGCTVVAKPSPETPIDAYILAECISAAGVPDGVFNLLPAGREVGEQLIRHPHVDKISFTGSTQAGRSIGIACAERLARVGLELGGKSAAIVLEDADLAKMLPTLVPYSMPIAGQVCFSLTRVLVPTQRREEILQAYCTALSAVKLGDPFAADTGMGPLALGRQLERVQSYIAKGKAEGARLVMGGSRPAHLSRGFFVEPTVFAEVMPDMAIAREEIFGPVVSFIDYHDEADLIAKANASDYGLHGTIYSEDAERAYRIARRVRSGSHAINGMWVDISMPFGGFKHSGIGREGGIEGLHAFLETRTLYLS

SEQ ID NO: 14808 - protein, 636 aa, Xanthomonas axonopodis pv. citri str. 306
MNALAVRWNDWPITRKSLAVVTLPLLLLAVALMAIYSVERQNIAAENDVRQTLEVLSDLYEAHALLAETAAGVRGYRLVRRDEFLTPYRDAEPRLQRVADRLSQRITDPSQAQRFARIKPLFAEKMQGWRRLLAPDLSREEEIRQLWDGKYKLDILRAELRELRNYETAQLQVRTAKAQGLRQRNLIITLSAAMLGGLGAVFAVAWFASALSGRLRTLAANADRLGEGLPLAPQPRAGDELGQVGQRLAQASELLAARAAEAQLARREAETANRAKTEFLSRSSHELRTPLNAILGYAQVLEMDLPEPGHRRHLRHILGAGRHLLGLITELLDIARIEADQLDLSPEPISVRAAVHEALGLIAPDADKHGIALQPASIDGPWTVRADAQRLRQVLLNLLSNAVKFNRTGGQVQVSAQADGEQVRITVADQGAGLTPAQIERLFTPFERLGAERSAVEGTGLGLALSKRLIEAMGGQIGVDSSSDGARFWISLPQGEHQHSEPTRPLVPPSNAGSGVCRLLSIEDNPSNQALIRTLTERRPQWQLLEAASLAQARELLQHGAPDLILLDLHLSDGNGEELLRELQAQPAMAAIPVVVISADATSATLARVGNQGVRAYLTKPLDVAEFFTVIDGLLA

SEQ ID NO: 14809 - protein, 247 aa, Xanthomonas axonopodis pv. citri str. 306
MSKPLQGEIALVTGASRGIGAAIADTLAAHGATVIGTATSASGAAAIGERLAAHGGHGRELNVTDAAAVDGVIDAIGKEFGAISILVNNAGITRDNLLMRMKDDDWQAIIDTNLTSVFRTSKAVMRGMIKARKGRIINIASVVGVTGNPGQTNYAAAKAGIIAFSKSLAKEIGSRGVTVNVVAPGFIDTDMTKALPDEARTALLQQIALGHLGEPEDIANAVAFLAGPTARYITGETLHVNGGMYMP

SEQ ID NO: 14810 - protein, 300 aa, Xanthomonas axonopodis pv. citri str. 306
MSSTKNQYEMQNPLTQFPQPQFPEQTQQAPGTIHALQPKADHGEQSYKGFGRLQGRKALVTGADSGIGRATAIAFAREGADIVLNYLPEEEQDAAEVVQLIQAEGRKAISVPGDLKNEAFCTELVDRAVKELGGLDVLVNIAGKQTAVKDIADITTEQFDATYKTNVYAMFWLCKAAIPHLPPGASIINTGSIQSYQPSPTLLDYASTKAAIVNFTKGLAQQVAEKGIRVNAVAPGPVWTPLQPSGGQPPEKIPDFGSETPLKRAGQPVEMAPLYVILASQESSYVTGEVFGATGGLLLS

SEQ ID NO: 14811 - protein, 284 aa, Xanthomonas axonopodis pv. citri str. 306
MSESSSPSCAQVRLRNGRRVPALGLGSWNLGQGRHAPEQEIQALQLGQQLGMQLIDTAEMYGNGRSEQLISQAIGRTQPPYVVSKVLPSNASARGIARACEASLQRLGVRTLDLYLLHWRGGSDLAEVVDAFEALRDAGKIRDWGVSNFDVDDMEELWAIDGGPHCLVNQVLYHAGSRGIEFDLLPWCAAHEVAVMAYSPLGSRALLDHPVLHAIGQRRGVAATAVALAWAIRSGNVIAIPESGTPAHVRANAAACTLQLHADDLAEIDRAFAPPTRKQPLDLL

SEQ ID NO: 14812 - protein, 468 aa, Xanthomonas axonopodis pv. citri str. 306
MRRWLAFGDRCATGDRQRDRRPGPRARRGRCRRCRHARGGAGQWRARRAHRAPACRHERHARWRGGGHAVRCRQRPGALCRGGQYRRLAVRWRWGARHALAPWHRRGSVPQGATVRLSTRGRQVAGHAQRRPAIALDPARSPGPAVAPSTHHCRSAGTRLRARPRRLLRVRHALGRHAMNSTTDLPAAEMAELESLRQQNQALREELEETNQGVLALYAELDQQAEQLRDVSELKSRFLSYMSHEFRTPLGSILSITRLLEDGMDGPLNAEQLKQVRFVSGSARELTEMVDDLLDLAKIEAGRITISPGWFDLMDLFAALRGMFRPLTDMGSTTLIFEDPPVLPMLYTDDKKLAQILRNFISNALKFTPQGQVRVFAQLEGDSHVRFGVQDTGIGIPAELHEALFEDFVQVDSPLQKRLTGTGLGLSICKRFAELLGGRVGINSVVGQGSEFYVVLPVTLAAEETRGQ

SEQ ID NO: 14813 - protein, 1068 aa, Xanthomonas axonopodis pv. citri str. 306
MTALPVRSTHLMQTISTTRDRWIWVIAGALMAGTLGMELVTPLGYAVWLTYFVAVGVTVFQNRPQVPLIVGVLSCILLAIGFQLAPPSTNSSFSSVNRSIGGVSFLAMALVVMQAIRARRQAEFALWLQQAENTVEASLRGDQAPQELADAAVRALCQTLDAQVGALYRIEGDRLRLTGGAALPPDLPQTLPTAAGQLGEVLQRGTVRRIRGMDAGHLQIASGLGQSSCQELLLAPITADDRVIGIIELGRVTDPRTAGSREEELLARCGENIGLALRTALLRAQLVALLEETQRQSEELQTQQEELRVANEELEEQSRSLQQSQSDLEVQQAELEQTNVQLEERTQALEAQKQALLIAQNQLVRNSNELSTASRYKSEFLANMSHELRTPLNSALILAKLLADNKDGTLSAEQVKYAQAILSSNNDLLALINDILDLSKIEAGHVELADETVVTGSVLQRLRDTFEPLARQKGLALEITAAAGAPAQLVVDNQRLQQILKNLLANAIKFTEHGKVGLLVQASAPGRVRFAVTDTGIGIAREQSEVIFEAFRQADGSTRRRYGGTGLGLSISRDLAQRMGGSISVDSEPGRGSCFTLELPTDGAPAEVIGPADAAANVAAVAAPASGAHVQQRTGSTLGAQSGAPALAAAHMAPVPIASPNAAPIQRADDDRDQRSRPGRLILAVEDDTRFAQALVELAHELDFDCVVAPNAEEALRLAAELRPSGILLDIGLPDASSLSVLERLKRDPATRHVPVHVVSALERSQIALELGAVGYLIKPATRELLAGAIRQLEETNARAVRRLLIVEDDSALRANLQLLLARDQLDIVAVGSIAEAMDQLASSTFDCMVTDLALPDGSGYDLLERMAGNDAVAFPPVIVYTGRALTRDEEQGLRRYSKSIIIKGVRSPERLLDEVTLFLHSVEASLPSDQQRLLREARRRDAVLDGATVLLAEDDVRNIFALSSVLEPLGVTLQIARNGREALEHLAKHEVDLVLMDIMMPEMDGITAMRQIRANRQWQDLPIIALTAKAMADDRERCLEAGANDYIAKPIDVDKLVSLCRVWCSRQ

SEQ ID NO: 14814 - protein, 321 aa, Xanthomonas axonopodis pv. citri str. 306
MTILPRQPRANAPFSQALQHDGYVVLDGALATELEQRGCDLNDALWSARVLMEQPELIYQVHRDYFAAGAQCAITASYQATPLGFAARGLDVAQAQALIARSVALAMQARADHLTLHPHAAPLWVAGSVGPYGAYLADGSEYRGDYVLPIEQLMDFHRPRIAALAEAGVDLLACETLPSASEIVALRQLLQHEFPQLHAWFSFTLRDAAHLSDGTPLAQVVPALDACAQVIAVGINCIALDQATAALHSLSALTALPLVVYPNSGEHYDASDKRWHAGRGAALTLADQHAHWLAAGARLIGGCCRTAPRDIAALAAARAAE

SEQ ID NO: 14815 - protein, 396 aa, Xanthomonas axonopodis pv. citri str. 306
MAGSSPRQVAVFGATGSIGTSALDVIARHPERLRASVLSAGSKVDELLALCATHRPAHALIADATLYPALRDGLRARGLATQAHAGAEALDALASSDACDTVVAAIVGAAGLPSTLAAARAGKRLLLANKESLVLAGELLTRTAAAAGAEIIPIDSEHSAIFQCLRSCDASRGVRRVILTASGGPFRGRDRAALAAVTPAQAVAHPKWSMGPKISVDSATLMNKGLEVIEAHHLFGLPGEQIDVLVHPQSLVHSLVEFVDGSTLAQLGLPDMRTTLAVGLAWPERVESGVGGLDLLSQGRLDFEAPDTAAFPCLRLAWDALRAGGTAPAILNAANEVAVSAFLQGQVGFLAIPALVEHTLTTLQRHNADSLDTLLFADAQARQITERALAHHALHA

SEQ ID NO: 14816 - protein, 537 aa, Xanthomonas axonopodis pv. citri str. 306
MGAGTIGPVFSMTGLPLTTSISPGASAGARLPLQIPFIIGNEACERFSFYGMRNILVQFLITSLLLQEISGPGREAEAKHILHSFMIGVYFFPLLGGWLADRFSGKYNTILWFSLVYCAGHACLALFEGSRDGFFLGLGLIALGAGGIKPLVASFMGDQFDQSNKHLAKVVFDAFYWIINFGSLFASLLIPLALKNLSPAWAFGIPGILMFVATLVFWLGRKRYVLVPLPPKDPHGFAAVVRTALLTHAPGQGRPGLLLAVVSVLLALAGFALIEPLGIVVCLCIALVLLLAGIGGGTWWQLERARGTHPDVAVEGVRALLRVLVIFALVMPFFSLFDQKASTWVLQGREMTMPAWFTASQMQALNPLLVMLLIPFNNLVLYPLLRRGGWEPTPLRRMTSGIAFSGVAWIAVGAIQMIMDGGEPMHIAWQILPYALLTFGEVLVSATGIEFAYSQAPPSMKGVVMSFWYLTTTVGNLWVLLSNVAVRNATVTAHIADTGLSEAAFLMFFFAAFAFLAALAFGLYARRYRMVDNYRTA

SEQ ID NO: 14817 - protein, 430 aa, Xanthomonas axonopodis pv. citri str. 306 [sequence omitted]

SEQ ID NO: 14818 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 14819 - protein, 725 aa, Xanthomonas axonopodis pv. citri str. 306
MNPFARIRQTLMNRPDSEHGQAIVRIVLITLILSYVLLPHVRNSLPMHQYTDVLAVVLVGLSLGLGLFVWLLSRPGRSDPRRIIGMLADYGLMAAGMVQMGEPLAWVYVVVMWVTVGNGLRYGNRYLYLAVGMAVSSFATTLAMTEYWHENLSLGIGLAVGLAAVPLYFASLLRQLTRATVEARRASEAKSRFLANMSHEFRTPLNGLSGMTEVLATTRMDSEQRECLKTIQASTRSLLALVEEVLDISAIEAGKLRINTSDFALHDTLQAIGLILEPQSRAKALNYQVSVAADVPARLHGDAGHLRQILLNLVGNAVKFTDQGSVQLKVAATGTNGRVGVLLRFEVIDTGIGVPVDMRPRLFEAFEQADTGLARRFEGSGLGTTIAKGLVQSMGGAIGFEENPEGGSQFWFELPFGLAAAVPASASLPALQDADTTAIPGNVIAFADPFLRHRARVRSMQILVADDHLANRLVLQRLLQKAGHRVTCVDGGEAVLDALADTDYDAAIVDLHMPGVSGLDMLKQLRVMQAGGASVTQVVVLSADVTPESIRSCEQAGAYAFLAKPVAAVKLLDTLAEIALNQKVRQTDAAIGKRGPATNGAVLDPAVLDELAELGMGEEFEREFIQQCLSDATACVVELGKAAADEDWGRLREHAHAVKGVSSNLGLVILAEQGGELMRLPEAQLRSEWRQRLEQLKTGLAQGREALAQRARRKTEGGASGNGDP

SEQ ID NO: 14820 - protein, 169 aa, Xanthomonas axonopodis pv. citri str. 306
MPTDAPTDTPHAAIDVHWMQHALQLAERAERDYDEIPVGAVLVDAQGNVLGEGWNFNIASHDPSAHAEIVAMREAGRRLANHRLIGCTLYVTLEPCAMCAMAMIHARIARVVFAASDPKTGACGSVFDLLADPRHNHRVQVCGGVLAAQASLRLTNYFRAKRGKPPLAP

SEQ ID NO: 14821 - protein, 792 aa, Xanthomonas axonopodis pv. citri str. 306
MNENILWLHELRLADLARVGGKNSSLGEMIGNLAGLGVSVPGGYATTAEAFKDFIAHNDLSKRIFDRLATLDVEDVNALTLAGKEIRGWVIDAPLQPDLDRDIRSAYAQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFALEAKGAKILAEGRAVGAKIGSGVARVVRSLDDMNRVQAGDVLIADMTDPDWEPVMKRASAIVTNRGGRTCHAAIIARELGVPAVVGSGNATDVLSDGQEVTVSCAEGDTGFIYDGLLPFERTTTDLGNMPPAPLKIMMNVANPERAFDFGQLPNAGIGLARLEMIIAAHIGIHPNALLEYDKQDADVLKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 14822 - protein, 1127 aa, Xanthomonas axonopodis pv. citri str. 306
MDIAVSPLAGLLPETSETAAMLAASVHPADALLGDSPALRTALSICLHAQVPMLLVWGRDDRCIYNDACIARLGPRHPAAFGQPLAALTCASDGDGEPAATIALDLASWSCSPVLQTGEQLGALYIGVAVSTADVDEQRRSDGRDSFLLMLEDALQHVSDPRQIIDTSVRLLGEHLQANRCAFGLVAADGSTMHVISDHVQDMPSLQGDFPLEAARGLRDALLENRPWFTTDALAPGAPDYVAEQYRRSGLRASLAIPLHKHDRLVAAIGVHQRAPRRWLSAEIELVRLVVARCWESMQRAKAQQQLAANEARLRRLANTLPQIIFIADPDGRPHYFNQRWYEYTGLDPSNNEDAAWHRAHTADGLRLSEHAWSLALKGQRALEVECELLRHDGQSRWHLVRALPVRGDDGSISEWIGTYTDIHDRRAFEQQLRESEVRFRALCETVPAMIWMADAQGDCVYWNPRWYNFTGQGEDQALDQGWWDVMHPDDAARVRHAFEQALEQRGEFLAEYRVRRHDGQYRWCIDTASPHFASDGRFLGHIGSLTDISERKHIEDATASDRAILSLITTGAPLPVVLDAIALSVEARGEIPLYCSVMVRDEVRHTLSFGSAPHFPIEYRGHFEPSPIGPEGPPCALSAHLGRQVICSDIQADASFSAHHAISAAMGIAACCVTPILASNGQVLGTLNIYYDRPHLPSLREQAMARSASHLAGIVIERTRVDAKLKLSLQAETAARAQAEHANRVKDEFLATLSHELRTPLNAILGWSRLMQSDIADPANLGRGLVIIERSARAQTQIIDDLLDMSAILSGKIRLQAEHFDIAGLVRSVLELMQPAALTRKIALELDAPCDGELWFFGDAGRLQQVLTNLLSNALKFTPAGGTVRVTMDVEDERLRLCVQDTGIGIAADFLPHVFDRFRQADAGTTRRVGGLGLGLSISRQLVDLHGGSLGASSAGEGQGALFTIVLPFQHGVSDLRPASADTTHVGALPDECRDRLAGVRVLLVDDDQDSREAVMQFLMLAGAQVQAAGSVDAAEHCLASAHFDVLVSDIAMPLRDGYDLIRTVRSGRADLPRHIPAVALTAYVREEDRDRAVVAGFDAHMGKPVEPPGLVDLIERVILPTRSTR

SEQ ID NO: 14823 - protein, 198 aa, Xanthomonas axonopodis pv. citri str. 306
MHALIVVSHPEPGSLTHRVAAEIAKSIADAGAAHTFEVADLAAEGFDPRYNPADLALFRNQGQPPADVLAEQTRIERADALVLVFPVYWWSFPATLKGWIDRVFTGGWAYSETSGGLLKRLPVHLVAIGASGKPTYDKHGYATAMKTQIEHGIFGYCGARVVSSHLLTEADEGFPQTHFDTARRVGRELPEQTDQQAP

SEQ ID NO: 14824 - protein, 485 aa, Xanthomonas axonopodis pv. citri str. 306
MLRIQAEALTYDDVSLVPAHSMVLPKDVSLETRLTRDLRLKLPILSAAMDTVTEHRLAVAMAQLGGIGIIHKNLTPQQQAGEVARVKKFESGVITEPFTVSPDTTIGEVLALTRARNISGVPVVDGSELVGIVTSRDMRFEKKLDDPVRHIMTKKDRLITVREGASDEEVLELLHRNRIEKVLVVNDSFELRGLITVKDIQKKTDNPNAAKDSAKRLLVGAAVGVGGDTEQRIELLAAAGVDVVIVDTAHGHSQGVIDRVAWVKKTYPQLQVIGGNIVTGDAALALMDAGADAVKVGVGPGSICTTRVVAGVGVPQITAVDMVAEALQDRIPLIADGGIRYSGDIGKALVAGASTVMVGGLLAGTEEAPGEVELFQGRSYKSYRGMGSLGAMEKGSKDRYFQDASDADKLVPEGIEGRVPYRGPVGGIIHQLIGGLRATMGYVGCATIEEMRSKPKFVKITGAGQRESHVHDVQITKEPPNYRAG

SEQ ID NO: 14825 - protein, 454 aa, Xanthomonas axonopodis pv. citri str. 306
MCDMRNEHLKPTLGTWQLWGIAVGLVISGEYFGWSYGWGTAGTLGFLATTLLVAVMYTCFIFSFTELTTAIPNAGGPFAYSLRAFGTYGGMLAGLATLIEFVFAPPAIAMAIGAYLNVQYPMLDPRIAAIGAYLVFMSLNIVGVAIAATFELIVTLLAVIELLVFMGVVAPGFSVARFAANGWAGSDVFGPAAISGIFAAIPFAIWFFLAIEGAAMAAEEAKDPTRTIPRAYIAGILTLVILALGVMVFAGGVGDWRQLSNINDPLPQAMKAVVGNSSSWLHMLVWIGLFGLVASFHGIILGYSRQFFALARAGFLPHGLARLSRFRTPHRAILAGGVIGIAAICSDSVVKIQGMSLTAAMITMSVFGAIVMYVMSMLSLFKLRRAEPGLERSFRAPGYPVVPAIALLLALVCLVAMVWFNPIVALIFLGLLLLGAACCVLSLRTQHTPAARAG

SEQ ID NO: 14826 - protein, 321 aa, Xanthomonas axonopodis pv. citri str. 306
MRAGCAIGTAHRCATAALQCWPAKRSAPMRVHHLNCISTCPLGGHLMDGRTPGVLERGHLCCHCLLVETSAGLVLIDTGFGLRDVAEPRARLSRFFLALVKPDLREDMTAIRQIQRLGLDPRDVRHIVLTHLDFDHAGGLDDFPHARVHLMTSERDAALAQRTWMDRQRFRPQQWSTRGQWRTYDGAAGEHWMGLECVRDLHGLPPELLMVPLRGHTLGHAAVAVHTPERWLLLAGDAYFFHREMDADAPYCTPGLRAYQWMLEKDRAARLTNQQRLRALRQQHGGEVEVFCSHDASEFERVAGQPARLPSGALLHAPTPQ

SEQ ID NO: 14827 - protein, 246 aa, Xanthomonas axonopodis pv. citri str. 306
MTSRVALVTGGTGGIGTAICKRLADQGHRVASNFRNEEKARHWQQRMQAQGYAFALFRGDVASSEHARALVEDVESSLGPIEVLVNNAGITRDTTFHRMSAEQWHEVINTNLNSVFNVTRPVIEGMRKRGWGRVIQISSINGLKGQYGQANYAAAKAGMHGFTISLARENAAFGVTVNTVSPGYVATDMVMAVPEEVRAKIVADIPTGRLGRPEEIAYAVAFLVAEEAAWITGSNLDINGGHHMGW

SEQ ID NO: 14828 - protein, 454 aa, Xanthomonas axonopodis pv. citri str. 306
MSYDTVNPANGQVEHTQQTLDAAAIEARLAASAKAFPAWAALPLAERGALLRRIGEELTRRREDLQRIMTAEMGKLRREALAEIDKCAQACAYYAEHAADYLAPRDIPTEAQSSYVRYEPLGCVFAVMPWNFPLWQAFRFLAPSLMAGNVSLLKHASNVPRCADAMKEVLDAAGIPPGVFDVLHIDNDQAADVLRDDRIAAVTLTGSERAGRSLAANAGDQLKKCVMELGGSDAFVVLEDADLAHTVPSAVQSRFDNSGQTCIAAKRFIVVDAIADRFIERFVAAAAQRVVGDPQQDSTTLAPMARADLRDELHKQVQASVAKGAKVLLGGEPVAGSHAGYPATILDTVAPGMPAYDEEFFGPVASIIRVADEAEAVRVANDTTFGLGGSVWTADAKRGERVAQQLQCGAAFVNSVVKSDVRLPFGGIKRSGFGRELAEHGIHEFMNVKTIYVA

SEQ ID NO: 14829 - protein, 1364 aa, Xanthomonas axonopodis pv. citri str. 306
MPKGRWDLRRTYGRRAFFGALLILSAGLVAAIVTGVWLQRQNELERQQRFDYVVRTLARNIGERMSTFEHGLRGARGAVIGAGSDIISRERFTLYSRSRDYPREFPGVLGYGYIHRVAPADEAAFLQAARADGAPDIHRRPLAPWDGERYMVLYFEPESSGNRPLGIDIASEPRRRAAALQAARSGEPVMTSPISLSGYRIPNESGFLVLLAVYREGMPLQTPQQRMLATSGWVYAPFSVEQMVRSALGERDDVALDLSDRNEPTHNFYRSGTPASDSALRPPVVRLLPIYGRTWVITAHPTAGFVASLNQSSPWLIGGLVMAASVLFAALLVLYFSNGLRREEVLRKQMELAALVSHSSEAIVAQTPDGRITHWNPAAEAMFGYTADEAIDQDLTTLLSPQPYAMSEVDHADAALAGNASAAQTMRHRDGHQVHVLASKAPIIESEGTLSGHSHFFRDISDRVRSHQRIIDLNASLEHQVAERTSELVKFSVLQRAILAHAGYAIIATDSGGFVTLFNPAAEKLLGYSAAEVIGRRKASQFVEQEELQERAHMLAEQTGTQVAHTLEAIAALTSLGRSDTSEWTYVSHDGRRLPVLLTLSTLRDDHDQVIGYLGVAVDLTEQKLHEKQLRLAMDAAKSANQSKSDFLANMSHEIRTPMNAILGMLYLLQRSELPGAAQDMVAKIDRSARTLLEIINDILDFSKIEAGRIDLECAPFDLNQLFDNIADLMRSSLSAKPVEMIVEPLPRDSRWLLGDALRINQVLVNLVGNAIKFTEQGEVVLSVRRFPSGDPNKFKLLFSVRDTGIGISKEKQSVIFSPFLQADTSTSRRYGGSGLGLTISRRLVELMGGELEVESVPGRGSEFYFVVTLEKSAPLQAQRELPVLPPEAMPRVLIADDHDAALNNLVRIATELGWRVDAVASGQAALQAIEHAAEPYDIFLLDWRMPDIDGVAIAREIRARATPGPHPVIVMVTAYERRLLEQHPEQQDLDAVMTKPVTGAALHRLVEQLLEERPGARPATPTFVARRLEGAHLLLVDDSDINCEVAQRILEGEGAMVTVAHDGEQAVSTLKRAPNLFHLVLMDVQMPVVDGYEATRRLRQIPALASLPVIALTAGAFRPQQEKALEAGMNGFIAKPFNVEELVTAIRHFLQPGTRRIPSLPHEAQAHAGPEWKYSDPELLDAARARSLWREREPYARYLIKLLRDNPDPGEIAAEHLRRNELPAIGAMAHKLRGAAGSLALPALAGAAGDLETRIEEGHDITGSLIALKDVMQRTAEAIRAFLQHGDSDVAADEDGAALDADSVQILTSAFASDDADRIDHALLICAPRLPHALQEALQRAVEDFDFRRAETTLREWQTTHPH

SEQ ID NO: 14830 - protein, 838 aa, Xanthomonas axonopodis pv. citri str. 306
MSSPSPAPVTPDLVRLRASARDKDDAIAQAAQLLVAAGCVAPGYEASMRRREGLANTFLGHGLAIPHGVGEDRHLVRRDGIAVLQLPDGVEWNPGQITRLVVGIAAQSDTHITLLRRLTRLIQDPAQLEALFSTDDPSVIVAALTGDRAPETSAAPATDLAEAFEWTIAYPSGLHARPATRWAETARGFSARAQVRAGDQAADAKSLVGLLQLGLRAGDSITVSAEGSDAAELLKRLRAVMDSLTAQEKADAERAAQRRAAPVAGWTPPQAQPAIVGIGASPGVAIGIVHRLRAAQTEVADQPVGLGDGGAQLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPDQPCILLASDLSPSDTANLDTARVLGLATAQGGPTSHTAILSRTLGLPALVAAGGQLLEIEDGVTAIIDGSSGRLYIDPSEQDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELVALRAICARIRADLDAPEVPIGIMIEVPAAAAQADVLARHADFFSIGTNDLTQYVLAIDRQNPELAAEADSLHPAVLRMIRSTIEGARMHDRWVGVCGGLAGDAFGASLLAGLGVQELSMTPNDIPAVKARLRGAALSQLQQLAEQALACETAEQVRALEAKREDKA

SEQ ID NO: 14831 - protein, 638 aa, Xanthomonas axonopodis pv. citri str. 306
MIDTTRYPRLSRIQTPDDLRRFDEAELTAIAEELRSYLIESVGKSGGHFAAGLGVIELTVALHYLYQTPVDQLVWDVGHQTYPHKILTGRRDQIHTVKQKDGVAPFPKREESIYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLQTLKGPQLLHVITTKGKGYELAEGDQIGYHAVGPFDPSKGLVAKTGAKKPTYTDVFSDWVCDMAAAEPKLLVITPAMREGSGLVRFSKQYPQRYFDVAIAEQHAVTLAAGMATQGAKPVVAIYSTFLQRGYDQLVHDVAVQQLDVLFAIDRGGVVGPDGATHAGNLDLSFLRCVPHMVVMAPADEAECRQMLSTGVQYQGPAAVRYPRGTGPGAALDASLATLPIGKAQLRHSGTRIALLGFGATVDAAEAVGRELGLTVVNMRFVKPLDKALLLELAKTHDGFVTIEDNVVAGGAGSGVSELLNAEAITMPLLHLGLPDSFQHHASREDLLAEAGIDQAGIRAALLKRWPQLMISLPPALNAATG

SEQ ID NO: 14832 - protein, 282 aa, Xanthomonas axonopodis pv. citri str. 306
MPVRVSLELLRVGHCRHCERMVRADGHWHAVEFPALSVLIRHPQRGALLYDTGYAAHFFRATDAWPERLYRLTTPVRLPAHETLGAQLSKRGVALDDIAWCLISHFHADHVGGLRDLPNARFMCSRADHQQLRSCSRVGGLRRALLPQLLPDDFDQRLQFADQAPQRALTGAWQGLGPAYDLFEDGSVLAVSLPGHVPGQMGLRVRDQHDREVLLCADAVWSSATWATLQWPAWPTRLLMHDWHAFQRTVHRLHALSHAHPELAILPSHCQPSLDRYQPEWR

SEQ ID NO: 14833 - protein, 492 aa, Xanthomonas axonopodis pv. citri str. 306
MTAKPRLDFWQIWNMCFGFLGIQFGFALQNANASRIFQTLGAQVDDVPGLWIAAPLTGLVVQPVIGYLSDRTWTPWGRRRPYFMVGAVFTTLALLVMPNAPMLWVAAGTLWVLDASINISMEPFRALVGDQLPPSQRPTGYAMQSFFIGIGAIVASFLPWLLTHWGIANTAPPGQLPDSVRYAFYLGAAVLFLSITWTVLRTREYSPEQLAGFDDAHPPLAQAVSTGMVPTSMASVLWCGLGVLLAAAIAWQHGDRMLYVLAGLCFAYGVLLALARMLPATSMLVAIVQDVRSMPMTMRRLAWVQFFSWFALFAMWIYTTAAVTQVHFGASDTASAAYNDGANWVGVLFGAYNGFAALAAVVIPLLVRAIGLRWSHLCNLWLGAAGLLSMLVIRDPQWLLLSMLGVGFAWASILSLPYALLSDSVPAPKMGVYMGIFNFFIVIPQLVAASALGFVLRVWLGGQPIYALAIGGLSLLIAGVCVVRVPVASGGQ

SEQ ID NO: 14834 - protein, 318 aa, Xanthomonas axonopodis pv. citri str. 306
MTADIRMSARIPTLDITRFDTDREAFVAELGAAYRQWGFAGIRNHGIAQADIDAAYEVFKAFFALPEATKRRYHVEGSGGARGYTAFGVETAKDSKHFDLKEFWHIGREIPDDSPYRAVMPPNLWPSEVAGFRERGHQLYQQLDQLGSRVLSALALHIGLPQDYFVDKTNNGNSILRPIHYPPITSDDIPNVRAGAHGDINFITLLVGASAAGLEVRSHEGEWVPFTADADTIVVNIGDMLQRLTNHVYPSTIHRVVNPPGEQARQPRYSVPFFLHPNPDFLIDVLPSCISADNPSRYPEPITAHGFLEERLREIKLK

SEQ ID NO: 14835 - protein, 317 aa, Xanthomonas axonopodis pv. citri str. 306
MSRSRWHTTTRVGDEHDGAKWFLGGARCCEGGWRMTGERRIAAHAVQGALAPHPRIRNVIAVGSGKGGVGKSTTAVNLALALRQLGARVGVLDADIYGPSVPAMLGLSGRPDSPDNKSIEPLRAFGIEAMSIGLLVDQDTPMIWRGPMATSALTQLFNDTLWDDLDYLLIDLPPGTGDIQLTLSQKIPVAGAVIVTTPQDIATLDARKALKMFEKVEVPVLGIVENMAVHTCSNCGHREHLFGEGGGERMAAQYGVPLLGALPLVIAIREQGDVGQPIVVAAPESVAAQAYLAAATRLAEELGKRPRASIPISASLL

SEQ ID NO: 14836 - protein, 310 aa, Xanthomonas axonopodis pv. citri str. 306
MPSSCPRHHSARPRMTTLIAPRVHDIGGLEVRRAVPTLQARSVGPFVFVDHMGPAVLEPDHGIDVRPHPHIGLATVTFLWAGEIGHRDTLGSDQVIRPGDVNWMTAGRGIAHSERTPGPERAREHALHGMQTWIALPRSAEETAPAFHHHAAASLPQQRRDGVWLRVIAGRAYGEESPVQVFSGTLNVALDLAPDAELDLDTGHTERALYILEGEAQLDGADVPARHLIVPSPGARGRLRAKTPLKAMLLGGEPLDGPRHLWWNFVSSSKERIEQAKDDWQAGRFGSIPGDDDEFIPLPESLAPKPVNYP

SEQ ID NO: 14837 - protein, 285 aa, Xanthomonas axonopodis pv. citri str. 306
MSTTTTTAAHVLRTIRGMPTSDGAGVKLTRVIGTQQLPELDPFLMLDEFGTDKAEDYLAGFPSHPHRGFETVTYMLDGRMRHKDNHGNEGLLTPGSVQWMTAGRGLIHSEMPEQESGRMRGFQLWVNLPARDKMTDPKYQEYAPDHIPVAHPASGVTVKVIAGAVGEVVGPIVQPATSPVYLDIALEPNVEWEYQLPSGHNAFAYAFEGALTVGESDTARVLPAQQLAVLGGGQRLRLHAGADGAQLILVAGRPLNEPVMRHGPFVMNTKQELMQAFVDFQEGRF

SEQ ID NO: 14838 - protein, 869 aa, Xanthomonas axonopodis pv. citri str. 306
MSAPHSTDRWIVLKFGGTSVSRRHRWDTIGKLASKRANETGGRVLVVVSALSGVTNELTAIADGAADSAQRVAALDQRHREFLAELELDADAVLGERLAALHALLGDARAATRTLDWQAEVLGQGELLSSTIGAAYLHASGLDMGWLDARQWLSALPPQPNQSEWSKRLSVSCQWQSDADWRTRFAAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGNAELVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDEADADGLLPILHAELIDSGAMPVSEGEVFGPRWRQIIGSVRPRPTPWWHAERAHLLSLSRAGTPRYAYHLPTVRERAHALAQIAAVDQRYYAIKANAHPAILMALEQAGFGLECVSHGELRRVFQALPELSPRRVLFTPSFAPKAEYEAAFALGVTVTVDNVEALRNWPEVFRGRNVWLRIDLGHGDGHHEKVNTGGKASKFGLSSTRVDEFVEVARTLEVTITGVHAHLGSGVETGEHWRMMYDELAGFARRIGTVETIDIGGGLPIPYSAEDEPFDLEVWAKGLAEVKAVHPGYRLAIEPGRYLVAEAGVLLASVTQVIEKDGVHRVGLDAGMNTLIRPALYDAGHDIENLSQLDAPADGTFDIVGPICESSDVFGKRRRLPAATAPGDVVLVADAGAYGYSMASTYNQRELPREEVIDAPTG

SEQ ID NO: 14839 - protein, 576 aa, Xanthomonas axonopodis pv. citri str. 306
MSLRLRGHGAARGNALGRARVRQSHTLEVAEQRVPANQVETQLQRLHAAIASARVEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSTLSHSAILARSLHLPLVVGVSDALQRIEDGDVLIVDAGSGQVIVDPKPEHLRDYRERLRALAKEQRELGRLRSKPTRTRDNVDITLLANAESLEDVANAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILQLRKQLKKLTAQLREEGHEIAEHIPLGAMIEVPAAALALDCFIDDIDFLSIGTNDLVQYLLAVDRNNEALGELYSPLHPAVLRLIAQVIATGRTYGKPVAVCGEIAGDPRFVPMLLALGLTEFSLHPATLLEVRRAVRDTHLGDLRVHGEKLLRARDRKGIEKWLTGHAQGLLR

SEQ ID NO: 14840 - protein, 1225 aa, Xanthomonas axonopodis pv. citri str. 306
MRPERTRRTRAACLPAPRVARTMRRLVVVDPVRFLSCLPHRLLAVLWVCLCLAVLPVQARTPATPVPIQLTIADGLPSDTINQLAEDKQGYLWLASDDGLARFDGRNYRIWRMEDGLTSNVVWTICVDANDRVWMGFEDGGVGYLEANTRAFKRLEDPQFPELRDATLWSLAQTPDGDIWIGTAKQGLYRYRPDGRMQHFSAKAGDAGSLPSDNIVGLEVAPDGGLWIGTWGGLVHWDGRRLERVPLPGPSQSVNRMYKEPDGKALWIADFDGNPVRFNTVGRPTASPWQSGTDTAQVRGVLLRDRLGRYWLDTATGLGMSTGDGGVERVPVYSFSAHGLVNRNWITAYQDREGGLWFASLEGGLWHLPPRWDTFALFSHRADDPQSLANPSVVATAPSITGGIWLVGTRGTLEHFDPVTGRVEPRLASVDPERIPDTVIESRRGTVWIGVQERLVRYNPQTGEVRRWPLLGHKESAADLEDVGRPGRMAEDAQGRIWVALLTHGVQLWSSEGQLLRTLDYGSDGLKALTVLDMRIGPDGQIWLSNNAGLWRWDPHADQFVPVRGAPSLPTYVFRQGDGGIVWIGLAGQLRRYLWDGKQLTHLDTVGKDQEFPMVSPTGLVIDAGGVAWVSSHRGLIRVDPGSKLVRVYDVHDGLPSSPLQVATLVQASTGQILGGTSDGIVVFDPATMRPNLRRPQLLIERVSLRRGERELDVTGKAPLQVQDGDRDLHIVARMPTFTNPESTSYRFRLSGYDPDWIDVGSTGERLFSRLPSGHYTLEVQGRTADGIWSASQTLRFQVLPPWWLSPWGLSLLALLTVCVVAAAISLYRRRLRRLNAWQLAVHKQELAEQASLAKTRFLATLGHEVRTPMTGVLGMSELLLKTTQDPTQRSYTESIRRAGAHLLRLVNDALDLARIESGRLELDFQPFSVRQLVAEVEALMAPLAQERGLRFSLEIGLLGDITASGDSTRIRQILLNLLNNAIKFTERGVVALKLTTLGSYQGLRFEVADTGPGINAEQKARLFQRFEQGNGAKTTSRYGGSGLGLAICQELAMAMGGHIEVISRLGAGTRFVVDLPLRWVASNATLDGEVAHAASPVDPQRILLVEDDPTIAEVIIGLLRAQGHSVVHAPHGLAALTEAADNTFDLALLDLDLPGLDGFALARQLRVFGYDMPLVAVTARSDEEAEPTAQEAGFDRFLRKPLTGDMLADTIAEALRRERPREQI

SEQ ID NO: 14841 - protein, 1189 aa, Xanthomonas axonopodis pv. citri str. 306
MPLKALMTRALLLLCLAVVSVWPSSTLAGVPVLPQPRQLTVADGLPSNVVYGFDEDANGYLWLASSDGLARYDGRNFRIWRIEDGLRDNQIWAVHVDKRNRVWIGTGMAGLAMLDPARHQFTFYDGARYPELRGAAIWNIKSTDDGSIWFGTEMSGLYRLRPDGSLEHFAHRADDPRSLPDNAIYRLDVDTRGTLWIGTADGAAHWTGKDFERQAFPDGTAQIITRLTADADGSIWIGTSDDKLFRRDPSGHLSPHRWQAPAEYPVLGVLLRDQDGSYWLDTLAGLGHTTGAEVRNVPLYSLSAHGRIRPNWESAYQDREGGVWFASPNGGLWHLPSNWHRFAVVFNYMDDGGQGGNLAIQGTARSRDGRMWLVGTSGVLERVDPATGKIERVLPSLGSASWSNSVLEDRKGNVWVGQFAELVRFDSATGHVQHWKAAASGSGAAAQDATLDASLEALQQTADGHIWVHATLGLQERDEQGRLLRTMLRGTHGLAADLVVYDLQAGPDGALWLAGNRGVQRWNASVARFERIAGAPDEPVFTFRFSDNQIAWFAGLGKLHRYLWKNGALQHLDTVGPEQNFPALAPQGLVVDHDGVAWLSSMRGLIRVDPATRGVRVFGVHDGLPNPQFVARSLVQSSKGMIVGATPDGLVIFDPAELKPNDHRVPLVIERVGLRRGESGLDLSHVTPLVMQDGDRDLHIVARLLSFADSESNSYRFRLSGYDPDWIDVGPSGERLFSRLPSGHYTLEVQGRTADGIWSASQTLRFQVLPPWWLSPWGLSLLALLTVCVIAAAILLYRRRLRRLNAWQLAVHKQEVAEQASLAKTRFLATLGHEVRTPMTGVLGMSELLLKTSLDIKQRSYTESIRRAGAHLLRLVNDALDLARIESGRLELDVEPFSVRQLVAEVGALMAPLAQERGLRFSLEIGLLGDITASGDCTRIRQILLNLLNNAIKFTERGVVGLKLTTLGSYQGLRFEVADTGPGINAEQKARLFQRFEQGDGARTTSRYGGSGLGLAICQELAIAMGGQIEVISRLGAGTRFVVDLPLRWVASNVALGGQTAHAETAVEPQRILLVEDDPTIAEVIVGLLHAQGHSVVHAPHGLAALTEAADNTFDLALLDLDLPGLDGFALARQLRVFGYDMPLIAVTARADEVAEPSAQEAGFDTFLRKPLTGDMLADSIAEALRRKR

SEQ ID NO: 14842 - protein, 1191 aa, Xanthomonas axonopodis pv. citri str. 306
MRVLIVVLAVLLAIWPCAAKIPEVPRFRIVGPSEGLPSTMVVAIGQDRAGYLWLGTLDGLVRYDGAGFRTWRHDPADPGSLPCNAVQALHIDALDRVWVGCGKTLSVLDAGRGHFRHYRAADYPLLKDGEIFSIAAFDGGIWAGTTTGALVRIDASGGMSSVDLGGIEGALDRAMVMNLAVDNQHRLWIGTSNGLAYYDGKQLHRQFIADEPNRQSSIFGLQWTGDRLWLGSESGLHVLRADGHWQPLAWSTMFGNGNEFWGAVATPDGEFWLGSGRGLWRTRGERPPVPALSGEGPLSRRNVIGLMGAADGGLWVPMHGTGLGYLPADWKRSAVLKPAVPMGDAIYCNLAPARRSGGLWQVDAQGRLLRVDPSTGDSFQTGLQSPQLKGMELVSALEDRLQRVWLGNLTFGLSRMDLRTGDFVHWPSDGPEPSSSLSAPEWIMEHGDTVWMAFIDMVQQRDLRTGKVLQRMTQQDLHGLRAIDIQQLDQGPDGRVWVAGEGGMFAWDDATGRFVPVAGLEGMPIQAFASQSADTLWVYRASGAEQWQKLAAGWKRVRQVGEADGLNGFDASAMRIDPRGRVWISSLRGLWRIDPSVHPARVRNIGTRDGLTSQEFIQHCLLMSGDTLIGATSDGSTVLLDTAMPDVAPFVPALQLEHVSVLRNGARIALPMDRPFQLGPEDRQLQIVTRLLSYSDPLSNRYRSFLKGFDTDWQTIGNTGIREFASLPAGNYELALQGIDPLGNRSQVRSLQFSVRPPWWRSEIGIALICFSGLLLSALLAAAYRRRIRMRAQWQLAQHKRELAEQASLAKTRFLATLGHEVRTPMTGVLGMSELLLQTPLDGRQQGYASAIQLAGKHLLRLVNDALDLARIEAGKLPLDYRDFDLRQLVGQAVELVRPSAEQKQLAFHCELDDALPPALHGDASRVQQILLNLLFNAVKFTERGSVHLRVTTLSQHTRQGLRVEVRDTGPGMSAEQRGRLFQRFEQAEGALTLARHGGSGLGLAICRELAAAMGGAVTVASELGQGACFVVELPLHWVSTLPTVTPPAVRAPSLREQAPLQLLLVEDDATVAQVIVGLLQARGHHVTHALHGLAALAEVSTRSFDAGLCDLDLPGLDGAALVAQLRARGVRFPIVAVTARADTDAEPQAMAAGCNGFLRKPVTGELLAQALARVLADVDDGQRDNVAVDA

SEQ ID NO: 14843 - protein, 453 aa, Xanthomonas axonopodis pv. citri str. 306
MTSPFAPRSAAGRLRAAMRSSPPLAWSFLYFFCLLSGYYVLRPVREAMGASADVEALFPTGMIAFFAAHGVPLKDFTLQVLFTCTFLIMVLLQPVYGALVSRYPRRVFLPGVYGFFIATLLLFYVLFDSGVPGRGMAFFLWVTVFNLFAVAVFWSFMADVFSNAQARSYYGYIGAAGTLGAFLGPVLTRVLVERIGIAHLMLVSAGFLAVCVVCVLRLRLWAVAREQEGQLSSGEVPMGGDVLGGLKLIVREPLLRWLAFMVLFGVGVGTLLYNEQAALVRRLYTDAAAATAYYSSIDLAINALALVLQLLVTRALLSRFGIAPALLIPGVAIMLGYAALAASPLPMMIAIVQVITRSSEFALAKPARETLYTRVNREWRYKAGAAIDTVVYRGGDLTFVWVHKLVSAFGSSAVFGVGLLVATGMTVGAFGLLRQARKLPAERDVETDKRVSE

SEQ ID NO: 14844 - protein, 246 aa, Xanthomonas axonopodis pv. citri str. 306
MTLRIAYVTSGMGSVGTAICQKLARSGHTVVAGCGPNSPRKASWLREQRELGFDFVASEGNAADWESTVAAFAKVKAEVGEIDVLVNNAGGSRDTLFRQMTRDDWNAVIASNLHSLFNITKQVVDGMTSRGWGRIVNIGSVSAHKGQIGQINFATAKAAMHGFSRALAQEVASRGVTVNTISPGYIASASISSFPPDVLDRLATSVPVRRLGKPAEVAGLCAWLASDEAAYVTGADYAVNGGLYMG

SEQ ID NO: 14845 - protein, 439 aa, Xanthomonas axonopodis pv. citri str. 306
MSSTVPPLSFARILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLTPPQRPLGYLTQSAFTGLAQTLAYLTPPLLVGMGMNQDAANAHHIPYVTIAAFVIGAGFSAGSILLTARSVREPAIAPAEIARIRQSGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPPERTGVYMGLFNLFIVLPMLIQIVTLPLYYEHVLHGDPRNVVRLAGALMLAAAAAMLCVRLRKPKAVAA

SEQ ID NO: 14846 - protein, 593 aa, Xanthomonas axonopodis pv. citri str. 306
MSFDPPFSHGSTASGLSRRRFVQGLALGGIAASGLWRNDARAAAQANTPVLRGSSQSLQIGRLPVNFTGRPRSAITVNQSLPAPTLRWREGDTVSVRVRNALTDQPTSVHWHGLLLPANMDGVPGMSFDGIAPGQEYHYRFALRQSGTYWYHSHSMFQEQSGLYGAIVIDPLVPPPYRHDREHVVLLSDWTDLDPAALFRRLKQMPSHDNYAQRTVGDFLRDARDDGLRATLADRGMWGRMRMTPTDLSDVNANTYTYLLNGVAPAGNWTGLFKPGEKVLLRFINGSSMTYFDIRIPGLRMTVVAADGQYVHPVSVDELRIAAAETFDVIVEPLGQDAFTLFAQDMGRTGFACGTLAVQHGLQAPIPALDPRAILTMQDMGHGDGMDHALPAMHGAPGMLAAHGMHTMHSHDDAKAHDKAPHHSASETGNPLIDMRSNATAPRLDDPGVGLRDNGRRVLCYADLHSVFDDPDGREPGRDIELHLTGHMEKFAWSFDGIAFASAQPLQLQYGERLRIVLVNDTMMQHPIHLHGMWSDLEDAHGNFQVRKHTIDMPPGTRRTYRVRADALGRWAYHCHLLYHMEAGMMREVRVEA

SEQ ID NO: 14847 - protein, 578 aa, Xanthomonas axonopodis pv. citri str. 306
MRSTPNRAAPGLILAARQLHNDRLVRLFESFLEYRACVGRVIVQTIVTAWCLGWLYGPQPVLVADAHHVFPTALSLWALSVVWMLLVRRRVIAPSEWLDAMGFAMNLLFIGIQTYLAFILLMSLNAFLPFITIAAVARYGQRAIFPVLLSTFVLMLLTAPSGYWLSRPAYFVYAVALIIVLPLLVARIVLAMQEVALQALASRDAQSHFISTMSHELRTPLNAVINCAQLIETEQMPAQQRELLQSVTANATALRHRVNEVLDVASIDGGRLQLHRKPLNLLDVVTTVKAVCATAASSKGVTLDVRVDSPQAPHVMGDEGRIEQVISNLVINAIKFTPAGGTVDLLIDATQVQERWSIAVTVTDTGIGVPDDQKAYIFTPFTQLSTGFSRVEGGVGLGLYIALSVSDAMGGSLTVSDNPAGGSIFRWIFELPGTAAGSNTLALRDALAQHAQNVPSLHCLVFEDMDTNRLVIGNLLTRAGHRVSFQVDGTDAVQRIREAAPDLVFLDLHMPGTSGWDALREARDAMSALPPIIVLTADTRTDSMRDASAAGVAGYLPKPINAHELLALLAQHASHARP

SEQ ID NO: 14848 - protein, 631 aa, Xanthomonas axonopodis pv. citri str. 306
MVFDGEQAVDYVIRTTNGAFERYTGLSPNALNVSIRNLLPEHEQEWFDRYGHVARTGNRIHFEMQAKALKRWYSVDAFRVGQPEQARVAILFMDITERKRVERELAESEARFSALADGLPMPVWVLDAQGVVRFVNSAYGEFFGLDISSGTVSAWSELLHPDDLPTFQFELAASLQEQRGLRALVRARRHDGQWRWIEMTATPRYSADGRFIGLAGSSPDVTEQREIELAREQLLESERSARNEAESMARLKDEFLATLSHELRTPLTTILGWSELLLQRVEEGQPYYKGLSVIASSARAQKRLISDMLDLSSMLLGKVQLEVESLDLVEQVREALNTQELAAEGKDQVLELHVPPTPCLVLGDATRLQQVLWNLLSNAIKFTPAHGRIDVKIERDDGHLVVSVCDSGDGIAAEFLPHLFGRFRQADGTTTRQHGGLGLGLAIVQQLVEMHGGQVGATSGGRGKGATFTVRLPEHVPDQAKRPRRELRRRLMSEQIVEARALNGLRLLAVEDQPDMLDYLRRLLEEQGAEVVTAGSATDALALIDHRGHARFDLMLTDIGMPGMDGYGLIRTVRENLGLTATALPAVAVTALAREDDRKRALESGFQEHLAKPYSVAQLVTAVRAARQAVE

SEQ ID NO: 14849 - protein, 584 aa, Xanthomonas axonopodis pv. citri str. 306
MRWFSSPGATRYGPVGALLLCVAICDAARAAAFFHSGFFMHSIDVVLAMLLAVAASGYLIRILPFSLPLPLVQIALGAVVSGVFDAGHELEPELFFLLFLPPLLFLDGWRIPKQGLFRDKAAILELALGLVIFTVIGAGFFIHWLIPAMPLAVAFALAAIISPTDPVAVSSIASKVPIPKRLMHILEGESLLNDASGLVCFQFAVAAVLTGTFSVAAASLTFLWVALAGLALGVATTFGLSRIQAWIWRHFGEEPGSAILVNLLTPFAAYLLAEAFHASGILAAVAAGVTMSYVEMAGNAPGNMRLQRSAVWDTVQFTFNGIIFVLLGEQLPGILDGAVRSVQEAGHLNPWWLAVYVATISASLMALRFVWVFLSLRWNIFKAQRRGEAHVSPPWRIVVAVSLAGVRGAITLAGVLTLPLMLEDGSPFPARQLAIFLAASVILVSLLVASVALPRLLRGLELPEEEDEQLKEDLAVKAASQAALEAVEKLRQRLVDGSKHAERYNAAANQVSQRYQRKLGAVDMAETDPEEAVAYEKALRQFRHAALVAERNELFKLARRREISDDLSRRLVRNLDLIESRKRA

SEQ ID NO: 14850 - protein, 363 aa, Xanthomonas axonopodis pv. citri str. 306
MTSWRCAQYRASSAKPHEVCVQPRCSACHRIAGVLPAAHRARSATHAMRTSFSPDIYVCVTTLACNQQSHCQETTMPVPNYPRPPFKPQKQSFPGRTEKMDPRPDHGEDSYVGHGQLKGKRALITGGDSGIGAAVAIAYAREGADVAIAFLPDEQEDAARIGALIEKAGVKALLVGCDISDPSQAAALVDKVNSTLGGLDILVNNAGYQKYFETFEDITLDEWRKTFDTNVHAAFNLVRLSVPLMTDGGSIINTASVQSKKPTPNILPYAATKGALANLTIGLAGVLAEKNIRVNAVLPGPIWTPFIPSGMDEESVENFGGQTPMGRPGQPVELASAYVMLAADTASYTSGTLLTISGGAVTL

SEQ ID NO: 14851 - protein, 625 aa, Xanthomonas axonopodis pv. citri str. 306
MANERPAQQSDIKLLISKGLEQGYLTYAEVNDHLPDDLVDPEQIEDIISMINGMGIDVHEVAPDAETLLLNDGNTGNREVDDTAAEEAAAALTALDTEGGRTTDPVRMYMREMGTVELLTREGEIAIAKRIEEGLSQVQAALGVFPLSTEMLLADYEAHKEGKKRLAEIVVGFNDLIEEADAAAAALAAAGPVAVSDDEAVDEDDDEDGDDEAAEEEAGPTGPDPVEVATRMENLANEYAKFKKVYAKNGAEHKLVVKAREDMAAIFTTLKLPLPLTDALVTQLRGVVNGIKDHERKVLHLATTVARMPRKDFIRSWEGNQTNLEWVEDALKRKQKWSSALRDVKDQIISEQQGSIEMEKANYLTLGEIKEISRAMAYGEAKARKAKKEMVEANLRLVISIAKKYTNRGLQFLDLIQEGNIGLMKAVDKFEYRRGYKFSTYATWWIRQAITRSIADQARTIRIPVHMIETINKLNRISRQMLQQFGREATPEELAKEMDMPEDKIRKVMKIAKEPISMETPIGDDEDSHLGDFIEDTNVESPIDNTTNINLSETVRDVLAGLTPREAKVLRMRFGIDMNTDHTLEEVGKQFDVTRERIRQIEAKALRKLRHPSRSEQLRSFLDID

SEQ ID NO: 14852 - protein, 258 aa, Xanthomonas axonopodis pv. citri str. 306
MTTHRWRLDGQTALITGASAGIGLAIARELLGFGADLLMVARDADALAQARDELADEFPERELHGLAADVSDDEERRAILDWVEDHADGLHLLINNAGGNITRAAIDYTEDQWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 14853 - protein, 458 aa, Xanthomonas axonopodis pv. citri str. 306
MSVSSAPPSATPGFASEVRTTGLLALPLVLGHVSTGLIGFVDNVIAGHHGTATLAAVTIGTSLLWLPMLVPIGTLISLTASVSQLLGAGREREIGPLFRQALWLSLGLSALMFVFLSVVPPLLPTFGIAPDIVPGATAFLHAVRWGVPALTFYFCMRYLSEGMHWTLPTMLLGFGGLLVLAPVGYALTYGKFGFAEHGAEGLGMASAITMWVQASVFALYLWRARRFAHLQLFAHLEGPRWRAIGELLRTGLPIGITVLMEGGLFIVTALLIGRLGSTEAAAHQIAINVAQLCFMIPMGVAEATTVRVGHAVGRGDPQAMRRAAWAGYAIVLGTQALSASALLLGHDAIVGVYTDDVAVAALASVLLLFAATFQFPDGIQVLSAGALRGLKDTRVPMFLAMFSYWGVGMPIGAGLGLGLGWGPKGMWVGLILGLTVASILMGLRFRQTSRRLTATVTP

SEQ ID NO: 14854 - protein, 207 aa, Xanthomonas axonopodis pv. citri str. 306
MPAITIWGRRNSSNVRKALWCAEEAGVAYTSIEVGGAFGGNDTPAYRALNPNGVVPTLQDGALVLWESNAIVRYLAAQYAPALYPQAPAERALGDRWMDWTTSTFAGVFRDLFWGVVRTPEAERDHARIAAALTQSGELLARADAALAQQPYLSGGRFAMGDIPLGSFIYAWFEMPIERPELPHLQAWYARLRVRPAYQRGVMTALT

SEQ ID NO: 14855 - protein, 291 aa, Xanthomonas axonopodis pv. citri str. 306
MNQTTSTALVANNLPIPSALGSLDAYIGAVHQIPVLSVDEEQDLARRFRDELDLDAARELVHSHLRFVVHVARGYNGYGLPLGDLIQEGNIGLMKAVKRFDPDMGVRLVSFAVHWIRAEMHEFILKNWRIVKVATTKAQRKLFFNLRKSKTRLGWLNASEVTAVAKDLNVSEREVMEMESRLSGRDIGFDASSDEDDDHGPPSPVSYLVANEEDPSQAYERHDSEDNQLQLLREGMAGLDARSRDIVKRRWLDSDSKVTLQELADEYGVSAERIRQIEANALKKMKALFVA

SEQ ID NO: 14856 - protein, 424 aa, Xanthomonas axonopodis pv. citri str. 306
MIGSTQARPLDGQRLLLCVGGGIAAYKSLELVRRLRDAGAQVQVAMTGGAQQFITPLSFQALSGQPTRTTLWDSAAEQAMGHIELARWADRVIVAPATADLLARLAHGLADDLVTTLCLATTAPLTVAPAMNHRMWLHPATQANIATLRARGVTVVGPDDGPLAEGESGPGRLAEPAAIIAALAGGAAAASTAPEGARSVVAPVFIPSSAQLEGLRIVISAGPTFEDLDPVRYVGNRSSGKMGYALAAAAARQGADVVLVSGPVHQTTPDGVQRIDVRSAAQMRDAVLGAFPADIYIGAAAVADYTPKRVVSQKIKKTGETLTLELVRTPDILSEVAAQTGALKLVVGFAAETHDVEHYARGKLAAKRLDLIIANQVGIEGGGFESDNNAATAYWQGGERVFPSSSKTELADQLLALIAERLQA

SEQ ID NO: 14857 - protein, 112 aa, Xanthomonas axonopodis pv. citri str. 306
MKMIMAIVKPFKLDDVREALAGCGVAGITVTEVKGFGRQKGHTELYRGAEYVVDFLPKVKIEVAVTDDQAERVVEAIVGAAGTGKIGDGKVFVYDLGTVVRIRTGELDSDAL

SEQ ID NO: 14858 - protein, 243 aa, Xanthomonas axonopodis pv. citri str. 306
MNSSARRALVTGGSGDLGGAICRHLAAQGRHVIVHANGNLARADEVVAAIVADGGSAQAVAFDVADAQASSAALESLLEAGPIQIVVNNAGIHDDAPMAGMNVEQWHRVIDVSLHGFFNVTQPLLLPMARTRWGRVVSVSSVAAVLGNRGQTNYAAAKAALHGASKSLSREMASRGIAVNVVAPGVIESDMVGDSFAPEAIKQLVPAGRVGKPDEVAALVAFLCSDAAGYINGQVIGVNGGMG

SEQ ID NO: 14859 - protein, 280 aa, Nicotiana tabacum
MYRDRGGGSSKSEIVGGPLDRKRINDALDKHLEKSSPSTSRAFKDKAVPSTSAGKSHQHHPDHRATKNKCSDDESETDSEESDVSGSDGEDTSWISWFCNLRGNEFFCEVDDEYIQDDFNLCGLSSQVPYYDYALDLILDVESSHGDMFTEEQNELVESAAEMLYGLIHVRYILTSKGMAAMLEKYKNYDFGRCPRVYCCGQPCLPVGQSDIPRSSTVKIYCPKCEDIYYPRSKYQGNIDGAYFGTTFPHLFLMTYGHLKPQKSTQNYVPRVFGFKLHKT

SEQ ID NO: 14860 - protein, 208 aa, Dreissena polymorpha
SSHYQQWLLDKQDLARERQADLKVMSEDEYEKCMIFFANFIQALGEQSKVRQQVIATATVYFKRFYARNSLKCIDPWLMAPTCIFLASKVEEFGLISNSRLITTCQTVVKNKFSHAYPQEYPYRSNNVLECEFYLLEMMDCCLVVFHPYRPLVQYVSDISSTDDSILPLAWRIVNDSLRTDVCLLYPPYLIALSALHIACVIQQKDLK

SEQ ID NO: 14861 - protein, 386 aa, Oryzias luzonensis
MSSVEVVAQQLLAAEHPRRMGKGAAADPRRAALGELTNLNAVAATNGKVGPSKKPSKASCAQKPKPTELVAPMIQTGAAASAPVSAKPCVKEEQLCQAFSEVLLAVQDVDEQDADQPQLCSQYVKDIYKYLHVLEEQQPVRANYMQGYEVTERMRALLVDWLVQVHSRFQLLQETLYLTVAILDRFLQVHPVSRRKLQLVGVTAMLVACKYEEMYTPEVADFSYITDNAFTKSQIVEMEQVILRSLSFQLGRPLPLHFLRRATKVAGADVEKHTLAKYLMELTLLDYHMVHYRPSEVAAAALCLSQLLLDGLPWSLTQQQYSTYEEQHLKPIMRHIAKNVVLVNEGRTKFLAVKKKYSSSKLMKISLIPQLNSSTVKAMAESLHNP

SEQ ID NO: 14862 - protein, 401 aa, Oryzias luzonensis
MALRVTRNRLASARAELGGKTCSVAGPTQKPRAALGEIGNVAVINKDVTKKNVKTEVAKKTKVPAKAEKIEQPKAAVVPVKPAPEVQVPAQPEPASPTPMETSGCEPADLCQAFSDVILNTAIRDVDADDYNNPLLCSEYVKDIYKYLRQLEVEQSVKPNYLEGQEVTGNMRALLIDWLVQVSLKFRLLQETMYMTVGIIDRFLQDHPVPKKQLQLVGVTAMFLASKYEEMYPPEISDFAYVTDKAYTTAQIRDMEMTILRVLKFQLGRPLPLQFLRRASKIYEVTAEQHTLAKYLLELSMVDYAMDHFPPSMVASAALALTLKVLDAGEWDVTLQHYMAYTADTLTPVMAHIAKNVVKVNNGQTKHMTIKGKYFTSKQMRIATIFQLKSSVVKDLATQIS

SEQ ID NO: 14863 - protein, 303 aa, Oryzias luzonensis
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWKGGSLSSMVKNLDKNGLDLLAKMLIYNPPKRISAREAMTHPYFDDLDKSTLPAACINGV

SEQ ID NO: 14864 - protein, 382 aa, Oryzias javanicus
MSSVEAVTQQQLLAAENPVRMGKGAADPRRAALGEITNRNAAAAANRKMGPSKKQPKPSCAQKPQPVVHTSAGDPAPISADMSMKVEQDLSQAFSEVLMLAVQDVDEQDADQPQLCSQYVKDIYKYLHTLEEQQAIRPNYMQGYSVTEHMRALLVDWLVQVHSRFQLLQETLYLTVAILDRFLQVHPVSRRKLQLVGVTAMLVACKYEEMYPPEVGDFAYITDDAFTKFQIVEMEQVILRSLGFQLGRPLPLHFLRRASKVADADVEKHTLAKYLLELTLLDYHMVHYRPSEAAAAALCLSQLLLDGLPWSLEQQHYSTYDEQHLKPIMQLMAKNVVQVTEGRTKFLAVKKKYSSSKLMKISLIPQLNSSTIKVMAEALQNP

SEQ ID NO: 14865 - protein, 401 aa, Oryzias javanicus
MALRVTRNRLASTRAEQGGKTCSVSGPTLKPRAALGEIGNVAANKDVTKKNVKMEAAKKTRITAKAEKIEQPKATVVPVKPEPKVQVPAQPEPASPTPMETSGCEPADLCQAFSDVILNTAIRDVDADDYDNPMLCSEYVKDIYKYLRQLEVEQSVKPNYLQGQEVTGNMRAILIDWLVQVNLKFRLLQETMYMTVGIIDRFLQDHPVPKKQLQLVGVTAMFLASKYEEMYPPEISDFAYVTDRAYTTAQIRDMEMTILRVLKFQLGRPLPLQFLRRASKIYEVTAEQHTLAKYLLELSIVDYDMAHFPPSTVASAALGLTLKVLDAGEWDVTLQHYMDYTAHTLTPVMAHIAKNVVKVNDGLTKHMAIKGKYSTSKQMRVATIAQLKSSLVKDLAKQLSQ

SEQ ID NO: 14866 - protein, 303 aa, Oryzias javanicus
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWMEGSLSSMVKNLDKNGLDLLAKMLIYNPPKRISAREAMTHPYFDDLDKSTLPAACINGV

SEQ ID NO: 14867 - protein, 388 aa, Oryzias curvinotus
MSSVEVVAQQQQLLAAEHPRRMGKGAAADPRRAALGELTNLNAVAATNGKVGPSKKPSKASCVQKPKPPQLVAPMIQTGAAASAPVSAKPCVKEEQLCQAFSEVLLAVQDVDEQDADQPQLCSQYVKDIYKYLHVLEEQQPVRANYMQGYEVTERMRALLVDWLVQVHSRFQLLQETLYLTVAILDPFLQVHPVSRRKLQLVGVTAMLVACKYEKMYAPEVGDFSYITDNAFTKSQIVEMEQVILRSLSFQLGRPLPLHFLRRASKVAGADVEKHTLAKYLMELTLLDYHMVHYRPSEVAAAALCLSQLLLDGLPWSLTQQQYSTYEEQHLKPIMQHIAKNVVLVNEGRTKFLAVKKKYSSSKLMKISLIPQLNSSTVKALAESLLNP

SEQ ID NO: 14868 - protein, 401 aa, Oryzias curvinotus
MALRVTRNRLASTRAELGGKTCSVAGPTQKPRAALGEIGNVAVINKDVTKKNVKTEVAKKTKIPAKAEKIEQPKAAVVPVKPAPEVQVPVQADPASPTPMETSGCEPADLCQAFSDVILNTAIRDVDADDYDNPMLCSEYVKDIYKYLRQLEVEQSVKPNYLEGQEVTGNMRAILIDWLVQVSLKFRLLPETMYMTVGIIDRFLQDHPVPKKQLQLVGVTAMFLASKYEEMYPPEISDFAFVTDRAYTTAQIRDMEMTVLRVLKFQLGRPLPLQFLRRASKIYEVTADQHTLAKYLLELSMVDYDMAHFPPSMVASAALALTLKVLDAGEWDVTLQHYMGYTAETLTPVMAHIAKNVVKVNNGQTKHMAIKGKYSTSKQMRIATISQLKSSAVKDLATQIS

SEQ ID NO: 14869 - protein, 303 aa, Oryzias curvinotus
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLSRAFGVPVRVYTHEVVTLWYRAPEVLLGSPRYSTPVDVWSTGTIFAELATKKPLFHGDSEIDQLFRIFRTLGTPNNDVWPDVESLPDYKSTFPKWKGGSLSSMVKNLDKNGLDLLAKMLIYNPPKRISAREAMTHPYFDDLDKSTLPAACINGV

SEQ ID NO: 14870 - protein, 303 aa, Oryzias latipes
MEDYVKIEKIGEGTYGVVYKGRHKSTGQVVAMKKIRLESEEEGVPSTAVREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWKEGSLSSMVKNLDKNGLDLLAKMLIYNPPKRISAREAMTHPYFDDLDKSTLPAACINGV

SEQ ID NO: 14871 - protein, 387 aa, Oryzias latipes
MSSVEIVAQQLLAAEHPRRMGKGAAADPRRAALGELTNLNAAAATNGKVGPAKKPLKASCAQKPKLTQLVASMIQTGAAASAPVLAKPSVKEEQELCQAFSEVLLAVQDVDEQDADQPQLCSQYVKDIYKYLHILEEQQPVRANYMQGYEVTERMRALLVDWLVQVHSRFQLLQETLYLTVAILDRFLQVHPVSRRKLQLVGVTAMLVACKYEEMYAPEVGDFAYITDNAFTKSQIVEMEQVILRSLSFQLGRPLPLHFLRRATKVAGADVEKHTLAKYLMELTLLDYHMVHYRPSEVAAAALCLSQLLLDGLPWSLTQQQYSTYEEQHLKPIMQHMAKNVVLVNEGRTKFLAVKKKYSSSKLMKISLIPQLNSSTVKTMADALHDH

SEQ ID NO: 14872 - protein, 404 aa, Oryzias latipes
MALRVTRNRLASTRAELGGKTCSVAGPTQKPRAALGEIGNVAVINKDVTKKTIKTEVAKKTKIPAKAEKIELPKAAVVPVKPAPEVQVTEVPDQAEPASPTPMETSGCESADLCQAFSDVILNTAIRDVDADDYDNPMLCSEYVKDIYKYLRQLEMEQSVKPNYLEGQEITGNMRAILIDWLVQVGLKFRLLQETMYMTVGIIDRFLQDHPVPKKQLQLVGVTAMFLASKYEEMYPPEISDFAYVTDRAYTTAQIRDMEMTILRVLKFQLGRPLPLQFLRRASKIYEVTAEQHTLAKYLLELSMVDYDMAHFSPSLVASAALALTLKVLDAGEWDVTLQHYMEYTAETLTPVMAHIAKNVVKVNNGQTKHMAIKGKYSTSKQMRIATISQLKSSVVKDLATQIS

SEQ ID NO: 14873 - protein, 429 aa, Mycobacterium leprae [sequence omitted]

SEQ ID NO: 14874 - protein, 355 aa, Oryzias latipes
MGCTVSQEDKAAADRSKMIDKNLREDGEKAAREVKLLLLGAGESGKSTIVKQMKIIHEDGYSEDECKQYRAVVYSNTVQSIMAIIKAMTILHLDYERPEREEDAKRLFKMAAEAEERGDLPEELANIIKDLWADSGIQHCLTRAREYQLNDSAAYYLKDLERISKPDYIPTQQDVLRTRVKTTGIVETHFTFKDLHFKMFDVGGQRSERKKWIHCFEGVTAIIFCVAMSAYDLVLAEDEEMNRMHESMKLFDSICNNKWFTETSIILFLNKKDLFEQKIAHSPLTICFPEYEGPNTYQEAQAYIQTKFEDLNKKKETKEIYTHFTCATDTKNVQFVFDAVTDVIIKNNLKDCGLF

SEQ ID NO: 14875 - protein, 304 aa, Mus musculus
MVAPRPLCWLVHLYQGKQYYSMAGNFWQSSHYLQWILDKQDLLKERQKDLKFLSEEEYWKLQIFFTNVIQALGEHLKLRQQVIATATVYFKRFDARYSLKSIDPVLMAPTCVFLASKVEEFGVVSNTRLIAATTSVLKTRFSYAFPKEFPYRMNHILECEFYLLELMDCCLIVYHPYRPLLQYVQDMGQEDVLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 14876 - protein, 268 aa, Arabidopsis thaliana
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 14877 - protein, 674 aa, Rhodobacter capsulatus
MAAKDIDDTKPDTAADEDASFDMSQAAVKRMIGEAKERGYITIDQLNAVMPPETVSGEQIEDVMSMLSEMGINVVEGEEVEESEGGEVVETGSGSREIAVAGAAGETLDRTDDPVRMYLREMGSVELLSREGEIAIAKRIEAGRNTMIAGLCESPLTFQAITIWRDELLSEEILLRDVIDLEATFGRSLDGDEGLEGMEGIEGPVVEGLDLEAAEGAAPAARRPASDEPEYDADGNPISRIDEEEDDDDSSNMSLAAMEAALKPKVLETLELIARDYAKLAEMQDLRMSATLNEDGTFTVAEEAAYQKLRSEIVLLVNELHLHNNRIEALIDQLYGINRKIMSIDSGMVKLADAARINRREFIDEYRGYELDPTWMDRMSAKPARAWVTLFEKSRHKVEDLRHEMAQVGQYVGVDISEFRRIVNQVQKGEKEARQAKKEMVEANLRLVISIAKKYTNRGLQFLDLIQEGNIGLMKAVDKFEYRRGYKFSTYATWWIRQAITRSIADQARTIRIPVHMIETINKLVRTGRQMLHEIGREPTPEELAEKLQMPLEKVRKVMKIAKEPISLETPIGHEEDSQLGDFIEDKNAILPLDSAIQENLKETTTRVLPSLTPREERVLRMRFGIGMNTDHTLEEVGQQFSVTRERIRQIEAKALRKLKHPSRSRKLPSFLDQ

SEQ ID NO: 14878 - protein, 109 aa, Anabaena variabilis
SIYIGNLSYQVTEEDLKLAFAEYGKVSRVQLPTDRETGRPRGFAFVEMETEAQETAAIEALDGAEWMGRDLKVNKAKPREERSSSPRGGGGSWGNNNRGGGGGGNRRSY

SEQ ID NO: 14879 - protein, 93 aa, Anabaena variabilis
TIYVGNLSYRATEAELKAVFADYGEVKRVVLPTDRETGRMRGFAFVEMNEDAQEDAAITELDGAEWMGRQLRVNKAKPREDDRRGSWGKKQDY

SEQ ID NO: 14880 - protein, 972 aa, Gallus gallus
MDFRANLQRQVKPKTLSEEERKVHAPQQVDFRSVLAKKGTPKTPLPEKVPPPKPAVTDFRSVLGAKKKPPAENGSASTPAPNARAGSEAQNATPNSEAPAPKPVVKKEEKNDRKCEHGCAVVDGGIIGKKAENKPAASKPTPPPSKGTAPSFTEKLQDAKVADGEKLVLQCRISSDPPASVSWTLDSKAIKSSKSIVISQEGTLCSLTIEKVMPEDGGEYKCIAENAAGKAECACKVLVEDTSSTKAAKPAEKKTKKPKTTLPPVLSTESSEATVKKKPAPKTPPKAATPPQITQFPEDRKVRAGESVELFAKVVGTAPITCTWMKFRKQIQENEYIKIENAENSSKLTISSTKQEHCGCYTLVVENKLGSRQAQVNLTVVDKPDPPAGTPCASDIRSSSLTLSWYGSSYDGGSAVQSYTVEIWNSVDNKWTDLTTCRSTSFNVQDLQADREYKFRVRAANVYGISEPSQESEVVKVGEKQEEELKEEEAELSDDEGKETEVNYQTVTINTEQKVSDVYNIEERLGSGKFGQVFRLVEKKTGKVWAGKFFKAYSAKEKENIRDEISIMNCLHHPKLVQCVDAFEEKANIVMVLEMVSGGELFERIIDEDFELTERECIKYMRQISEGVEYIHKQGIVHLDLKPENIMCVNKTGTSIKLIDFGLARRLESAGSLKVLFGTPEFVAPEVINYEPIGYETDMWSIGVICYILVSGLSPFMGDNDNETLANVTSATWDFDDEAFDEISDDAKDFISNLLKKDMKSRLNCTQCLQHPWLQKDTKNMEAKKLSKDRMKKYMARRKWQKTGHAVRAIGRLSSMAMISGMSGRKASGSSPTSPINADKVENEDAFLEEVAEEKPHVKPYFTKTILDMEVVEGSAARFDCKIEGYPDPEVMWYKDDQPVKESRHFQIDYDEEGNCSLTISEVCGDDDAKYTCKAVNSLGEATCTAELLVETMGKEGEGEGEGEEDEEEEEE

SEQ ID NO: 14881 - protein, 252 aa, Bacillus coagulans
MDAELKKAENKARLKDEEVKNLIRRTEEGDQEARDLIVEKNIRLVWSVVHRFLNRGYEPDDLFQIGCIGLLKSVDKFDLSYDVKFSTYAVPMIIGEIQRFLRDDGTVKVSRSLKETGNRIRKIRDELTKKLGRSPTVHEIASELGMPVEEVVMAQEAGKAPSSIHETVYENDGDPITLLDQISDQNDQKWFDQIALQEAIRGLEERERLIVYLRYYKDQTQSEAGERLGISQVQVSRLEKKILRVMKERMEL

SEQ ID NO: 14882 - protein, 323 aa, Mycobacterium tuberculosis
MADAPTRATTSRVDSDLDAQSPAADLVRVYLNGIGKTALLNPAGEVELAKRIEAGLYAEHLLETRKRLGENRKRDLAAVVRDGEAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQHLGREATDEELAAESGIPIDKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMSKLRHGERADRLRSYAS

SEQ ID NO: 14883 - protein, 381 aa, Staphylococcus aureus subsp. aureus MW2
MLTEQEKDIIKQTVPLLKEKGTEITSIFYPKMFKAHPELLNMFNQTNQKRGMQSSALAQAVMAAAVNIDNLSVIKPVIMPVAYKHCALQVYAEHYPIVGENLLKAIQDVTGLEENDPVIQAWAKAYGVIADVFIQIEKEIYDQMMWIGFKPFKITNIKQESEDIKSFTVETEEYDFSEFTPGQYITVDVSSEKLPYRAKRHYSIVSGEKNHLTFGVKRDVTTEHEGEVSTILHDEIKEGDMINLAAPVGGFVLENTTEPQLFLGSGIGVTPLVAMYEAASAKGLDTQMVQVAENEQHLPFKDNFNSIASHHDNAKLYTHLKDKQGYIGAEELQAFLANKPEIYICGGTKFLQSMIEALKSLNYDMDRVHYETFIPRLSVAV

SEQ ID NO: 14884 - protein, 304 aa, Staphylococcus aureus subsp. aureus MW2
MTNKVVILGSTNVDQFLTVERYAQPGETLHVEEAQKAFGGGKGANQAIATARMQADTTFITKIGTDGVADFILEDFKAAHIDTSYIIKSTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 14885 - protein, 613 aa, Staphylococcus aureus subsp. aureus MW2
MSQFLTQLKDNVLVADGAIGTILYSEGLDTCPEAYNLSHPDKVERIHRSYIEAGADVIQTNTYGANFEKLKRFGLEDKVKAIHQAAVRIAKKAANKDTYILGTVGGFRGIKQEDISLQTILYHTEIQIDTLIEEGVDALLFETYYDLEELTNVISRTRKKYDIPIIAQLTASNTNYLVNGQAINEGLKQLVQCGANIVGLNCHHGPHHMQESFTHIELPEHAYLSCYPNASLLDIENSEFKYSDNAQYFGQVAQNLIHEGVRLIGGCCGTTPEHIKFIKESIQTLKPVNDKKVIPIPTKALFNPSQNKVRQSLTSKVQERPTVIIELDTPKHLDTDRFFENIAKLDKANVDAVTLADNSLATVRISNIAAASLIKQYYNIEPLVHITCRDRNLIGLQSHLLGLSLIGVNEILAITGDPSKVGHLPGATNVYDVNSKGLTELALRFNQGINTDGDALKKRTHFNIAGAFNPNVRKLDGAVKRLEKKIESGMSYFITQPVYSKEKIIEIYHATKHLNKPFFIGIMPIASYKNALFLHNEVPGIKMSDEILQQFEAVKDDNAKTRELSLKLSKDLIDTVHEYFNGLYIITPFQNVEDSLELAAYSKSITAHKEAIL

SEQ ID NO: 14886 - protein, 488 aa, Staphylococcus aureus subsp. aureus MW2
MWESKFAKESLTFDDVLLIPAQSDILPKDVDLSVQLSDKAKLNIPVISAGMDTVTESKMAIAMARQGGLGVIHKNMGVEEQADEVQKVKRSENGVISNPFFLTPEESVYEAEALMGKYRISGVPIVDNKEDRNLVGILTNRDLRFIEDFSIKIVDVMTQENLITAPVNTTLEEAEKILQKHKIEKLPLVKDGRLEGLITIKDIEKVIEFPNAAKDEHGRLLVAAAIGISKDTDIRAQKLVEAGVDVLVIDTAHGHSKGVIDQVKHIKKTYPEITLVAGNVATAEATKDLFEAGADIVKVGIGPGSICTTRVVAGVGVPQITAIYDCATEARKHGKAIIADGGIKFSGDIIKALAAGGHAVMLGSLLAGTEESPGATEIFQGRQYKVYRGMGSLGAMEKGSNDRYFQEDKAPKKFVPEGIEGRTAYKGALQDTIYQLMGGVRAGMGYTGSHDLRELREEAQFTRMGPAGLAESHPHNIQITKESPNYSF

SEQ ID NO: 14887 - protein, 680 aa, Staphylococcus aureus subsp. aureus MW2
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEVGMVCDGYLMRIENLTPSNFFNSASEDTITKIKLNALREQRRILRELIDTDEVSEGTALKLREAINYDEMVIVDSMT

SEQ ID NO: 14888 - protein, 279 aa, Staphylococcus aureus subsp. aureus MW2
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALNRNARQGKNPDDVKIGDLK

SEQ ID NO: 14889 - protein, 572 aa, Staphylococcus aureus subsp. aureus MW2
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 14890 - protein, 277 aa, Staphylococcus aureus subsp. aureus MW2
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQILNDETIKDIAQELGKSPAQVVLRWNVQHGVVTIPKSVTPNRISENFQIFDFELSDEQMTRIDGLNQDKRIGPDPKTFEG

SEQ ID NO: 14891 - protein, 256 aa, Staphylococcus aureus subsp. aureus MW2
MAKESKSANEVSPEQINQWIKEHQENKNTDAQDKLVKHYQKLIESLAYKYSKGQSHHEDLVQVGMVGLIGAINRFDMSFERKFEAFLVPTVIGEIKRYLRDKTWSVHVPRRIKEIGPRIKKVSDELTAELERSPSISEIADRLEVSEEEVLEAMEMGQSYNALSVDHSIEADKDGSTVTLLDIMGQQDDHYDLTEKRMILEKILPILSDREREIIQCTFIEGLSQKETGERIGLSQMHVSRLQRTAIKKLQEAAHQ

SEQ ID NO: 14892 - protein, 389 aa, Staphylococcus aureus subsp. aureus MW2
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVVMIIGAIILGISDHIALFTVGCLTISICAGIGNGLIFKLVPSYFLNEAGSANGIVSMMGGLGGFFPPLVITYVANLTGSSHLAFIFLAVFGCIALFTMRHLYQKEYGSLKNG

SEQ ID NO: 14893 - protein, 272 aa, Staphylococcus aureus subsp. aureus MW2
MKRLENKVAVVTGASTGIGQASAIALAQEGAYVLAVDIAEAVSETVDKIKSNGDKAKAYIVDIASEQQIDNFASEIREQIGHVDVLFNNAGVDNAAGRIHEYPTDVYDKIMNVDMRGTFLMTKMMLPLMMTKGGSIVNTSSFSGQAADLYRSGYNAAKGAVINFTKSIAIEYGRDGIRANAIAPGTIETPLVDKLTGTSEDKEGKAFRENQKWMTPLGRLGKPEEVGKLVVFLASDESSFITGETIRIDGGVMAYTWPGEMLSDDSWKRTLE

SEQ ID NO: 14894 - protein, 199 aa, Staphylococcus aureus subsp. aureus MW2
MTEKEKMLAEKWYDANFDQYLINERARAKDICFELNHTRPSATNKRKELIDQLFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 14895 - protein, 496 aa, Staphylococcus aureus subsp. aureus MW2
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 14896 - protein, 463 aa, Methanocaldococcus jannaschii
  unsure (1)..(463): unsure at all Xaa locations
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIXTIIISK

SEQ ID NO: 14897 - protein, 589 aa, Arabidopsis thaliana
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGIGANVALIFSGRTVKYFSNLRKNLGPGVDGSFVESHDEHCGGNGTRICLSIGGSNRYVPLPTRSKNKKEKPKMGTMESLKFLVSSPYIRDLATLVVAYGISINLVEVTWKSKLKAQFPSPNEYSAFMGAFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRLKKSLRRKWRELHR

SEQ ID NO: 14898 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLSLGEINKAFDLLHEGTCLRCVLDTSK

SEQ ID NO: 14899 - protein, 287 aa, Arabidopsis thaliana
MERIQKDVTQSMRGIRVTEQQEHGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTTTFLRRFIQPAQASYKVPFIELEYLANYLAELTLVEYSFLRFLPSLIAASAVFLARWTLDQTDHPWNPTLQHYTRYEVAELKNTVLAMEDLQLKHQWLYSRCHP

SEQ ID NO: 14900 - protein, 728 aa, Arabidopsis thaliana
MDDDGELGMFFPSWTSKNPIDTVESRGLMFSCFVAALVGILTIAYTAFQWRRNINLSWTKAIARSKKNPKARHKVPVAPHSWELDPIARAKNLNCCVCLKSMSPSQAIVASESFFHRCTICGAAAHFNCSSSAPKDCKCVSMVGFEHVVHQWAVRWTEGADQTDDSSFCSYCDESCSSSFLGGSPIWCCLWCQRLVHVDCHSNMSNETGDICDLGPLRRLILCPLYVKELTRNPSGGFLSSITHGANELASTALASIRIQSKKYKQTNETSADTGNSGSNCDESTESTADTGPTVNGAHAVLENSISVMNGDSSNGDSDSNGKLEKKPSVKRTGSFGQKEYHALRSKLKYELADLPSDARPLLVFINKKSGAQRGDSLRQRLHLHLNPVQVFELSSVQGPEVGLFLFRKVPHFRVLVCGGDGTAGWVLDAIEKQNFISPPAVAILPAGTGNDLSRVLNWGGGLGSVERQGGLSTVLQNIEHAAVTVLDRWKVSILNQQGKQLQPPKYMTNYIGVGCDAKVALEIHNLREENPERFYSQFMNKVLYAREGARSIMDRTFEDFPWQVRVEVDGVDIEVPEDAEGILVANIGSYMGGVDLWQNEDETYENFDPQSMHDKIVEVVSISGTWHLGKLQVGLSRARRLAQGSAVKIQLCAPLPVQIDGEPWNQQPCTLTISHHGQAFMLKRAAEEPLGHAAAIITDVLENAETNQVINASQKRTLLQEMALRLT

SEQ ID NO: 14901 - protein, 268 aa, Arabidopsis thaliana
MSSDSSREENVYLAKLAEQAERYEEMVEFMEKVAKTVETEELTVEERNLLSVAYKNVIGARRASWRIISSIELKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNSSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 14902 - protein, 284 aa, Arabidopsis thaliana
MTAVTAAQRSVPAPFLSKTYQLVDDHRTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 14903 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFEPSRRITVDEALCHPYLAPLHDINEEPVCVRPFNFDFEQPTLTEENIKELIYRETVKFNPQDSV

SEQ ID NO: 14904 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 14905 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 14906 - protein, 281 aa, Arabidopsis thaliana
MAADNAYLMQFVDETSFYNRIVLSHLLPANLWEPLPHFLQTWLRNYLAGTLLYIISGFLWCFYIYYRKINVYLPKDAIPTIKAMRLQMFVAMKAMPWYTLLPTVSESMIERGWTKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWAANIHDCIHGNIWPVMGAGYHTIHHTTYKHNYGHYTIWMDWMFGSLRDPLLEEDDNKDSFKKAE

SEQ ID NO: 14907 - protein, 62 aa, Brassica napus
MRGILVDWLVEVAEEYTLVPDTLYLTVYLIDWFLNGNYVERNRLQLLGVTCMLIASKYEEIY

SEQ ID NO: 14908 - protein, 282 aa, Glycine max; identical to SEQ ID NO: 1241

SEQ ID NO: 14909 - protein, 371 aa, Medicago sativa
MSVESAENNIRGVPTHGGRYLQYNIYGNLFEVSRKYVPPIRSVGRGAYGIVCAAVNAETREEVAIKKIGNAFDNRIDAKRTLREIKLLRHMDHENVMSIKDIIRPPQKENFNHVYIVSELMDTDLHQIIRSNQPMTDDHCRYFVYQLLRGLKYVHSANVLHRDLKPSNLLLNANCDLKIGDFGLARTTSETDFMTEYVVTRWYRAPELLLNCSEYTAAIDIWSVGCILGEIVTRQPLFPGRDYVHQLRLVTELIGSPDDASLGFLRSENARRYVRQLPQYPKQNFSARFPNMSPGAVDLLEKMLIFDPSKRIKVDEALCHPYMAPLHDINEEPVCARPFSFDFEEPMFTEEDIKELIWKESVRFNPDPPIN

SEQ ID NO: 14910 - protein, 273 aa, Pisum sativum
MDMEGSIGTKEHLAKGKRTKRGIRMLSPCTVANTTVTSSCSSAIGDGGRSFSSTTFDSTEQEEEADMANCLILLAQGRTGGQEETRCHNHRQQDGGYNNIVTEKATRNGFESYECKTCNRFFHSFQALGGHRASHKKPKMKEIISAGETEEQNNHIHNKNVSTISPLVPPHVSLELRCGGNLNFHGHGNNNKPNRSNKVHECSICGAEFTSGQALGGHMRRHRACTNKNNNNNVGDVHGKTRNILELDLNLPAPEEDLRDSTFQFPAMVGCHY

SEQ ID NO: 14911 - protein, 145 aa, Sesbania rostrata
EIATIPPAVNQVEMNPSWQQGNLREFCKQKGIHVSAWSPLGAYKIFWGSGAVMENQILQDIATAKGKTIAQVALRWVYQQGSSAMAKSFNKERMKQNLEIFDFELSEEELEKIKQIPQRRQYTGDMWLSENGSCKTLEELWDGDV

SEQ ID NO: 14912 - protein, 209 aa, Nicotiana sylvestris
MADDEYRCFIGNLSWSTSDRGLKDAFEKFGNLVDAKVVLDKFSGRSRGFGFVTFDEKRAMEDAIEAMNGVDLDGRDITVDKAQPDKGSGRDFDSDRPRDRDRDRGRDRDRDRGSRDYGGGRGSGGGGDCFNCGKPGHFARECPSEGGRGGRYGGGGGGSRSSGYGPDRNGDRYGSRSGRDGGGRGGGERFSRDRSGPYERRSSGGSRAG

SEQ ID NO: 14913 - protein, 766 aa, Nicotiana tabacum
MGAPILSDLGTEILIPVCAVVGIAFSLFQWFLVSKVTLSADKSSGAADDKNGYAAESLIEEEEGINDHNVVQKCAEIQNAISEGATSFLFTEYQYVGVFMVAFAILIFLFLGSVEGFSTKNQPCTYDSTKTCKPALATAVFSTVSFLLGAVTSVVSGFLGMKIATYANARTTLEARKGVGKAFIVAFRSGAVMGFLLAANGLLVLYITILLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTVGIAVVTWIALPSIFTIFNFGAQKEVKSWQLFLCVGVGLWAGLIIGFVTEYYTSNAYSPVQDVADSCRTGAATNVIFGLALGYKSVIIPIFAIAVSIFVSFSFAAMGYIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSDAHKAAVIGDTIGDPLKDTSGPSLNILIKLMAVESLVFAPFFATHGGLLFKLF

SEQ ID NO: 14914 - protein, 764 aa, Nicotiana tabacum
MGSALLPDLGTQIVIPVCAVIGIVFSSFQWYLVSRVKVSSEHGATSPSSNKNNKNGYGDCLIEEEEGINDHNVVAKCADIQNAISEGATSFLFTEYQYVGIFMIAFAILIFLFLGSVEGFSTSSQPCTYNKEKRCKPALATAIFSTVSFLLGAITSVISGFLGMKIATYANARTTLEARKGVGKACLVQVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKAVKEIEPALKNQLIISTAIMTVGIAIVTWTCLPSSFTIFNFGTQKVVKNWQLFLCVAVGLWAGLIIGFVTEYYTSNAYSPVQDVADSCSTGAATNVIFGLALGYKSVIIPIFAIAIAIFVSFTFAAMGYIAVAALGMLSTIATGLAIDAYGPISDNAGGIAEMAGMSHRIRERTDALDAAGNTTAAIGKGFAIGSAALVSLALFGAFVSRAGISTVDVLTPQVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 14915 - protein, 765 aa, Nicotiana tabacum
MGAALLPDLGAEIVIPVCAVIGIVFSLVQWYLVSNVKLTPESSSPSNNGKNGYGDYLIEEEEGINEQNVVVKCAEIQNAISEGATSFLFTTYQYVGIFMIAFAILIFLFLGSVEGFSTKSQPCTYNKEKLCKPALATAIFSTVSFLLGAVTSVVSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMLYPLLISSMGILICLITTLFATDFFEIKAVKEIEPALKNQLIISTALMTVGIAIVTWTCLPSSFTIFNFGAQKVVKNWQLFLCVAVGLWAGLIIGFVTEYYTSNAYSPVQDVADSCRTGAATNVIFGLALGYKSVIIPIFAIAIAIFVSFSFAAMGYIAVAALGMLSTIATGLAIDAYGPISDNAGGIAEMAGMSHRIRERTDALDAAGNTTAAIGKGFAIGSAALVSLALFGAFVSRAAITTVDVLTPQVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 14916 - protein, 557 aa, Nicotiana tabacum
MNSWIRLFIVLAACLFPLVVECRIRHYKFNVVMKNTTRLCSSKPIVTVNGKFPGPTIYAREGDTVLVKVVNHVKYNLSIHWHGIRQLRTGWADGPAYITQCPIQPGQNYVYNFTITGQRGTLFWHAHILWLRATVHGAIVILPNLGVPYPFPKPNHEAVVILAEWWKSDTEAVINEAIKSGLAPNVSDAHTINGHPGPVSNCASQGGYKLNVDPGKTYMLRVINAALNEELFFKIAGHKMTVVEVDATYIKPFKTDTIVIAPGQTTNVIVTANQGSGKYMVAASPFMDAPIAVDNVTAIATLHYSGTQGNSHISLTSTPPKNATPVANTFLDSLRSLNSKKYPAKVPKKIDHSLFFTVGLGINPCPTCKQGNGSRVVASVNNVTFVMPTVALLQAHFFGTKGVFTTDFPANPPFAFNYTGTGPTNLATMNGTKVYRLRYNDTVQLVLQDTGIIAPENHPIHLHGFNFFLVGKGIGNFNPKTDPKNFNLVDPVERNTVGVPAGGWVAIRFRADNPGVWFMHCHLEIHTTWGLKMAWLVDNGKGPNESLLPPPKDLPKC

SEQ ID NO: 14917 - protein, 212 aa, Petunia x hybrida
MGRGKIEIKRIENSSNRQVTYSKRRNGIIKKAKEITVLCDAKVSLIIFGNSGKMHEYCSPSTTLPDMLDGYQKTSGRRLWDAKHENLSNEIDRIKKENDSMQVKLRHLKGEDINSLNHKELMVLEEGLTNGLSSISAKQSEILRIVRKNDQILEEEHKQLQYALHQKEMAAMGGNMRMIEEVYHQRDRDYEYQQMPFALRVQPMQPNLHERM

SEQ ID NO: 14918 - protein, 953 aa, Flaveria bidentis
MMSSLSVEGMLLKSARESCLPARVNQRRNGDLRRLNHHRQSSFVRCLTPARVSRPELRSSGLTPPRAVLNPVSPPVTTAKKRVFTFGGKRSEGNRDMKSLLGGKGANLAEMSSIGLSVPPGLTISTEACEEYQQNGKSLPPGSWDEISEGLDWVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPDAYKELVENCEILEGHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTIEYKVGTMIEIPRAALIAEEIGKEADFFSFGTNDLTQMTFGYSRDDVGKFLQIYLAQGILQHDPFEVIDQKGVGQLIKMATEKGRAANPNLKVGICGEHGGEPSSVAFFDGVGLDYVSCSPFRVPIARLAAAQVIV

SEQ ID NO: 14919 - protein, 319 aa, Avena fatua
MASAKAMGQGEQDRFVLKSGHAIPAVGLGTWRAGSDTAHSVQTAITEAGYRHVDTAAQYGIEKEVDKGLKAAMEAGIDRKDLFVTSKIWRTNLAPERARPALENTLKDLQLDYIDLYLIHWPFRLKDGAHQPPEAGEVLEFDMEGVWKEMEKLVKDGLVKDIDVCNFTVTKLNRLLRSANIPPAVCQMEMHPGWKNDKIFEACKKHGIHVTAYSPLGSSEKNLVHDPVVEKVANKLNKTPGQVLIKWALQRGTSVIPKSSKDERIKENIQAFGWEIPEDDFQVLCSIKDEKRVLTGEELFVNKTHGPYKSASEVWDHEN

SEQ ID NO: 14920 - protein, 402 aa, Avena fatua
QQQPWGYQQQPGAMDAGANAASFSAPAVQATSSEMAPSGGVYRQTHSQRRSSDDGYNWRKYGQKQVKGSENPRSYYKCTFPNCPTKKKVETSIEGQITEIVYKGTHNHAKPLSTRRGSGGGGGGAAQVLQSGGGGDASEHSFGAMSGAPVSTPENSSASFGDDEIGASSPRAGNVGGDDLDDDEPDSKKWRKDGDGEGSNSMAGNRTVREPRVVVQTMSDIDILDDGYRWRKYGQKVVKGNPNPRSYYKCTTVGCPVRKHVERASHDLRAVITTYEGKHNHDVPAARGSAALYRPAPRAAADSAMSTSQQYTANQQQPSAMTYQTSAAAGTQQYAPRPDGFGSQNQGSFGFNGSFGFSAGFDNPTGSYMSQHQQQQRQNDAMQASGAKEEPREDMFFQHSQF

SEQ ID NO: 14921 - protein, 349 aa, Avena fatua
MDPWIGSQPSLSLDLHVGLPPMGHHHHRYQAAAPMVAMAKPKILVEESFMPPKKDPEVAVLESELQRVSEENRRLGEMLREVAAKYEALQGQFTDLVTAQQANAGGSNNNNHPSSASEGGSVSPSRKRKSEDSLGTPPSHAHQHHHAFPAPADQAECTSGEPCKRIREECKPVVSKRYVHADPSDLSLVVKDGYQWRKYGQKVTKDNPCPRAYFRCSFAPGCPVKKKVQRSAEDKTILVATYEGEHNHSAPPPAHPQQQDAKNAAAKPPQAPVPVPAPHHPPPQQQQPKQETVVVVSEETAAAAASEMMRRNLAEQMAMTLTRDPSFKAALVTALSGRILELSPSRDVN

SEQ ID NO: 14922 - protein, 507 aa, Hordeum vulgare
MEVEAGAHGDTAASKFTLPVDSEHKAKSFRLFSFANPHMRTFHLSWISFFTCFISTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYFDHFHLDLRAAGTIAACFGMANIVARPTGGYLSDLGARYFGMRARLWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKAKGLHIAGQKFAENSRSERGRRNVILATSATPPNNTPQHV

SEQ ID NO: 14923 - protein, 509 aa, Hordeum vulgare
MEVESSSHGAGDEAASKFSLPVDSEHKAKSIRLFSFANPHMRTFHLSWISFFTCFVSTFAAAPLVPIIRDNLNLAKADIGNAGVASVSGSIFSRLAMGAICDLLGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGMMHVVMGLLVLTMGQDLPDGNLASLQKKGEMAKDKFSKVVWGAVTNYRTWIFVLLYGYCMGVELTTDNVIAEYYFDHFHLDLRTSGTIAACFGMANIVARPAGGYLSDLGARYFGMRARLWNIWILQTAGGAFCLWLGRAKALPESITAMVLFSICAQAACGAWFGVIPFVSRRSLGIISGLSGAGGNFGAGLTQLLFFTSSKYGTGRGLEYMGIMIMACTLPVALVHFPQWGSMLLPPNANATEEEFYAAEWSEEEKKKGLHIPGQKFAENSRSERGRRNVILATAATPPNNTPQHA

SEQ ID NO: 14924 - protein, 473 aa, Hordeum vulgare
GSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGRPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQISPETPSSASEARQYGSPGFGLRQHFAAERKWALGLQSRAHPREIITEVLKALQELNVCWKKIGHYNMKCRWSPGFFENMMHNNNGFGVESAIIEADGLGDKSTHIVKFEIQLYKTRGDKYLLDLQRVSGPQLLFLDLCSAFLT

SEQ ID NO: 14925 - protein, 380 aa, Oryza sativa
MGSSCSRSHSLSEAETTKNAKSADIDRRILQETKAEQHIHKLLLLGAAESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPVIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 14926 - protein, 264 aa, Axinella corrugata
GEGTYGVVFKGRNKKTDEIVAMKKIRLESEEEGVPSTALREISLLKELQHPNIVGLNDVIMQEVKLYLIFEFLTMDLKKFMDTKTKMDMNLVKSYTYQILQGILFCHQRRVIHRDLKPQNLLIDKEGSIKIADFGLARAFGVPVRVYTHEVVTLWYRAPEILLGATKYSCPIDIWSIGCIFAEMCNKRPLFQGDSEIDQLFRIFRVLRTPNEEIWPGVTQLPDFKVTFPAWTSNNLVAQMKNLDDDGLDLLQEMLHYDPAKRIS

SEQ ID NO: 14927 - protein, 155 aa, Axinella corrugata
GEGTYGVVYKARVKESGRTVALKKIRLDTECEGVPSTAIREISLLKELGHPNIVSLLEVLHCDRKLFLVFEYLDYDLKKFMDKSAPTGIPPNSAKSYLYQLLDGISFCHSHRVLHRDLKPQNLLLNSHGVIKLADFGLARAFGVPVRTYTHEVVT

SEQ ID NO: 14928 - protein, 103 aa, Aplysia californica [sequence omitted]

SEQ ID NO: 14929 - protein, 516 aa, Blumeria graminis
MHRTFHPYFLLKMSGSSQRHSHVTGYLILLVAVATLGPLQYGYHLAELNAPQDVITCHSLLGRQNVASKSLSNPSQCIPMTEAEFAALSSIYILGGLAGAITAGPISSSHGRLLTMRITGIFFILGSLIETIAESVPVMSTGRFLAGLGAGAATVVAPMYISEISPAEKRGLFGTMTQAMISVGIFVTQSLGYFFSRGMLWRIILGVGAGFGLLLGAGLCFIPESPSWLASHHNPTLAVKTLQRIRGAGTPIHKETAGWNVQEINGEEERLIRPSDLSSTSQYNQHNLATPNLKLPSVGFFGVLQDPLYRPAIMAVCGIMIAQQLSGINSIMMYSVSLLRGVLPIPSILLTIIMSAMNVITTIVCAPLADRIGRKSCLLLSIAGMGTMSLLLAISLRMEWKLFSAIAVISFVAFFATGLGPVPYIMASELVGQEAVGAAQSWALAANYLASFLVAQFFPLLNSWMNNRWGGAGWVYFIFTAFAGVSWIFVTYYVPETNGKTGPDEVWGRTTGEVAD

SEQ ID NO: 14930 - protein, 226 aa, Spinacia oleracea
WEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 14931 - protein, 358 aa, Leishmania mexicana
MTSYGIDGEVEQRYRILRHIGSGAYGVVWCALDRRTGKCVALKKVYDAFGNVQDAQRTYREVMLLQRLRHNPFIVGILDVIRAANDIDLYLVFELIETDLTAIIRKNLLQRDHKRFLTYQLLRTVAQLHAQNIIHRDLKPANVFVSSDCSIKLGDFGLARTFRSGYDNEQEFLDLTDYIATRWYRSPEILVKSRAYSTAMDMWAIGCVIGEMLLGRPLFEGRNTLDQLRLIIEAIGVPSDADVRSLHSPELEKLINSLPTPLIFSPLVGNKNLKDSEATDLMMKLIVFNPKRRLSAVEALQHPYVAPFVQHGELEKIQGLDPLVLPLVDEKIYTKEEYKANLYDEIGMRYRYHITDVY

SEQ ID NO: 14932 - protein, 265 aa, Rosa hybrid cultivar
LVQFGAFIVLCGATHLINLWTFSVHSRTVAIVMATAKVFTAAVSCATALMLVHIIPDLLSVKTRELFLKNKAAELDREMGLIRTQEETGRHVRMLTHEIRSTLDRHTILKTTLVELGRILTLEECALWMPTRTGLELQLSYTLHQQNPVGYTVPIHLPVINQVFNNNGTVKISPNSPVARLRPIAGKHIPGEVVAVRVPLLHLSNFQINDWPELSTKRYALMVLMLPSDSARQWHVHELELVEVVADQVAVALSHAAILEESMRA

SEQ ID NO: 14933 - protein, 402 aa, Vitis vinifera
MDPDAFTASLFKWDPRGAVAPPNRLLEAVAPPPPGAAAPAPVAAAYAIRPRELGGLEDLSQEYGVRYYTAAKIAELGFTVSTLLDMKDEELDDMMNSLCQIFRWDLLVGERYGIKAAVRAERRRLDEEESRRRHLLSADTANAIDALSQEGLSEEPVQQEKEAGGSGGVGTWEVVVAGERKKQQRRKKGKTRMGSADDNMNEDDNEGGDEDDDKGSGERGSERQREHPFIVTEPGEVARGKKNGLDYLFHLYEQCRDFLIQVQNIAKERGEKCPTKVTNQVFRYAKKAGASYINKPKMRHYVHCYALHCLDEEASNALRRAFKERGENVGAWRQACYKPLVALAARQGWDIDAIFNAHPRLAIWYVPTRLRQLCHSERSNAAAAAAAAASSCISGGADHLPF

SEQ ID NO: 14934 - protein, 173 aa, Vitis vinifera
MARMSDPLIVGRVIGDVVDSFCSTVKMTVTYNSNKQVYNGHELFPSSVTIKPKIEVEGGDMRSFFTLIMTDPDVPGPSDPYLREHLHWIVTDIPGTTDSTFGREIVNYEMPRPNIGIHRFVFLLFKQKRRQTVNPPSSRDRFSSRNFAEENELGPPVAAVFFNAQRETAARKR

SEQ ID NO: 14935 - protein, 285 aa, Saccharomyces cerevisiae
NVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 14936 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPLVKNYAYFTDGSYTPEEVVQAEKYMLTILNFDLNYPNPMNFLRRISKADDYDVQSRTLGKYLLEITIVDYKFIGMRPSLCCALAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 14937 - protein, 166 aa, Datura ferox
  unsure (1)..(166): unsure at all Xaa locations
SMGGACGKGDLYSQGYGTNTAALSTALFNNGLSCGXCFELKCGGDSKWCLPGSIVVTATNFCPPNYALPNNAGGWCNPPLHHFDLSQPVFQQMAQYRAGIVPVAYRRVRCQKRGRIRFTMNGHSYSNLVLVTNVGGSGDVNAVSVKGSRTDWILMSRNWGQNWQDP

SEQ ID NO: 14938 - protein, 238 aa, Mus musculus
MADTDPGYPRSSIEDDFNYGSCVASASVHIRMAFLRKVYSILSLQVLLTTVTSALFLYFQALRTFVHESPALIVVFALGSLGLIFALTLHRHTHPLNLYLLFAFTLSESLAVAAVVTFYDVYLVLQAFIMTTAVFLGLTAYTLQSKRDFTKFGAGLFAGLWILCLAGFLKLFFYSETMELVLASLGALLFCGFIIYDTHSLMHRLSPEEYVIAAISLYMDIINLFLHLLKFLEAVNKK

SEQ ID NO: 14939 - protein, 237 aa, Mus musculus
MNIFDRKINFDALLKFSHITPSTQQHLKKVYASFALCMFVAAAGAYVHVVTHFIQAGLLSALGSLALMIWLMATPHSHETEQKRLGLLAGFAFLTGVGLGPALELCIAVNPSILPTAFMGTAMIFTCFSLSALYARRRSYLFLGGILMSAMSLMLLSSLGNLFFGSIWLFQANLYLGLLVMCGFVLFDTQLIIEKAEHGDKDYIWHCVDLFLDFVTLFRKLMLILAFNEKDKKKEKK

SEQ ID NO: 14940 - protein, 375 aa, Mus musculus
MEAESPASAGASEPRALGTVDSIGSQLSRIRRKLFTWDILKTIALGQMLSLCICGTAITSQYLAEKYRVNTPMLQSFINYCLLFLVYTLMLAFQSGSDNLLEILRRKWWKYTLLGLADVEANYLIVGAYQYTTLTSVQLLDCFGIPVLMALSWFILRARYKVIHFIAVFVCLLGVGTMVGADILAGREDNSGSDVLIGDILVLLGASLYAVSNVCEEYIVKKLSRQEFLGMVGLFGTIISGIQLLIVEYKDIARIQWDWKIALLFVAFALCMFCLYSFMPLVIKVTSATSVNLGILTADLYSLFFGLFLFEYKFSGLYILSFTVIMVGFILYCSTPTRTVEPPESSVPPVTSIGIDNLGLKLEESGLPETHSAVL

SEQ ID NO: 14941 - protein, 192 aa, Mus musculus
MPTDMSMWTGPLSLHEVDEQPQHLLGVTYTEAEVEELGQVLTPTQVKHRPGSISWDGLDTGKLYTLILTDPDAPSRKKPVYREWHHFLVVNMKGNDISSGNVLSDYVGSGPPKGTGLHRYVWLVYQQDKPLRCDEPILTKRSGDHCGKVKTGSFRKKYHLGAPVAGTCYQAKWGSYLPKLYKTAVWEIGGNF

SEQ ID NO: 14942 - protein, 395 aa, Mus musculus
MQASCNQLHDPPGTAHEDAAASPCGHSRSTEGSLHPGDVHIQINSGPKEYSENPSSRNPRSGVCTCAHGCVHGRFRSYSHSEARPPDDFATESGEHGSGSFSEFRYLFKWLQKSLPYILILGIKLVMQHITGISLGIGLLTTFMYANKSIVNQVFLRERSSKLRCAWLLVFLAGSSVLLYYTFHSQSLHYSLIFLNPTLEQLSFWEVLWIVGITDFILKFFFMGLKCLILLVPSFIMPFKSKGYWYMLLEELCQYYRIFVPIPVWFRYLISYGEFGNVTTWSLGILLALLYLILKLLDFFGHLRTFRQVLRVFFTRPSYGVPASKRQCSDMDGICTICQAEFQKPVLLFCQHIFCEECITLWFNREKTCPLCRTVISECINKWKDGATSSHLQMY

SEQ ID NO: 14943 - protein, 334 aa, Homo sapiens
MSKLLNPEEMTSRDYYFDSYAHFGIHEEMLKDEVRTLTYRNSMYHNKHVFKDKVVLDVGSGTGILSMFAAKAGAKKVFGIECSSISDYSQKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 14944 - protein, 365 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 14945 - protein, 354 aa, Homo sapiens
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVAAIIFCVALSDYDLVLAEDEEMNRMHESMKLFDSICNNKWFTDTSIILFLNKKDLFEEKIKKSPLTICYQEYAGSNTYEEAAAYIQCQFEDLNKRKDTKEIYTHFTCATDTKNVQFVFDAVTDVIIKNNLKDCGLF

SEQ ID NO: 14946 - protein, 508 aa, Mus musculus
MSRFVQDLSKAMSQDGASQFQEVILQELELSVKKELEKILTTAASHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPIAKDVSYSGENTEAWYPPGHGDIYASFYNSGLLDTFIEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLGAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 14947 - protein, 246 aa, Gallus gallus
MEPDLSFRGRRALVTGAGKGIGRAVAVALCKAGARVTALSRTAADLESLVRECPGIEPLCLDLADWDATEAAVGAAGPFELLVNNAAVAMLQPFLQVTREAVERSFDVNFRAVLHVSQIVARQMIAQGLPGAIVNVSSQASQRALRDHAVYCSTKSALDMLSKVMAMELGPHKIRVNTVNPTVVMTDMGRINWSDPQKSAAMINRIPLGKFAEVDDVVNSILFLLSDKSAMTTGSSLMVDGGFLVS

SEQ ID NO: 14948 - protein, 228 aa, Raoultella planticola
NGGTEGNMFGCYLGREIFPNGTLYYSKDTHYSVAKIVKLLRIKSTLVESQPNGEMDYTDLIKKIKRDNEKHPIIFANIGTTVRGAIDNIAIIQESISELGIERKDYYLHADAALSGMILPFVDNPQPFNFADGIDSIGVSGHKMIGSPIPCGIVVAKKKNVDRISVEIDYISAHDKTISGSRNGHTPLMMWEAIRSHSWEEWRRRIERSLNMAQYAVDRFQSAGIDAW

SEQ ID NO: 14949 - protein, 419 aa, Brassica amplexicaulis
HHRSYNLFFFVVLVLFHHVFSTNTLSPNETLTISSNKTLVSPGDVFELGFFTTTTHTDRWYLGLWYKTTSHKTYVWVANRDNPLHSSTGTLKISHSNLFLLDQFNTPVWSTNITETVTSPLTAELLSNGNFVLRDSKTKDTNQFLWQSFDFPVDTLLPEMKLGRNLKTGHDRVLTSWKSPTDPSSGDYSFKLETHQGSLLHEFYLLKNELKVYRTGPWFNAIPKMQNWSYIVNSFIDNKEEVSYAFKVNNHKMIHTRFRMSSTGLLQVITWTKTTPQRNMFWSFPEDQCDYYTSCGSYAYCDTNTTPTCNCIKGFMPKNDQAWALRDASSGCVRSSRLSCGEGDGFYRMSHMKLPETSGAVVDKGIGLKECKERCSRDCKCTGFANMDIRNGGSGCVMWTGELMDMRSYVAGGQDLYLK

SEQ ID NO: 14950 - protein, 419 aa, Brassica barrelieri
FYHSCIIFFAVLLQFHHVFSTNTLSSNEALTISSNRTLVSPGDVFELGFFKTTTRNSQDGGDRWYLGIWYKTTSDLRTYVWVANRDNPLHNSIGTLKISHSDLVLLDQSDTPVWSTNCMGVVQSSVTAELLANGNFVLRDSKTKDLNRFMWQSFDFPVDTLLPEMKLGRKRNSSENEKILTSWKSPTDPSSGDYSFILETEGFIHEFYLLKNEFKVYRTGPWNGVRFNGIPKIQNWSYIINNFIDNKKEVAYTFQVSNNHNIHSRFRMSSTGYLQVITWTKTVPQRNMFWSFPEDTCDLYKVCGTYAYCDMHTTPTCNCIKGFVPKNAAAWELRDMSGGCVRSKRLSCGEGDGFLRLGQMKMPETSEAFVDESIGLKECKEKCIRDCNCTGFANMDIMNGGSGCVTWTGELVDMRKYDA

SEQ ID NO: 14951 - protein, 425 aa, Brassica deflexa
YHHSYTLFFFVVLVLFPHVFSTTNTLSSNETLTISSNKTLVSPGDVFELGFFKTTTRKSQDGTDHCWYLGIWYKTTTSNQRTYVWVANRDNPLHNSTGTLKISHASLVLLDQSNTPVWSTNHTGVAHLPVTAELLANGNFVLRDSKTNDLDRFMWQSFDFPVDTLLPEMKLGRKINSSEKEKILTSWKSPTDPSSGDYSLILETEGFLHEFYLFNNDFKMYRTGPWNGVRFNGIPKIQNWSYIDNNFIDNKEEVAYTFKVNNNNNHNIHTRFRMSSTGYLQVITWTKTIPQRNMFWSFPEDACDLYQVCGHYAYCDMHTTPTCNCIKGFVPKNASAWGLRDMSGGCVRSSKLTCGEGDGFLRLGQMKLPEPNEAFVDKRIGLKECKEKCVRACHCTGFAGMDIMNGGSGCVTWTGELVDMRKYDA

SEQ ID NO: 14952 - protein, 420 aa, Brassica erucastrum
YHHHSYTFFFVILVLFPHAFSTNTLSSNEALTISSNRTLVSPGDVFELGFFKTTTRNSRDGTDRWYLGIWYKTTSDQRTYVWIANRDNPLLNSMGTLKISHANLVLFDQSATPVWSTNLTGAAHLPVTAELLANGNFVLRDSKTKDLDRFMWQSFDFPVDTLLPEMKLGWKHKILEREKILTSWKSPTDPSSGDYSFILETEGFLHEFYLYKNEFKVYRTGPWNGVRFNGIPKIQNWSYIDNSFIDNHEELAYSFQVNNNHNIHSRFRMSSTGYLQVITWTKTVPQRNMFWSFPEDTCDVYLVCGPYAYCDMHTTPRCNCIEGFVPKNAAQWELRDMSSGCVRSSKLTCGEGDGFLRLGKMKLPETTEAVVEKRIGLKECKEKCLRDCQCTGFANIDNMKGGSGCVTWTGELDDMRKYDA

SEQ ID NO: 14953 - protein, 422 aa, Brassica maurorum
YDHFYTFSFVILVLFPHAFSTNTLSSNESLTISSNKTLVSPGDVFELGFFKTTTRSSRGGSTDRWYLGIWYKTTSQRRTYVWVANRDNPLHNSIGTLKISHASLVLLDHSDTPVWSTSLTGVAHLPVTAELLANGNFVLRDSKTKDLDRFMWQSFDFPVDTLLPEMKLGRKVNSSEKEKILTSWKSPTDPSSGDYSLILETEGFLHEFYLFKNEFKVYRTGPWNGVRFNGIPKKMQNWSYIVNSFIDNKSEVAYSFQVDNNRNIIHSRFRMSSTGYLQVITWTKTVPQRNMFWSFPEDACDPYQVCGPYAYCDMHTSPMCNCIKGFVPKNASRWDLRDASGGCVRSSKLSCGEGDWFLRMSQMKMPETTEAFVDKTIGLEECKEKCMRDCHCTAFANMDIMNGGSGCVTWTGELVDMRKYDA

SEQ ID NO: 14954 - protein, 419 aa, Brassica nigra
NHHSCTIFFVVLLQFHHVFSINTLSPNEALTISSNKTLVSPGDVFELGFFKTTTRNSQDSADRWYLGIWYKTTSERTYVWIANRDNPLHNSIGTLKISHANLVLLDQSDTPVWSTNLTGVVQSSVTAELLANGNFVLRGSYSTEDEFMWQSFDFPVDTLLPEMKLGWNLKPGPERILTSWKSPTDPSSGDFSFMLETHTIRLHEFYLLKNEFIVYRTGPWNGVRFNGIPKMQNWSYIVNSFTDNNGEVAYAFHVDNHNIHSRFRMSSTGYLQVITWTKTVPQRNMFWSFPEDSCDAYKVCGPYAYCDMNTTPTCNCIKGFVPKNASRWELRDMSGGCVRSSRLSCGEGDGFLRMSQMKLPETSEAVAVLVDKRIGFKECKERCIRDCNCTGFANMDIMNGESRCVIWSGELVDMRNYVA

SEQ ID NO: 14955 - protein, 419 aa, Brassica oxyrrhina
YHHSYTFFFVILVLFPHAFSTNNLSSNETLTISSNRTLVSPGDVFELGFFKTTTRNSQDGGDRWYLGIWYKTTSDQRTYVWVANRDNPLHNSIGTLKISHSNLVLLDQSDTPVWSTNCTGVVQSPVTAELLANGNFVLRDSKTKDLNRFIWQSFDFPDDTLLPEMKLGRKLNSPENKKILTSWKSPTDPSSGDYSFILETEGFLHEFYLLQNEFKVYRTGPWNGVRFNGIPKLQNWSYITNNFIDNKEEVAYTFHVNKNHNIHSRFRMSSTGYLQVITWTKTVPQRNMFWSFPEDSCDPYKVCGPYAYCDMHTTPTCNCIKGFVPKNEAAWALRDMSGGCVRSSGLSCGEGDGFLRLGQMKMPETSEAFVDKRIGLNECKEKCVRDCNCTGFANMDIMNGGSGCVTWTGELVDMRNYDA

SEQ ID NO: 14956 - protein, 422 aa, Brassica tournefortii
FYHSCTIFFVVLLQFHHVFSTNTLSSNEALTISSNRTLVSPGDVFELGFFKTTTRNSQDGADRWYLGIWYKTTSDQIQRTYVWVANRDNPLHNSTGTLKISHANLVLLDQSDTPVWSTNLTGVAHLPVTAELLANGNFVLRDSKTKDLNRFMWQSFDFPVDTLLPEMKLGRKFNSSEKEKILTSWKSPTDPSSGDYSFILETKGFLHEFYLFKNEFKVYRTGLWNGVRFNGIPKKMQNWSYIVNDFIDNKEEVAYSFQVNNKNHNIHSRFRMSSTGYLQVITWTKTVPQRNMFWTFPEDTCDLYQVCGPYAYCDMHTTPRCNCIKGFVPKNAGRWDLRDMSGGCVRSSRLTCGEGDGFLRLGQMKMPETSEAVVDKMIGLKECREKCVRDCNCTGYANMDIMNGGGCVMWTGELVDMRKYDA

SEQ ID NO: 14957 - protein, 420 aa, Brassica villosa
YHHSYTLFFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNLIGSENEKILTSWKSPTDPSSGDYSFILETEGLLHEFYLLKNEFKVYRTGPWNGVRFNGIPKMQNWSYIDNSFIDNNEEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYDA

SEQ ID NO: 14958 - protein, 412 aa, Crambe kralikii
YHHSCTLFFILLLQFHHVFSTNTLSSNETLTISSNKTLVSPGDVFELGFFKTTQDGHDRWYLGTWYKTTSERTYVWIANRDNPLHNSMGTLKVSHANLVLLDQSDTPVWSSNLTGTAQLPVTAELLSNGNFVLRDSKTNDLNQSMWQSFDFPVDTLLPEMKLGRNLKTGHDRVLTSWKSPTDPSSGDYSFKLETQGLHEFYLLKNEFKVYRTGPWNGVRFNGIPKMQNWSYIVNNFIDTKEEVAYTFHVNNRNIHTRFRISSSGVLQVITWTSTVPQRNMFWSFPEDDCDMYQMCGPYAYCDMNTTPRCNCIKGFVHKNASAWDLRDMSGGCVRSSKLSCGGEGDGFLRMSQMKLPETSEAVVDERIGLEECKEKCVRDCNCTGFANVDNRNGGSGCVIWTGELVDMRNYVA

SEQ ID NO: 14959 - protein, 420 aa, Diplotaxis erucoides
YHHHSYTFFFVILVLFPHAFSTNTLSSNEALTISSNRTLVSPGDVFELGFFKTTTRNSRDGTDRWYLGIWYKTTSDQRTYVWIANRDNPLHSSMGTLKISQENLVLFDQSATPVWSTNLTGVAHLPVTAELLANGNFVLRDSKTKDLDRFMWQSFDFPVDTLLPEMKLGRKRNSSEKEKILTSWKSPTDPSSGDFSLILETEGFLHEFYLFNNEFKVYRTGPWNGVRFNGIPKIQNWSYIDNSFIDNHEGLAYSFQVNNNHNIHSRFRMSSTGYLEVITWTKTVPQRNMFWSFPEDSCDLYKVCGPYAYCDMHTTPRCNCIQGFVPKNAAQWELRDMSSGCVRSSKLSCGEGDVFLRLGQMKLPETPEAVVEERIGLKECKEKCLRDCQCSGFANIDNMKGGSGCVTWTGELDDMRKYDA

SEQ ID NO: 14960 - protein, 420 aa, Diplotaxis siifolia
YHYSCTFFFVILVLFPHAFSTNTLSSNESLTISSNKTLVSPGDVFELGFFKTTTRNSRNGTDRWYLGIWYKTTSDQRTYVWVANRDNPLHNSIGTLKISHANLVLLDQSNTSVWSTNLAGVVQSPVTAELLANGNFVLRGSYSTEDEFMWQSFDFPVDTLLPEMKLGWKLNSSEKEKILKSWKSPTDPSSGDYSFRLETEEFLYEFYLMKNEFKVHRTGPWNRVRFNGVPKMQNWSYISNNFIDNEDEVAYSFLVNNNNHNIHTRFRMSSTGYLQVITWTKTVPQRNMFWSFPEDTCDLYKVCGPYAYCDMNTTPMCNCIKGFVPKNAGQWELRDASGGCMRSSQLSCGEGDGFLRMSQMKLPETSEAVAVLVDNGLKECKERCVRDCNCTGFANMDSMNGGPSCVIWSGELEDMRNYVA

SEQ ID NO: 14961 - protein, 419 aa, Eruca sativa
YHHSYTLFFLVLLQFHHVFSTNTLSSNETLTISSNKTLVSPGDVFELGFLKTNTKNSQDGTDRWYLGIWYKTTSERTYVWVANRDNPLHNSIGTLKISHANLVLLNQFNTPVWSTNLTESVTSPVTAELLANGNFVLRDSKTKDLNHFMWQSFDFPVDTLLPEMKLSRNIKPGNDRILTSWKSPTDPSSGDFTFVLEPHNHGLHEFYLLKNEIEVYRTGPWNQNRFNGIPKIQNWSYIANNFIDNNNEEVAYTFHVNNSNIHSRFRMSSLGYLQVITWTKTIPQRDMFWSFPEDACDLYQVCGSYAYCDINTTPNKCNCIKGFVPKNPDAWTLRDATGGCVRSSRLSCGEGDGFVRMSKMKLPETSEARVDKGIGLEECKERCVRDCDCTGFANMDIGSGGSGCVMWIDELVGMRNYVA

SEQ ID NO: 14962 - protein, 419 aa, Eruca vesicaria
YHYSYTLFFVILLQFHHVFSTNTLSSNETLTISSNKTLVSRGDVFELGFFKTTTKNSQDGTDRWYLGIWYKTTSERTYVWVANRDNPLHNSIGTLKISHNNLVLLNQFNTPVWSTNLTESVTSPVTAELLANGNFVLRDSKTKDLNRFMWQSFDFPVDTLLPEMKLSRNFKPGNDRILTSWKSPTDPSSGDFSFKLEPQNHGLHEFYLLKNEIEVYRTGPWNQNRFNGIPKIQNWSYIVNNFIDNNNEDVAYTFHVNNSNIHSRFRMSSTGYLQVITWTKTIPQRNMFWSFPEDACDLYQVCGSYAYCDINTTSNKCNCIKGFVPKNPEAWDLRDATGGCVRSSRLSCGEGDGFMRMSKMKLPETSEARVDKGIGLEECKERCVRDCDCTGFANMDILNGGSGCVMWIDELVDMRNYVA

SEQ ID NO: 14963 - protein, 420 aa, Erucastrum abyssinicum
YHQSCTIFFLVLIQFHHVFSTNTLSPNDALTISSNKTLVSPGDVFELGFFKTTTRNSRDGTDRWYLGIWYKTTSDQRTYVWIANRDNPLHNSMGSLKISHANLVLLDQSDTPVWSTNLTGVAHLPVTAELLANGNFVLRDSKTNDLDRFMWQSFDFPVDTLLPEMKLGRKVNSSEKEKILTSWKSPTDPSSGDYSFILETEGFLHEFYLFKNEFKVYRTAPWNGVRFNGVPKMQNWSYIDNSFIDNKEEVAYTFRVNNNHNIHSRFRMSSTGYLQVITWTKTVPQRNMFWSFPEDTCDPYKVCGPYAYCDMHTTPMCNCIKGFVPKNAAQWDLRDASGGCVRSSKLSCGERDGFLRLGQLKLPETSEALVEKGIGLKECKEKCLRDCHCTGFANMDIMNGGGSGCVTWTGELVDMRDYDA

SEQ ID NO: 14964 - protein, 419 aa, Erucastrum gallicum
YHHSCTIFFLVLIQFHHVFSTNTLSPNDALTISSNKTLVSPGDVFELGFFKTTTRNSRDGTDRWYLGIWYKTTSDQRTYVWIANRDNPLHNSMGTLKISHANLVLLDQSDTPVWSTNLTGVAHLPVTAELLANGNFVLRDSKTNDLDQFMWQSFDFPVDTLLPEMKLGRKVNSSEKEKILTSWKSPTDPSSGDYSFILETEGFLHEFYLFKNEFKVYRTGPWNGVRFNGIPKMQNWSYIDNSFIDNKEEVAYTFRVNNNHNIHSRFRMSSTGYLQVITWTKTVPHRNMFWSFPEDTCDVYRVCGPYAYCDMHTTPMCNCIKGFVPKNAAQWDLRDASGGCVRSSKLSCGEGDGFLRLGQMKLPETSEALVEKGIGLKECKDKCLRDCHCTGFANIDIMNGGSGCVTWTGELVDMRNYDA

SEQ ID NO: 14965 - protein, 416 aa, Moricandia arvensis
YHHSNTLFFVMLVLFPHVLSTNTLSSNEALTISSNKTLVSPGDVFELGFFKTTTRNSTDRWYLGIWYQTTSERTYVWVANRDNPLHNSNGTLKVSHANLVLLDQSDTPVWSTNITRPVTSPVTAELLANGNFVVRGSYTIDQSHFMWQSFDFPVDTLLPEMKLGWNNKTEHGRFLTSWKSPTDPSSGDFSFGLETHEGLHEFYLLKDEYEMYRTGPWNGARFSGIPKMQNWSYIVNSFIDNKEEVSYSFHVNNNHNNIHSRFRMSSTGSLQVITWTSTTPQRNMFWSFPEDACDAYQMCGPYAYCDMNTTPTCNCIKGFVPKDADAWALRDASGGCVRSSRLSCGEGNGFLRMGQMKLPETSTGAVGDKRIGLKECKERCVRDCRCTGFANMDIRNGGSGCVIWTGELMDMRNYGA

SEQ ID NO: 14966 - protein, 420 aa, Sinapis alba
YHHSCTIFFVVLLQFHHHVFSINTLSSNEALTITSNKTLVSPGDVFELGFFKTPTSNSQDGTDRWYLGLWYKTTSDQRTYVWVANRDNPLHSSTGTLKISHANLVLLDQSDTPVWSTNLTGVVQLPVTAELLDNGNFVLRDSKTKDLNQFMWQSFDFPVDTLLPEMKLGRKLNSPENEKILTSWKSPTDPSSGDYSFILETEGFIHEFYLLKNEFTVYRSGPWNGVRFNGIPKMQNWSYIVNSFTDNKEEVAYTFRVNNHNIHTRFRMSSTGYLQVITWTKTVPQRNMFWSFPEDTCDVYKMCGPYAYCDMHTTPMCNCIKGFVPKNAGRWDLRDTSGGCVRSSRLSCGEGDGFLRMSQMKLPETSEAAVDKMIGLKECKEKCVRDCNCTGFANMDIMNGGGSGCVTWTGELVDMRNYVA

SEQ ID NO: 14967 - protein, 420 aa, Sinapis arvensis
YHHSNTFFFVVLVLFPHVFSTNTLSSNDALTISSNKTLVSPGNVFELGFFRTTTRNSQDGADRWYLGIWYKTTSDQRTYVWVANRDNPLHNSIGTLKISNANLLLLDHSDSPVWSTNLTGVVEPPVTAELLANGNFVLRGSYSTEDEFMWQSFDFPVDTLLPEMKLGWNRKPGPERILTSWKSPTDPSSGDFSFMLETHTIGLHEFYLRKNEFIMYRTGPWNGVRFSGIPKMQNWSYIVNSFVDNHKEVAYTFHVDNHKINSRFRMSSTGYLQVITWTMTVPQRNMFWSFPEDTCDLYQVCGPYAYCDMNTAPTCNCIKGFVPKNAAQWELRDASGGCVRSSRLSCGEGDGFLRMSQMKLPETSEAVAVLVDKRNGFKECKERCIRDCNCTGFANMDSMNGESRCVIWSDELLDMRKYVA

SEQ ID NO: 14968 - protein, 420 aa, Sinapis arvensis
YHHSYTFFFVVLVLFPHVFSTNTLSSNDALTISSNKTLVSPGDVFELGFFRTTTRNSRDGTDRWYLGIWYKTTSDQRTYVWVANRDNPLHNSIGTLKISNANLVLLDHSDTPVWSTNLTGVVEPPVTAELLANGNFVLRGSYSTDDEFMWQSFDFPVDTLLPEMKLGRNRKPGPERILTSWKSPTDPSSGDFSFMLETHTIGLHEFYLRKNDFIMYRTGPWNGVRFSGIPKMQNWSYIVNSFVDNHKEVAYTFHVDNHKINSRFRMSSTGYLQVITWTMTVPQRNMFWSFPEDTCDLYQVCGPYAYCDMNTAPTCNCIKGFVPKNAAQWELRDASGGCVRSSRLSCGEGDGFLRMSQMKLPETSEAVAVLVDKRNGFKECKERCTRDCNCTGFANMDSMNGESRCVIWSDELVDMRNYVA

SEQ ID NO: 14969 - protein, 556 aa, Oryza sativa (japonica cultivar-group)
MWDYQVLAVRESAECAARAMMSQLTGHGVKLVLPSLLKVGSVIKNPEISALVPILLSALTDPNNHTKHSLDILLQTTFINSIDAPSLALLVPIVHRGLRERGVDTKKKAAQIVGNMSSLVTEPKDMIPYIGLLLPEVKKVLVDPIPEVRAVAARALGSLIIGMGEEIFPDLVPWLLDTLKSDSSNVERSGAAQGLSEVLAALGKDYFDQILPDIIRNCSHQKASVRDGHLTLFRVAGTSGKAILEGGSDDEGASTEAHGRAIIDVLGREKRNEVLAAIYMVRSDVSLTVRQAALHVWKTIVANTPRTLKEIMPVLMDTLISSLASSSSERRQVAGRSLGELVRKLGERVLPSIIPILSQGLKDPDASRRQGVCIGLSEVMGSAGKHQLLSFMDLLIPTIRTALCDSTQEVRESAGLAFSTLYKSAGLQAIDEIVPTLLRALEDDETSATALDEVAGPGLNSHIGTVLPALILAMDDEDADVQNSARKAAETVVLVIDEEGIETLIPELLKGVNDSQGLISGSAETKEQAAEGLGELIDVTSEKTLKEVVVPITGYG

SEQ ID NO: 14970 - protein, 513 aa, Oryza sativa (japonica cultivar-group)
MVLSHGVSGSDESVHSTFASRYVRTSLPRHARSPLSRAPLAPIDSVIDWEFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 14971 - protein, 504 aa, Escherichia coli
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFTMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVLGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 14972 - protein, 389 aa, Beta vulgaris
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 14973 - protein, 717 aa, Medicago truncatula
MDLCSLACPSFVTPCDPRRTLPLPSSSSSHSQWGLHFFSHSQQHNKLKKKFGVVHASLSEMGEYYSQRPPTPLLDTINYPIHMKNLSTKELKQLADELRSDVIFSVSRTGGHLGSSLGVVELTIALHYVFNTPQDKILWDVGHQSYPHKILTGRRDKMHTMRQTNGLSGFTKRSESEYDSFGTGHSSTTISAGLGMAVGRDLKGRKNDVVAVIGDGAMTAGQAYEAMNNAGYLDSDMIVILNDNKQVSLPTATLDGPIPPVGALSSALSRLQSNKPLRELREVAKGVTKRIGGPMHELAAKVDEYARGMISGTGSTLFEELGLYYIGPVDGHNIDDLVAILKEVKTTNSTGPVLIHVITEKGRGYPYAQKAADKYHGVAKFDPPTGKQFKVAAKTQSYTTYFAEALIAEAKADKDIIAIHAAMGGGTGMNIFHRRFPTRCFDVGIAEQHAVTFAAGLACEGLKPFCAIYSSFLQRAYDQVVHDVDLQKLPVRFAMDRAGLVGSDGPTHSGSFDVTFMACLPNMVVMAPSDEAELCHMVATAAAIDDRPSCFRYPRGNGIGVELPTEYKGIPLEIGKGRILIEGERVALLGYGSAVQNCLAAASLVEQHGLRLTVADARFCKPLDRSLIRSLAKSHEVLITVEEGSIGGFGSHVAQFMALDGLLDGNLKWRPVVLPDRYIDHGSPADQLCMAGLTPSHIAATVFNILGQTREALEVMS

SEQ ID NO: 14974 - protein, 711 aa, Medicago truncatula
MALSSCLLKPNHSLLQCHKFKAPNPNHGFRNQFCVMASSSSDGERTIIRKEKDEWKINFSAEKPPTPLLDTVNFPVHMKNLTTEDLEQLAAELRADIVHSVSDTGGHLSSSLGVVELSVALHHVFDTPDDKIIWDVGHQAYPHKILTGRRSRMHTIRKTSGLAGFPKRDESVHDAFGVGHSSTSISAGLGMAVARDLLGKKNSVISVIGDGAMTAGQAYEAMNNAGFIDSNLIVILNDNKQVSLPTATLDGPATPVGALSSTLSKIQASRKFRKLREATKNITKQIGGQTHLVASKVDKYARDFISGSGSSLFEELGMYYIGPMDGHNIEDLVNIFEKVKAMPAPGPVLIHIVTEKGKGYPPALAAADRMHGVVKFDPKTGHQFKPKPSTLAYTQYFADSLIKEAEMDNKIVAIHAAMGGGTGLNYFQKRFPDRCFDVGIAEQHAVTFAAGLAAEGLKPFCAIYSSFLQRGYDQVVHDVDLQKLPVRFAMDRAGLVGADGPTHCGAFDITFMACLPNMIVMAPSDEAELMNMVATAAAIDDRPSCFRFPRGNGIGANLPLNNKGTPLEIGKGRILLEGSRVAILGYGCMVQQCMKAAEMLRAVGVYVTVADARFCKPLDTDLIRLLAREHEILITVEEGSIGGFGSHVSQFLSLAGLLDGPLKLRSMMLPDRYIDHGAPNDQIDEAGLSSKHILATVLSLLDMPKEALLFK

SEQ ID NO: 14975 - protein, 238 aa, Lilium longiflorum
MFLLVLAALILSSPVAGYGSTVEDVKARTNIAAEEAKVKADETAQEAKESTESWAGWARDRISEGLGIKSDVKVSDISSGSAEMASEKAAGAKDAVMSGAGKAKENILEAADATQKTVGGCGGNAADAAGRTYEGAKQKVGEAYESAKGAVSGSADLAGRTYDGAKQKVGDAYASTKDTVSGSVDSAGRTYEGAQQKVGEAYDNAKDTMTESAKANYEAAKEKASQAAGDVGGRTEEL

SEQ ID NO: 14976 - protein, 511 aa, Corynebacterium glutamicum ATCC 13032
MPELNRRTFFKGAGVLAATVVGAQVLVACSSDDVRGYGGEPRTLPIPPADLGTREGSSVHFALEAQTGESQILPDVTTKTWGFNGTHLGPTLVVKKGDDVHVDVINNLDEMTTVHWHGMKLPAIADGGPHSPIGPGQTWSPTWTVANDAATLWYHPHTHGLTGLHAYRGLAGMIIVEDEATDKLDLPREYGVDDIPLVLMDHRFLEDGSLDEEDLPDLGLLGDTPTANGITNAHFDATTRRVRFRVLNGSNMRFYNLAFSDTRTFQVIASDSGLLDEPQDRTTLAIGPGERWEIVVELEPGEDVTLESVGFEDNYGVPDDEFVPDFGMSDSFQLLTITGPSDDAAQAPALPGVLVKSTEPDVIDATERTFIMNTFSINDLQMDMQRVDVVIDHDQPEVWIVTNDNSDWPHNFHVHDARFKVLKFEGTDVELFNDGWKDTVGLPPGATATLAVEFGHYPDPQWPYMYHCHMLYHEDQGMMGQFVIVEPGDEPAAVLGSGTGSSIDSAGGHAH

SEQ ID NO: 14977 - protein, 321 aa, Corynebacterium glutamicum ATCC 13032
MELVRVTEAAALASGRWVGRGMKNEGDGAAVDAMRQLINSVTMKGVVVIGEGEKDEAPMLYNGEEVGTGFGPEVDIAVDPVDGTTLMAEGRPNAISILAAAERGTMYDPSSVFYMKKIAVGPEAAGKIDIEAPVAHNINAVAKSKGINPSDVTVVVLDRPRHIELIADIRRAGAKVRLISDGDVAGAVAAAQDSNSVDIMMGTGGTPEGIITACAMKCMGGEIQGILAPMNDFERQKAHDAGLVLDQVLHTNDLVSSDNCYFVATGVTNGDMLRGVSYRANGATTRSLVMRAKSGTIRHIESVHQLSKLQEYSVVDYTTAT

SEQ ID NO: 14978 - protein, 281 aa, Corynebacterium glutamicum ATCC 13032
MNIHLCCCSRLCGRMVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 14979 - protein, 375 aa, Corynebacterium glutamicum ATCC 13032
MMTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSLVGKTLGLGVK

SEQ ID NO: 14980 - protein, 292 aa, Corynebacterium glutamicum ATCC 13032
MLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 14981 - protein, 323 aa, Sorghum bicolor
MDTTSRAAKIPSLHQTEINWDNLDKTKLYVVGAGMFSGVTVALYPVSVVKTRMQVASGDAMRRNALATFKNILKMDGVPGLYRGFATVIIGAVPTRIIFLTALETTKAASLKLVEPFKLSEPVRAAFANGLAGLSASTCSQAIFVPIDVISQKLMVQGYSGNARYKGGLDVARKVIKADGIRGLYRGFGLSVMTYAPSSAVWWASYGSSQRIIWSALGHLHDKEEAPSQLKLVGVQASGGVFAGAVTSFVTTPIDTIKTRLQVMDNENKPKAREVVKRLIAEDGWKGLYRGLGPRFFSSSAWGTSMIVCYEYLKRLCAKVEEV

SEQ ID NO: 14982 - protein, 423 aa, Sorghum bicolor
MNEAVQEAKLLRQVNALIVAHLRSQNLGQAAAAVAAATMTPISAAESVPANQLLRLVAKGLAAEGGGGAASAFDSAGFGGAVQPLGSSAVDFSMQDVKGSSKSFPKHEAKHVSDHKNAARCAKFSPDGKYFATGSADTSIKFFEVAKIKQTMVGDSKDGPARPVIRTFYDHTQAINDLDFHPESPILISAAKDNTIKFFDFSKTNARKAFRVIQDTHNVRSVCFHPCGDYLLAGTDHPVAHLYDINTFTCYLSANAQDSSSPINQVRYSCTGSLYVTASKDGSLRIWDGVSAECVRPIIGAHGSAEATSAIFTRDERYVLSCGKDSCVKLWEVGTGRLVKQYAGAIRRQFRCQAVFNETEEFVLSVDEQNNEVVVWDALTAEKVARLPSGSTGAPRWLDHSPVEPVFVICGNDRSIRFWKQTV

SEQ ID NO: 14983 - protein, 563 aa, Gossypium hirsutum
MSDLQAPLRPKRKKGLVDFLVQFRWIFVIFFVLPFSTLYYFLIYLGDVRSEMKSYKQRQKEHDENVLKVVKRLKQRNPKKDGLVCTARKPWIAVGMRNVDYKRARHYEVDLSAFRNILEIDKQRMIARVEPLVNMGQITRVTVPMNLSLAVVAELDDLTVGGLINGYGIEGSSHIYGLFSDTVVAYEIVLADGRVVRATKDNEYSDLFYAIPWSQGTLGFLVAAEIKLIPVKEYMRLTYTPVVGNLQDLAQGYMDSFAPRDGDQDNPEKVPDFVEGMVYSPTEGVFMTGRYASKEEAKKKGNKINNVGWWFKPWFYQHAQTALKKGEFVEYIPTREYYHRHTRCLYWEGKLILPFGDQWWFRFLLGWLMPPKVSLLKATQGESIRNYYHEMHVIQDMLVPLYKVGDALEWVHHEMEIYPIWLCPHRLFKLPVKTMVYPEPGFEQHRRQGDTPYAQMFTDVGVYYAPGPVLRGEVFDGAEAVRKLEQWLIKNHSFQPQYAVSELNEKDFWRMFDADLYEHVRRKYGAVGTFMSVYYKSKKGRKTEKEVQEAEQAHLETAYAEAD

SEQ ID NO: 14984 - protein, 919 aa, Emericella nidulans
MAAAQSGSENTELSKQPSPQNDGCQDDDNHDQIGSSTPSPSGIATPQPNPADRRLPSIMHNYFQVGSSSAVMLRSLKTRFSLSDPSPSSADTMQSGSLANGTRDAQSSGHTSSSSGSFVIMERDEARLESPTTPPDNEAETQEISQESRPPAALPTPPCSSACSLLQKESEEPEAGPDKGMGSIFNTLKNYLSPSRSVSCSDSQARRHTSHPVSSISDDPVLASHFFNPSLSQTPESLCLVEAPLLDHEKPHVSASSENAAKLTANVSNPSHLKNTPPHTPRAMSDEDLQSNGKAPASPPRSSNPTHSPRDEPSDSADEITGKLNEVFPSSMDTSSSPSSGPPVASLKGKLHVKISEGKGLQPGFDPYVVCVFEWNEVISKSVQDEEQESLKRQQKELEQSALDSGRPMAIPMNRQSSHNNTLESTDHRGHAPITDPHWNHEAVFDVFGDQSEIDVSVYDRNDSEAFLGHVRLCVNLKEDNSRLDGWFPLKGRAAGDSRVSGEIHMEMRFEKTEKKQVGPNDFQILKLIGKGTFGQVYQVKKKDTRRIYAMKVLSKKVIIQKKEVAHTVGERNILVRTAMAASPFIVGLKFSFQTPTDLYLVTDYMSGGELFWHLQKEGRFQEPRAKFYIAELIMALQHLHDHDIVYRDLKPENILLDANGHIALCDFGLSKANLTQNDTTNTFCGTTEYLAPEVLLDEQGYTKMVDFWSLGVLVFEMCCGWSPFYAEDTQQMYKNIAFGKVRFPRDALSTEGRNFVKGLLNRNPKHRLGAQNDAKELMAHPFFHDIDWEALGRKEVIPPFKPKLKSDTDTSNFDPEFTNALENSNSLNDRAAALANGFMAASTPLSPGMQANFQGFTFVNESSIDHHFKNEVGDRMDEDYEPMHRSHRSGNSIDHRMAGVQKTGDAGEIFNVDDNFDM

SEQ ID NO: 14985 - protein, 504 aa, Rattus norvegicus
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSTEQILATLKGHTKKVTSVVFHPSQELVFSASPDATIRIWSVPNTSCVQVVRAHESAVTGLSLHATGDYLLSSSDDQYWAFSDIQTGRVLTKVTDETSGCSLTCAQFHPDGLIFGTGTMDSHIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 14986 - protein, 582 aa, Rattus norvegicus
MSALRAEQQPSRSGERQPLVAQGRWGPRRWRRTAAAAVLLVEMLERAAFFGVTSNLVLYLNSLNFNWDGEHASRATLLFLGASYLLAPVGGWLADVYLGRFLAISLSLLLYLAATGLLLTTITDDGRRSFCGEMPELPLKPACPSANCQGSWSSPYCATTLYLVLLLLALAASSVRSNLTSFGADQVMDLGRDATRRFFNWFYWSINLGAILSLLVVAFIEQNISFLQGYSIIVGLVGLAFFIFLIATPVFITKPPTGSQVSSMLNLAFQNCCPGWQWWRRPSSRNSEGAHLLPDQRSNQPGPSPQEDMANFQVLLKVLPVMVTLVPYWMVYFQMQSTYVLQGLHLHIPNIFRTNPNISLPLRSDSSNYRIPEAWLLLANVAVILILVPVKDHLIDPLLLRCKLLPSALQKMALGMFFGFTSIIVAGVLEKERLQYIAANQTVPQLIGKDLYYAAPLSIWWQIPQYLLIGISEIFASIPGLEFAYSEAPRSMQGAIMGIFFCLSGVGSLLGSGLVALLSLPGGWMYCPKDFGNINNCRMDLYFFLLAGIQAVTAVLFLWIAGRYERTRQDPDSQNSTSRVRG

SEQ ID NO: 14987 - protein, 461 aa, Thermococcus sp. GU5L5
MKPAKLLVFVLVVSILAGLYAQPAGAAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQYWLWASNESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDRLKNLIWIHDHLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 14988 - protein, 461 aa, Thermococcus sp. 'AEPII 1a'
MKKFVALFITMFFVVSMAVVAQPASAAKYSELEEGGVIMQAFYWDVPGGGIWWDTIRSKIPEWYEAGISAIWIPPASKGMSGGYSMGYDPYDFFDLGEYNQKGTIETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 14989 - protein, 432 aa, uncultured organism
MALEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 14990 - protein, 436 aa, synthetic construct
MAKYSELEKGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHENLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 14991 - protein, 496 aa, Nicotiana tabacum
MVLSKTASESDVSIHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 14992 - protein, 343 aa, Saussurea medusa
MALLVSSWSNGVQSVPKDYVMPPERRPGDFVSACNEIPVIDLQENPKIDRSDIVQQILKACQEFGLFQVINHGVSEKMMEDMRVLYHEFFNMPVDDKLRGYFEPWSTTGCSLYTSGVNYAKEDVHYWKDTLRHPCHPLEEHTPSWPEKPARYREEVGRYAVEVRKMGFKILDLIGEGLGLNEGYFNGVNQYQTMAINHYPLCPDPGLAMGIDGHTDPNLITFLQQDQYGLQMCKDGKWMGIDPIPNAFVVNIGYQLEIISNGKLKSAEHRVVTSSTTARTSIVTFFGPNAGLPIVVEPAKELVTSTSPKMFKSYQYNNFIADYLAYIRKPFPPSGTPLDPYRV

SEQ ID NO: 14993 - protein, 630 aa, Uncultured proteobacterium
MHSLLDEITAPSDLKTLSDQQLAQLADELRVDVIEAVSRTGGHLGSSLGVVELTVALHAVFDTPKDKLIWDVGHQCYPHKVLTGRRAGMGTLRQEGGLSGFTKRSESPYDPFGAAHSSTSISAAHGFTVARDLGQDTGDAIAVIGDGSISAGMAYEALNNAGAEGRRMFVILNDNEMSIAPPVGAMSKYMSGLAGTALAQLNAFGQDIETVLPGPMRDHARRARELVTGAVASQGTIFEELGFEYIGPIDGHDMSQLLSVLRSARTRAKGPVLIHCCTVKGKGYAPAETSADKYHGVAKFDVASGAQMKSGANAPSYTTVFGQTLTKLAEKDSKIVGITAAMPSGTGLDIFAQRFADRMFDVGIAEQHGVTFAAGLAASGLKPFCAIYSTFLQRGYDQIVHDVALQNLPVRFAIDRAGLVGADGATHAGAFDIGFLTALPNMVVMAAADEAELVHMITTAAAHDTGPIAFRYPRGTGTGVSIPQEGELLQIGKGRIVRPGAEIALLSFGGHLAEALKAADLISAQGVDATVADARFAKPLDHALISKLAKTHKVLITIEQGAQGGFGAMVLHYLADTGLLDGPLAVRSMTLPDRFIDQAAPDAMYADAGLTATDIAATALQALKRAPVSV

SEQ ID NO: 14994 - protein, 463 aa, Uncultured proteobacterium
  unsure (1)..(463): unsure at all Xaa locations
MAHDYIVKDISLAAFGRKELDIAETEMPGLMALRKEYGAAKPLKGARIVGSLHMTIQTAVLIETLVELGADVRWASCNIFSTQDHXAXAIAAGGTPVFAIKGQSLEEHWDYLDRSFMFPEGANMILDDGGDATLYVLLGARVEEGETDLIAVPKSEEEEAVFAQIKKRMAETPGWFTKTRAAIQGVSEETTTGVHRLYELVKQGQLPFPAINVNDSVTKSKFDNKYGCKESLVDGIRRATDTMMAGKVAVVLGYGDVGKGSAASLRGAGARVKVTEVDPICALQAAMDGFEVVLLEDVVSSADIFITTTGNKDVIRIEHMRDMKDMAIVGNIGHFDNEIQVASLKNHKWTNIKEQVDMIEMPNGNRLILLSEGRLLNLGNATGHPSFVMSASFTNQVLAQIELWTKGDDYSNEVYILPKHLDEKVARLHLDRIGVKLSKLNDEQAAYIGVSSEGPFKPEHYRY

SEQ ID NO: 14995 - protein, 186 aa, Emericella nidulans
MSSTSPSKEPEVEQEPHSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGDPSAELPAALQSCVPGVLQLEAPSPKPLIMQAAL

SEQ ID NO: 14996 - protein, 341 aa, Plasmodium yoelii
MIQFLKNLQLYKKRETSDIKPNTKKSKMKYEDFNFIRTLGTGSFGRVILATYKNEDLPPVAIKRFEKSKIIKQKQVDHVFSERKILNYINHPFCVKLYGSFKDESYLYLVLEFVIGGEFFTFLRRNKRFPNDVGCFYAAQIVLIFEYLQSLNIVYRDLKPENLLLDKDGFIKMTDFGFAKVVNTRTYTLCGTPEYIAPEILLNAGHGKAVDWWTLGIFIYEILVGYPPFYANEPLLIYQKILEGIIYFPKFLDNNCKHLMKKLLSHDLTKRYGNLKKGAQSVKEHPWFANIEWNNLLNKKVDVPYKPKYKNIFDASNFEKVQEDLSIADKVINENDPFFDW

SEQ ID NO: 14997 - protein, 152 aa, Onchocerca volvulus
VVSTAPTKLVNVSYNNLTVNLGNELTPTQVKNQPTKVSWDAEPGALYTLVMTDPDAPSRKNPVFREWHHWLIINISGQNVSSGTVLSDYIGSGPRKGTGLHRYVFLVYKQPGSITDTQHGGNRPNFKVMDFANKHHLGNPVAGNFFQAKHED

SEQ ID NO: 14998 - protein, 114 aa, Onchocerca volvulus
WDAEPGALYTLVMTDPDVPSRKNPVFREWHHWLIINISGQNVSSGTVLSDYIGSGPRKGTGLHRYVFLVYKQPGSITDTQHGGNRRNFKVMDFANKHHLGNPVAGNFFQAKHED

SEQ ID NO: 14999 - protein, 339 aa, Xenopus laevis
SFHRSGPAALQVTVRDALNQAMDEEIERDERVFLLGEEVAQYDGAYKISRGLWKKYGDKRVMDTPITEMGFAGIAVGAAMAGLRPICEFMTFNFSMQAIDQVINSAAKTHYMSGGLVSVPIVFRGPNGASAGVAAQHSQCFAAWYGHCPGLKVVSPWNAEDAKGLLKASIRDDNPVVFLENELMYGVPFELSEEVQSKDFVVPIGKAKIERPGSQITLVSHSRSVGHCLEAASVLEKEGIDCEVINMRTIRPMDTETIEASVVKTNHLVTVEGGWPQFGVGAEICANIMEGPAFNYLDAPVVRVTGTDVPMPYAKILEENCVPQVKDIIFAVKKTLNVL

SEQ ID NO: 15000 - protein, 1211 aa, Meleagris gallopavo
MSMLTPVLQPPEVKEYLSRGERFIKWDDETASASPVILRVDPKGFYLYWTYQNKEMEILDITSIRDTRVGRFAKIPKCQKLREVFNLDYPHSTFLLKTLTIVSGPDMVDLTFHNFVSYKENVGKSWAEDIMAIVQNPLTYNASRYTFLEKILVKLKMQLNAEGKIPVRNIFQMFPADRKRVEAALNACHLPKGKNDAINPEDFPETVYKTFLMNLCPRPEIDEIFTSHHFKAKPYMTKEHLAKFINKKQRDSRLNDILFPPAKPEQVQSLIEKYEPSVINIQRGQLSPEGMVWFLCGPENNVIALDKLVLYQDMTQPLSHYFINSSHNTYLTAGQFSGISSPEMYRQTLLAGCRCVELDCWKGRPPDEEPIITHGFTMTTEILFKDAIEAIAESAFKTSLYPVILSFENHVDSPKQQAKMAEYCRTIFGDMLLTEPLEKYPLKPGVPLPSPKDLLGKILIKNKKKQFVSEKRQSSMKKGKNVEPEIIEQPAFTDAEDTVWAGDVAEEEPEEEDDQLGNLDEEEIKKMQSDEGTAGLEVTAYEEMSSLVNYIQPIKFDSFEVSAQKNRSYVISSFTELKAYDLLTKFPMQFVEYNKRQMSRIYPKGTRMDSSNYMPQMFWNVGCQMVALNFQTMDVPMQQNMALFEFNGQCGYLLKHEFMRRPDKQFDPFSVDRIDVVVASTVSVTILSGQFLSDRSVKTYVEVELFGLPRDTKRKYRTKLTSTANSINPVWKEEPFVFEKIVMPELASLKIVAFEEGGKFIGHRVIPIIAVHSGYHHVCLRSESNMPLTMPSLFVYLEVKDYVPDAWADLTIALSNPIKFFNLQEKRSVNLKDGSEVERPDMQRNFSFPENNGIPESTRIFSTPFANGPAGAAALVKDGNMKEVTQLPEPQTASLAELQQMKLFLKLLKKQEKELKELERKGSKRREELLQKYSVLFLEPVYPRGKKRSMHSRKTQKKRSLTTGDVGTCMQPVEMAEKLDSQVVELKERLEMELIHLGEEYHDGIRRRKEQHATEQTAKITELAREKQIAELKALKESSESNIKDIKKKLEAKRLDRIQVMMRSTSDKAAQERLKKEINNSHIQEVVQTIKLLTEKTARYQQKLEEKQAENLRAIQEKEGQLQQEAVAEYEEKLKTLTVEVQEMVKNYMKEVFPDGPEIQKEAVLSIPVEEQGSTKQLEEKIPGAEVPRLTAATTEPPGAETDINIEESIL

SEQ ID NO: 15001 - protein, 1423 aa, Homo sapiens
MTVFRQENVDDYYDTGEELGSGQFAVVKKCREKSTGLQYPAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQVTCAASAQIPISRTKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNPVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTNNGAPKDFLPSPLHALLREWTTYPESTVGTLMSKLRELGRRDAADLLLKASSVFKINLDGNGQEAYASSCNSGTSYNSISSVVSR

SEQ ID NO: 15002 - protein, 252 aa, Homo sapiens
LNDGHFMPVLGFGTYAPAEVPKLAIEAGFRHIDSAHLYNNEEQVIADGSVKREDIFYTSKLWCNSHRPELVRPALERSLKNLQLDYVDLYLIHFPVSVKPGEILFDTVDLCATWEAVEKSIGVSNFNRRQLEMILNKPGLKYKPVCNQVECHPYFNQRKLLDFCKDIVLVAYSALGSHREEPWVDPRTPALIALRYQLQRGVVVSYNEQRIRQNVQVFEFQLTAIDGLNRNVRYLTLDIFAGPPNYPFSDEY

SEQ ID NO: 15003 - protein, 317 aa, Drosophila melanogaster
MLHLSKQLVVRAPKIRLNASAVSGSGQSSSFDQNSNNYSRKLVGPNLNQCHKRLSSSSQSSTAGTMKRLAGKVAVVTASTDGIGFAIAKRLAEDGAAVVISSRKQKNVDSALAELRKLNLNVHGLKCHVSEPEDRKQLFEETISKFGKLNILVSNAATNPAVGGVLECDEKVWDKIFDVNVKSSYLLAKEALPLLRQQKNSSIVFVSSIAGYDAFELLGAYSVSKTALIGLTKAAAKDLAPEGIRVNCLAPGVIRTKFSKALYENESANEAALSKIPMGRLGTSEEMAGVVSFLVSEDAGYITGESIVAGGGMTARL

SEQ ID NO: 15004 - protein, 204 aa, Drosophila melanogaster
MAKMYGKGKTAIESEELQKRRWQIELEFVQCLSNPNYLNFLAQRGFFKDQSFINYLKYLQYWKEPDYAKYLMYPMCLYFLDLLQYEHFRREIVNSQCCKFIDDQAILQWQHYTRKRIKLIENVTAAQQQQQQLQQQQQQANGMEAATGGESAAPTPNVNGSASTADSQQTSSALQPVQAQPGNPQQQQQINGVASGANIKLELN

SEQ ID NO: 15005 - protein, 366 aa, Drosophila melanogaster
MEYLSYVYEKIFGGNPPTDDTQGAFHTPRKVICFGNVLLDRLVQLEDPQLLERFGLELGSKGELDMEKLNQLAAEASESSRCLTNPGGSALNTARILKQLGTDALFFGAVGADKHAEELRQIIRDRGIEARLQTVEDAHTGQCVCLMYQDNPTLYANIGASAQFEVQTLSHAVSHEGQSFLRPVERKQILYVEGFFVPQRSDVCDYIVQHLVRERRRLALNLSAPYIVRKNHQAMMKLARAAFFLFGNRQEFEALAEAAGGFRNVDELADHLLQSGGTKVIFVTNGSAGVQVITNYVEELAPPGPVSFEDFRAQRVEQLVDATGAGDAFVAGFLHAWLEKRSLGECIRMASSVAAKVVTQVGCNLP

SEQ ID NO: 15006 - protein, 160 aa, Drosophila melanogaster
MAAFMEEALVEARRARDAGEVPVGCVFVHGDKVVARGGNEVNVHRNATRHAEFICIDAILASCRERRLPARQLFSEITVVVTVEPCIMCSAALHTLGVKEIIYGCENDRFGGKTVVDVAAVVGHRIEITGGVRADEAMALLKDFYKGDNPAAPPQAKKKK

SEQ ID NO: 15007 - protein, 179 aa, Drosophila melanogaster
MDDIVPDVLDAVPAGTIKVIYGDDLEVKQGNELTPTQVKDQPIVSWSGLEGKSNLLTLLMVDPDAPTRQDPKYREILHWSVVNIPGSNENPSGGHSLADYVGSGPPKDTGLHRYIFLLYRQENKIEETPTISNTTRTGRLNFNARDFAAKHGLGEPIAANYYQAQYDDYVPIRNKTIVG

SEQ ID NO: 15008 - protein, 420 aa, Drosophila melanogaster
MRCFLPLVALLLAAGVHADVSHLDTDLQEDGYHYKQPSVPFPPPGSGNGIEDSGIGPGPAPSAPAPSYGPPQTRPPPPPPPPQPTPPAPRPSYGPPQTQPPRPPPQPTPSAPAPPPPSYGPPQTPPPRPPPQPTPSAPAPPPSYGPPQTPPPRPPPQPTPSAPAPSYGPPQPQPPAPQPPSPPSPQPGPEYLPPDQPKPRPTPSRPQPPPPPPPRPQPTPGYGPPPPPPPPKPQPTPGYGPPTPPPGPGPAQPAPQPPRPQPPRPQPPRPQPGSEYLPPPGENEVTPTQPQPTAPVPEYGPPPPAPPAGPTYQPRPPAPPAPAPGPTYQPRPPAPPAPAPGPTYQPRPPSPPAPPAPTYQPQPPAPPAPAPGPTYQPRPPAPPAPTPEYGPPPPTSGGDEAGSLGPDGYNYNKPAKPFTF

SEQ ID NO: 15009 - protein, 380 aa, Drosophila melanogaster
MAEAMVVEDRPAEAKRFFCHMCNVEINIPNSDFTCPLCANGFVEELPANAPEMDSSTAGASGSARSGSSGSGSSGSHDTLSRGSSSSGSQVNVESLRNDIVSLLNMRNVPNLEITIEPNRRHSNVLHLGGFGGPSGSDSARGLTAGGRVRPANLDRLDNVLFDFLQSLPLAGATAEIVTGPGGGGVGGGGNSHMFFMGNPGDYAWGREGLDTIVTQMLNQMETSGPPPLSAQRINEIPNVQINAEEVNRKIQCSICWDDFKIDETVRKLPCSHLYHENCIVPWLNLHSTCPICRKSLADDGNDADDEFVMLDAFGPEMAADGSNSERRSASTATGTDNPSPANNPSQAAAEGGRTRPDANPAQAARNNIFTFDDDNMFLD

SEQ ID NO: 15010 - protein, 245 aa, Drosophila melanogaster
MADTANYINDRFQTFMNGLGDRYEPYVREHLSKVYMVLGSTAAATAMGAMLQMRDFLDLGVLAAVATLVLVLGLHFYKDDGKNYYTRLGMLYAFGFCSGQTLGPLLGYICSINPAIILSALTGTFVTFISLSLSALLAEQGKYLYLGGMLVSVINTMALLSLFNMVFKSYFVQVTQLYVGVFVMAAFIVYDTQNIVEKCRNGNRDVVQHALDLFFDVLSMFRRLLIILTQKEERKQNERRQNKTK

SEQ ID NO: 15011 - protein, 345 aa, Drosophila melanogaster
MTSTLQEGILVGCGNPLLDISAVVPLNFLQKYSMNEDDAILAEDRHMPIYGELVEGYQAEFLAGGSVQNSLRIAQWILRQPRVAVFFGCVGEDRYANILKEKAQAAGLDVHYQVKKDVPTGTCAVLITGTHRSLCANLAAANNFTIDHLEEPSNKALVDNAQYYYISGFFLTVNPPSIMQVAATAHAKQRPFLMNLSAPFISQFYMAPLLAALPYVDIIFGNEAEAQAFAEAQQWPSGDLREIGKRLVAMEKKNPTRPRIAILTQGCDPVLLIQQDSVQEFPVTKLAVHEIVDTNGAGDAFVGGFLSQFVQGKSLDVCIRCGNYAAGHIIKNPGCTYSGEPEFVE

SEQ ID NO: 15012 - protein, 376 aa, Drosophila melanogaster
MASTDIPMEAAVESATGITPNSNANSNNVAKKLPAEGSTGDNPNANADEMTSRDYYFDSYAHFGIHEEMLKDEVRTVTYRNAMYHNKHLFQGKTVLDVGCGTGILSMFAAKAGAAQVIAVDCSNIIEFARQVVIDNNLQDVITVVKGKIEEIELPNGIEGVDIIISEWMGYCLFYESMLDTVLYARDKWLKKDGMMFPDRGTLYITAIEDRQYKDEKINWWDDVYGFDMSCIRKVAVTEPLVDVVDPKQVVSTSCMVKEVDLYTVQKADLNFSSKFSLCIKRNDFVQALVTYFNIEFTKCHKRLGFSTSPDSTYTHWKQTVFYLDDHMTAKKNEEITGTFQMKPNERNNRDLDFVIDINFKGELSQIQESNTYRMR

SEQ ID NO: 15013 - protein, 338 aa, Drosophila melanogaster
MEFLHESVALGVDLLILGLCAREYVHYKRTAKVLKAAPQYNIDGDLKSVVERQRDKKIPYAVIRGTVTPIGVPLRSSLVPSVSGVLQIVKLHEHRVTRGFAGFWTEQHKLLHESANEMPFELRNQSHGVEIVDALSAAVLDVDVVYDNYEPSNLSLFDHVFGFFSGVRQRGLQTTEEVLREGSFLTAIGELELDGDTLRMQPSNEGPLFLTTATKSTLIKRFEDAKTTTILKLVVCSTISAILVAFIAKKLYRKRKQEREEAKIRERLDTERRERRARSRPHTLSQDQLCVVCSTNPKEIILLPCGHVCLCEDCAQKISVTCPVCRGSIVSKAAAFIA

SEQ ID NO: 15014 - protein, 604 aa, Drosophila melanogaster
MTAANTNKTTDKENDPGPNTSISTTATPPSAAAQNVGGCFGSSGGRSSPKFQSYVNGNGYGVYKIIKTLGKGNFAKVKLAIHLPTGREVAIKLIDKTALNTIARQKLYREVNIMKKLNHPNIVRLLQVIESERTLYLVMEYVSGGELFNYLVKNGRMRERDARVLFRQLVSAIEYCHSKSIVHRDLKAENLLLDQQMKLKIADFGFSTTFEPKAPLETFCGSPPYAAPELFRGKKYSGPEVDSWSLGVVLYTLVSGSLPFDGTNLKELRDRVLRGKYRVPYYVSIECESLIRKFLVLNPTQRTSLSAVMADRWINMGYEQGNGLRPFQEKPMDLHDVNRLSLLSNMGHKPRDVEQSLKNQKFDDIYCTYMLLDVAKPRSTACSEKSGSSFRETPTAMPGSSRIPVPIAAPNVTISQVTFALDKSTPNRPAATSIRPMAPRLANALTPLPLTPPPKKYICCSASKAANPRRSEPSSIPQSAMPKKGVGSPVDVKTTLLSAQRKLAVNQKLTSASHQIRSPITQSPSQASECTRTPPTHFEMLDSTSTPLKVLKLVASNSQTPPSTENTNRPTRVGFFSKLSARFVRRSLHKGEKDISEQGRNLTK

SEQ ID NO: 15015 - protein, 1038 aa, Drosophila melanogaster
MDAKESDFITISNLQSYPPIVAEHQENVQVPHFLPDPRDGSIYQLGQMGSLKKLPYTIPQLVANAPCRSSDGILYSGKKSDTWYMVDPKTGRREKVMGFGDATVDGKEGEQIGWATSRAIYLGRTQYTVMMYDSLAKNKDAKPWNITFYDYNAVSAPPELAKEYEYIHLTTTTNGQIVTLDRKHGKFLWQRDLSSPVVAAFLLGPDGLLSVPFTTVSDEAYQAILEESKTGNVNTVKLFQSLYVGEHQKGLYALPSLVDKNTPRISTAPPIKLLDGPTGDQNSNQETDPRTIYINDVLQEHAGIMLGHYNMPNEGNGNLQLSPTTASSKVVQSLATIHNYNDGYGLLANNEKNAADIGVQTDPELVEIGIDQRTNGNTINRTKTIILQNSNKVQAFINEWFMEHPSGKVHQILIVIVLGMIALFWYTCSTMRELQKQSENGSKTFAIAQNGSNGSTGSNGSNANAEDLVDLGNGQVRVGKISFSTNEVLGKGCEGTFVFKGTFEERFVAVKRLLPECFTFADREVALLRESDAHENVVRYFCTEQDRQFRYIAVELCAATLQDYTEGDRSLELQNHIDVWQVLSQAASGLSHLHSLDIVHRDIKPQNVLISLPDAKGKVRVMISDFGLCKKLNFGKTSFSRRSGVTGTDGWIAPEMMRSQRTVRHDFYYYPTLLLHHHKNFLKSMSFNYLQTTAVDIFSLGCVYYYVLSGGHHAFGDNLKRQANILSHEYNLAKLRPEDDSEDSRIILAEQLISDMIHKDPQSRPPARCIGNHPLFWDEPKMLSFLQDVSDRVEKLQFHAEPLKSLEKNGRIVVLDDWNVHLDPMITDDLRKYRGYMGASVRDLLRALRNKKHHYHELTPAAQKMLGCIPHEFTNYWVDRFPQLISHAYHAFSICSNEPIFKPYYSAGYLFTRPWYFDADDALFPMLMLDPKPLPKIGSPKKTPSPASSQAQQLKQRKGLYNFRKPNDELPIPGVGLQRNLELDGQSLEPDGKRDVFANFKFRRYSKPGNNRNYNGGHKEAQDKEKYVIWTLPPSTQD

SEQ ID NO: 15016 - protein, 705 aa, Drosophila melanogaster
MSVDNSLGILDLSSGKESEKTAMTAANKENDPDSHFTGTIVTTGATAQPATPTTSNATALPATPTVAAGQDLGDGACSSKNTDSKFQSYVNGNGNGVYKIIKTLGKGNFAKVKLAIHVPTGREVAIKVIDKTQLNTSARQKLYREVKIMKLLNHPNIVRLFQVIESERTLYLVMEYASRGELFDHLVKNGRMRERDARVIFRQLVSAIQYCHSKFVVHRDLKAENLLLDQHMNIKIADFGFGNTFDPNAQLETFCGSPPYAAPELFMGRKYAGPEVDAWSLGVVLYTLVSGSLPFDGGTLKELRERVLRGKYRVPYYISMDCENLMRKFLVLNPAKRTSLSAVMSDKWINLGHDESDRLRPFREKPMELQDAARFDLLMSMGHKRRDVEQSVKGQLFDDIYCTYMLLGVAKPRSSNRSTKPEAIPTVDLTTPAVSSPLPNITTPTVTIAHVTLALDKNPPIHSSSASGRPIAPRLANAPNTPTSTPPTGPPAKPTRRTPARTPARKATNHTSGQGRPEPSSLPHTPQSKRASANMDVKPTLLSAQRQLAQTQKLANTPPRFQYPVAQTPNQAQGSSRRPTTLYEKAEPAVTPLLVPKSPAMGARLLERIPGGGAVEKTSDKPFTRQNVARATFHFGQARSGKRGGGSGNGAGGEEDSYQTPPLSADDTKPASRVGFFSKLTARFGRRVIHLNEKDVTEQRKNLTK

SEQ ID NO: 15017 - protein, 555 aa, Drosophila melanogaster
MLENISLCVIKIETDLDPSADSEGAVSAEHPTNPRVLKERERDRGLRQSRDITIETYTNQRWKRELSEPRQQEMNWVAAVQHVNSPSAGSSREITPRSGDDGQAGASASNFPQEIGYFSGNPIVEVTKGLIHLYKKNERKAIKEAPSNQLCLLAVPATLNCHDLLNFIAPCHAEIKHIQIVRDGSPNQFMVLLEFRSNESALEFYKSYNGSTYNSLEPDSLCHAVWVSEVERSEHGAPPMGHTELPTCPVCLERMDESVDGVLTILCNHAFHASCLMKWGDSTCPVCRHVQTPGLVEDSVCMECEGTDSLWICLICGHVGCGRYQGGHAAAHFRATNHTFAMQLGTSSVWDYAGDNFVHRLFQNKSDGKLVASQTEKDEREEKIDSMQMEFTYLLTSQLDTQRKYYEERMERLEQEWQNHKATANDAKTEVSELQQLQQNMQKEKVNLERKLAQHTAKLKDVQKQLNEERELSKALQSNQSSWHGKYKLLEQQYNEFKQTHDAEVTELKEQLRDIMFFLDNQQKLANTEIAGGTVTGIAEKEPDPNTRRRNRRKK

SEQ ID NO: 15018 - protein, 257 aa, Drosophila melanogaster
MPSFKDKVIIVTGASSGIGAGTSVLLAKLGGLLTIVGRNLDKLNETAEQIVAAGGAPALQVAADINSESDVQGIVSATLAKHGRIDVLVNNAGILELGSIENTSLEQFDRVMNTNVRSLYQLTHLVTPELIKTKGNIVNVSSVNGIRSFPGVLAYNVSKAAVDQFTRCVALELAPKGVRVNSVNPGVIITELQRRGGLDQEAYVKFLEHAKVTHALGRPGEVKEVAAAIAFLASDEASFSTGISLPVDGGRHAMCPR

SEQ ID NO: 15019 - protein, 264 aa, Drosophila melanogaster
MANVESLYKELTAEWSKRPPNTVKCGQLLDQLKVALVKMAFLPTDGNDAQSSKKQLILARSVLEVAVEHSVLSKDLLAFERYMAQLKCYYYDYAKIIGESESKYKLLGLNLLYLLSGNRVSDFHTELELLSVDVIQHNQFIRPILALEQYIMEGRYNKIFQAKSTVPVEVYSYFMDLLLETVRDEIGACIEKSYDKISAKDAAKRLNLRVPDEIKAFGAKRQWKLEASGDYSFTDRSVKPKELLPSEELAEQVLSYARDLEMIV

SEQ ID NO: 15020 - protein, 516 aa, Drosophila melanogaster
MKDTEVNDNTTEEEPVKEAPEVPANSSSDEDEYDDIDDDDEPMDEGDELTTCLFCTETSANISVAIDHLDARHKVNLSQLQRKFEMDQYSFIKLINYIRAKKISAEQLLSAEHPLWQDEKYLQPGEYEPWLCYDYEVLKTDGAPTQPSVLELQQRIAEQSQLLQQANEDMERMRNDYKALLQKVHADGEPKGSDQSVPRNNVCLDNEYFKSYAHFGIHHEMLSDKVRTSTYRASLLQNEAVVRGKTVLDVGCGTGILSIFASKAGAARVVGIDNSDIVYTAMDIIRKNKVENVELIKGRLEDTDLPETKYDIIISEWMGYFLLYESMLDSIIYARENHLNPNGIILPSRCTLSLLGYGDDTLYADEVEFWSNVYEVDMSDLRKQSIEEPLMQVVDAEFMLTEPEQIANFDIMTVDMNYPNFTHQFSLKVTKPGRLSAFVGYFETLFELPSPVMFSTSPSATPTHWKQTVFFIENPQVVKEGDVICGKITSRRHKEDVRGLSVDIEVFGKKHKYNVV

SEQ ID NO: 15021 - protein, 202 aa, Drosophila melanogaster
MLRVLLPLVGCLLAVQAGSVEEVFRSHQVVPDVIPEPPNQLLKVTYSNNLVAKDGVELTPTQVKDQPVVEWDAQPGEFYTLIMTDPDAPSRAEPKFREFKHWILANIAGNDLASGEPIAEYIGSGPPQGTGLHRYVFLLYKQSGKLEFDEERVSKRSRKDRPKFSAAKFAINHELGNPIAGTFYQAQYDDYVPKLHKQLSEN

SEQ ID NO: 15022 - protein, 412 aa, Drosophila melanogaster
MSVESSSSAVQQPPSSSNLPLLGDNQAVATTSSASSASSSSTSSSSSSVGGGNVVGVPLDTQGSGEPPAKKQLLDGGGGGATSSSGSSLLSSAAAASGMHEKLAHRISNALCCAVCLDLPKTAMYQCQMGHLMCAACFTHLLADGRLRDQIATCPNCRVEISKSTASRNLAVEKAASELPSECQFCNKEFPYKSLERHEQHECQERPTKCKYHRIGCQWRGPYHETNEHERNCLHPQKSGYEVMAALEAHDDRIKEEKKMFNTLIDLLSYEKIIFNDLQMKPYRTDEYVHKLFYETARFSAFNQQWVVKARINNSQRDPHQSNERTITYQLILKTKTSTPMSIHFFALKGPFSDMKVSTQIYKHEFTETSTESEYYVLPLPDGVGGSGSSECNRMLANKGINFRLLMFLLNK

SEQ ID NO: 15023 - protein, 698 aa, Homo sapiens
MVGLLLGGIIFGVDEKSPPAMKTDVFFLYLLPPIVLDAGYFMPTRPFFENLGTIFWYAVVGTLWNSIGIGLSLFGICQIEAFGLSDITLLQNLLFGSLISAVDPVAVLAVFENIHVNEQLYILVFGESLLNDAVTVVLYNLFKSFCQMKTIQTVDVFAGIANFFVVGIGGVLIGILLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTQVINWFRTIPLTFKDQFIIAYGGLRGAICFALVFLLPATVFPRKKLFITAAIVVIFFTVFILGITIRPLVEFLDVKRSNKKQQAVSEEIHWCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNSLSNPPATLSYNRHNLTADTSERQAKEILIRRRHSLRESLRKDNSLNRERRASTSTSRYLSLPKNTKLPEKLQKKNKVSNADGNSSDSDMDGTTVLNLQPRARRFLPDQFSKKASPAYKMEWKNEVDVGSARPPPSVTPAPRSKEGGTQTPGVLRQPLLSKDQRFGRGREDSLTEDVPPKPPPRLVRRASEPGNRKGRLGNEKP

SEQ ID NO: 15024 - protein, 156 aa, Homo sapiens
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENSMRYINGTRLDDRIIRTDWDAGFKEGRQYGRGRSGGQVRDEYRQDYDAGRGGYGKLAQNQ

SEQ ID NO: 15025 - protein, 122 aa, Drosophila melanogaster
MAEEIEVEETEDFHDMDFNDEEPSCSGGAVQARTERFVVKKWVAHAMWGWDVAVDNCAICRNHIMNLCIECQADPNANQDECTVAWGECNHAFHYHCIARWLKTRLVCPLDNKEWVYQKYGR

SEQ ID NO: 15026 - protein, 585 aa, Petunia x hybrida
MAVLPGENPIAVHNNKEMGKIPPLNSLPVGYRFRPTDEELVNHYLRLKINGADNEVSVIREVDICKLEPWDLPIWSVVESNDNEWFFFCPKDRKYQNGQRLNRATERGYWKATGKDRNIVTKKGAKIGMKKTLVYYIGRAPEGKRTHWVIHEYRATDKSLDGTHPGQGAFLLCRLFRKNDLKQDEHVESSNLDDAEQNATAAKSPTDDELSEAATPLVAGQPLGDSDKSYAAKFPKGEPYGKQLPLESHSNSCIADDTEDQMVDITSIPPDLELEKALGNFCDQSSQPLDWKIFSPLHAQMQVEFGSSYLQAPMNNDMSAFQKDVQFQYGTNALDINDFLDSVIVSSDEFSCGDSGQEVGLHNFDTTIHSFTGAPVKDSGSCSESEAEVTQRLVEPDFFEPEILLGNFDQATDVKGGVNSIQTTVQDAAGAPYFSNDHVMGNVGFLQNTYIGQNDFSAGYGGIQVPNFLTVQESGGYNNVVSSDSGSGTGIKLRTRQMQNQPDDRQSRMQGTANRRIRLQMKLQVGPVKSRIHSDSSQGAESDEAATEGERVSDEHSSTTSAAITSDEARDATHEEFKSKLVKEA

SEQ ID NO: 15027 - protein, 731 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 15028 - protein, 751 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHRKCNYSFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 15029 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 15030 - protein, 448 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 15031 - protein, 530 aa, Homo sapiens
MSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 15032 - protein, 204 aa, Homo sapiens
MEPKASCPAAAPLMERKFHVLVGVTGSVAALKLPLLVSKLLDIPGLEVSVVTTERAKHFYSPQDIPVTLYSDADEWEMWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 15033 - protein, 258 aa, Homo sapiens
MAKYQGEVHSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 15034 - protein, 428 aa, Homo sapiens
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 15035 - protein, 393 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 15036 - protein, 313 aa, Mus musculus
MAEASPQPGRYFCHCCSVEIVPRLPDYICPRCESGFIEELPEETRNTENGSAPSTAPTDQNRQPFENVDQHLFTLPQGYSQFAFGIFDDSFEIPTFPPGAQADDGRDPESRREREHQSRHRYGARQPRARLTARRATGRHEGVPTLEGIIQQLVNGIISPAAVPSLGLGPWGVLHSNPMDYAWGANGLDTIITQLLNQFENTGPPPADKEKIQALPTVPVTEEHVGSGLECPVCKEDYALGESVRQLPCNHLFHDSCIVPWLEQHDSCPVCRKSLTGQNTATNPPGLTGVGFSSSSSSSSSSSPSNENATSNS

SEQ ID NO: 15037 - protein, 324 aa, Sphingobium chlorophenolicum
MTNPVSTIDMTVTQITRVAKDINSYELRPEPGVILPEFTAGAHIGVSLPNGIQRSYSLVNPQGERDRYVITVNLDRNSRGGSRYLHEQLRVGQRLSIVPPANNFALVETAPHSVLFAGGIGITPIWSMIQRLRELGSTWELHYACRGKDFVAYRQELEQAAAEAGARFHLHLDEEADGKFLDLAGPVAQAGQDSIFYCCGPEAMLQAYKAATADLPSERVRFEHFGAALTGEPADDVFTVVLARRSGQEFTVEPGMTILETLLQNGISRNYSCTQGVCGTCETKVLEGEPDHRDWVLSDEKKASNSTMLICCSLSKSPRLVLDI

SEQ ID NO: 15038 - protein, 381 aa, Mus musculus
MLLSIGMLMLSATQVYTILTVQLFAFLNLLPVEADILAYNFENASQTFEDLPARFGYRLPAEGLKGFLINSKPENACEPIVPPPLKDNSSGTFIVLIRRLDCNFDIKVLNAQRAGYKAAIVHNVDSDDLISMGSNDIDTLKKIDIPSVFIGESSANSLKDEFTYEKGGHIILVPELSLPLEYYLIPFLIIVGICLILIVIFMITKFVQDRHRNRRNRLRKDQLKKLPVHKFKKGDEYDVCAICLEEYEDGDKLRILPCSHAYHCKCVDPWLTKTKKTCPVCKQKVVPSQGDSDSDTDSSQEENQVSEHTPLLPPSASARTQSFGSLSESHSHHNMTESSDYEDDDNEETDSSDADNEITDHIVVVQLQPNGEQDYNIANTV

SEQ ID NO: 15039 - protein, 381 aa, Gallus gallus
MLLSIGMLMLSATQIYTIVTVQLFAFLNLLPVEADILAYNFENGTQTFDDLPARFGYRLPAEGLKGFLINSKPENACEPIAPPPLRDNSSTAFIVLIRRLECNFDIKVLNAQRAGYKAAIVHNVDSDDLISMGSNDIEILKKIDIPSVFIGEASANSLKEEFTYEKGGHVVLIPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSETDSSQEENEVSENTPLLRPLASVSTQSFGALSESHSHQNMTESSEYEEDDNDNIDSSDAESGVNEESVVVQLQPNDERDYRVTNTV

SEQ ID NO: 15040 - protein, 466 aa, Brucella melitensis
MTASQDFVVKDISLADWGRRELDIAETEMPGLMAAREEFGKSQPLKGARISGSLHMTIQTAVLIETLKVLGAEVRWASCNIFSTQDHAAAAIAATGTPVFAVKGETLEEYWTYTDQIFQWPDGEPSNMILDDGGDATMYILIGARAEAGEDVLSNPQSEEEEVLFAQIKKRMAATPGFFTKQRAAIKGVTEETTTGVNRLYQLQKKGLLPFPAINVNDSVTKSKFDNKYGCKESLVDGIRRGTDVMMAGKVAVVCGYGDVGKGSAQSLAGAGARVKVTEVDPICALQAAMDGFEVVTLDDAASTADIVVTTTGNKDVITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTVLSEEQAAYIGVTPQGPFKSEHYRY

SEQ ID NO: 15041 - protein, 482 aa, Streptomyces argillaceus
MSADFTDFKVADLSLAEFGRKEITLAEHEMPGLMSIRREYAEAQPLAGARVTGSLHMTVQTAVLIETLVALGAQVRWASCNIFSTQGHAAAAIAVGPDGTPDNPRAVPVFAWKGETLEEYWWCTEQALTWPDSPTGGPNMILDDGGDATLLVHKGVEYEKDGKVPSVDTAENDEHRVILELLNRTITDGSQKWTQLASEIRGVTEETTTGVHRLYEMQRDGVLLFPAINVNDAVTKSKFDNKYGCRHSLIDGINRATDVLIGGKTAVVFGYGDVGKAARSLRGQGARVIVTEIDPICALQAAMDGYQVTTLDEVVDKADIFITTTGNKDIIMAADMARMKHQAIVGNIGHFDNEIDMAGLAKVPGIVKDEIKPQVHTWTFPDGKKIIVLSEGRLLNLGNATGHPSFVMSNSFADQTLAQIELFTKPGDYPTGVYTLPKHLDEKVARLHLDALGVKLTTLRPEQASYIGVDVDGPYKSDHYRY

SEQ ID NO: 15042 - protein, 480 aa, Xylella fastidiosa
MNTHPQTSPNTHYKIADISLTDWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLSDGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNALAGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 15043 - protein, 485 aa, Lupinus luteus
MALLVEKTTSGREYKVKDMSQADFGRLEIELAEVEMPGLMASRSEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEIYEKSGQFPDPDSTDNAEFKIVLSIIKEGLKTDPKRYHKMKDRVVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQATMEGLQVLTLEDVVSEADIFVTTTGNKDIIMLDHMKKMKNNAIVCNIGHFDNEIDMLGLETHPGVKRITIKPQTDRWVFPETNTGIIILAEGRLMNLGCATGHPSFVMSCSFTNQVIAQLELWNEKSSGKYEKKVYVLPKHLDEKVAALHLEKLGAKLTKLSKDQADYISVPVEGPYKPFHYRY

SEQ ID NO: 15044 - protein, 485 aa, Lycopersicon esculentum
MALLVEKTTSGREYKVKDMSQADFGRLEIELAEVEMPGLMASRAEFGPSQPVKGAKITCSLHMTIQTAFLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPTSTDNVEFQLVLTIIKESLKTDPLRYTKMKERLVGVSEETTTGVKKLYQMPANGSLLFLPINVNDSVTKSKFDNLYGCRHSLPDGLMRATDVMIAGKVALVAGYGDVGKGCAAAMKQAGARVIVTEIDPICALQATMEGLQVLFLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERSSGKYEKKVYVLPKHLDEKVAALHLGKFGAKLTKLTKDQADYIYVPVEGPYKPAHYRY

SEQ ID NO: 15045 - protein, 416 aa, Aeropyrum pernix
MAQGFKVRDLSLAGEGRMQIEWAERHMPVLMRLRSSMGGDKPLSGVRVAACLHVTKETAVLVETLRKWGAEVYLAPSNPLSTQDEVAAALAEAGIGVFAWRGMTPEEYKWALSTVAGREPDIVIDDGADLHVLLHEEMRSVGEKVWGGTEETTTGVIRLRALEREGRLLYPVIAVNDALTKFMFDNRYGTGQSTVDGVLRATNILIAGKTVVVAGYGWVGRGIAARFRGMGAKVVVTEVDPVRALEAAMDGFTVTTMDEAASLGDVFITATGNINVIDARHMEKMKDGAILANAGHFNVEINVAALEEMSVSKRRVRRYLDEYRLPDGRRLYLIGEGRLVNLVAAEGHPSEVMDMSFSNQALAVLKIAGERGRLEKRVHRVERIQDEMVARLKLETMGVRIDSLTEEQKLYLQKWK

SEQ ID NO: 15046 - protein, 462 aa, Roseobacter denitrificans
MTKDFIVKDIALAEFGRKELDIAETEMPGLMALRAEYGDSKPLAGARIVGSLHMTIQTAVLIETLVALGADVRWASCNIFSTQDHAAAAIAAGGTPVFAIKGQSLEEHWDYLDRSFMFEDGPNLILDDGGDATLYVLLGARAEAGEEIIPVPTSEEEEAIKAQIKKRMAASPGWFTKVRDQIKGVSEETTTGVHRLYDLVKQGQLPFPAINVNDSVTKSKFDNKYGCKESLVDGIRRATDTMMAGKVAVVMGYGDVGKGSAASLRGAGARVKVTEVDPICALQAAMDGFEVVLLEDVVGSADIFITTTGNKDVIRIEHMRAMKDMAIVGNIGHFDNEIQVAALKNHKWTNIKEQVDMIEMPNGNRLILLSEGRLLNLGNATGHPSFVMSASFTNQVLAQIELWTRADAYDNEVYILPKHLDEKVARLHLDRIGVKLTPLDPEQAAYIGVKPEGPFKPEHYRY

SEQ ID NO: 15047 - protein, 245 aa, Bos taurus
MDKNELVQKAKLAEQAERYDDMAAAMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 15048 - protein, 745 aa, Cricetulus griseus
GLQDDQDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSSADAQHWVQGLRKIIHHSGSMDQRQKLQHWIHSCLRKADKNKDNKMNFKELKDFLKELNIQVDDSYARKIFRECDHSQTDSLEDEEIETFYKMLTQRAEIDRVFAEAAGSAETLSVEKLVTFLQHQQREEAAGPALALSLIERYEPSETAKAQRQMTKDGFLMYLLSADGSAFSLAHRRVYQDMDQPLSHYLVSSSHNTYLLEDQLTGPSSTEAYIRALCKGCRCLELDCWDGPNQEPIIYHGYTFTSKILFYDVLRAIRDYAFKASPYPVILSLENHCSLEQQQVMARHLKAILGPMLLDQPLDGVTMSLPSPEQLKGKILLKGKKFGGLLPAGGENGPETTDVSDEDEAAEMEDEAVRSQVQQKSKEDKLNVAPELSDMVIYCKSVHFGGFSNPSTSGQAFYEMASFSENRALRLLQESGNNFVRHNVSHLSRIYPAGRRTDSSNYSPVEMWNGGCQIVALNFQTPGPEMDVYLGRFQDNGACGYVLKPAFLRDPDTAFNPRALTQGPWWAQKRLRVRVISGQQLPKVNKSKNSIVDPKVIVEVHGVGQDVASRQTAVITNNGFNPWWDTEFEFEVAVPDLALVRFVVEDYDASSKNDFIGQSTIPWNSLKQGYRHVHLLSKNGDQHPSATLFVKISLQD

SEQ ID NO: 15049 - protein, 764 aa, Cricetulus griseus
MNGEADCPTDLEMAAPKGQDRWSQEDMLTLLECMKNNLPSNDSSKFKTTESHMDWEKVAFKDFLGDMCKLKWVEISNEVRKFRTLTELILDAQEHVKNPYKGKKLKKHPDFPKKPLTPYLRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEQRPELSESELTRLLARMWNDLSEKKKAKYKAREAALKAQSERMPGGEREERGKLPESPKRAEEIWQQSVIGDYLARFKNDRVKALKAMEMTWNNMEKKEKLMWIKKAAEDQKRYERELSEMRAPPAATNSSKKMKFQVEPKKPPMNGYQKFSQELLSNGELNHLPLKERMVEIGSRWQRISQSQKEHYKKLAEEQQKQYKVHLDLWVKSLSPQDRAAYKEYISNKRKNMTKLRGPNPKSSRTTLQSKSESEEEEDEEDEDDDEEEEEEDDENGDSSEDGGDSSESSSEDESEDGDENEDDDDDDDDDEDDDEDEDNESEGSSSSSSSSGDSSDSDSN

SEQ ID NO: 15050 - protein, 727 aa, Cricetulus griseus
MNGEADCPTDLEMAAPKGQDRWSQEDMLTLLECMKNNLPSNDSSKFKTTESHMDWEKVAFKDFLGDMCKLKWVEISNEVRKFRTLTELILDAQEHVKNPYKGKKLKKHPDFPKKPLTPYLRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEQRPELSESELTRLLARMWNDLSEKKKAKYKAREAALKAQSERMPGGEREERGKLPESPKRAEEIWQQSVIGDYLARFKNDRVKALKAMEMTWNNMEKKEKLMWIKKAAEDQKRYERELSEMRAPPAATNSSKKMKFQVEPKKPPMNGYQKFSQELLSNGELNHLPLKERMVEIGSRWQRISQSQKEHYKKLAEEQQKQYKVHLDLWVKSLSPQDRAAYKEYISNKRKNMTKLRGPNPKSSRTTLQSKSESEEEEDEEDEDDDEEEEEEDDENGDSSEDGGDSSESSSEDESEDGDENEDDDDDDDDDEDDDEDEDNESEGSSSSSSSSGDSSDSDSN

SEQ ID NO: 15051 - protein, 113 aa, Mus musculus
MSASVVSVISRFLEEYLSSTPQRLKLLDGYLLYILLTGALQFGYCLLVGTFPFNSFLSGFISCVGSFILAVCLRIQINPQNKADFQGISPERAFADFLFGSTILHLVVMNFVG

SEQ ID NO: 15052 - protein, 481 aa, Mus musculus
PCGEARAVAAALAAAAGTAGTGAELAAERAVASRVGSRRAAEVRPEAMVIMSEFRAVPSGTGRSQKPLRVGFYDVERTLGKGNFAVVKLRGHRVTKTQVAIKIIDKTRLDSSNLEKIYREVQLMKLLNHPNIIKLYQVMETKDMLYIVTEFAKNGEMFDYLTSNGHLSENEARQKFWQILSAVEYCHNHHIVHRDLKTENLLLDSNMDIKLADFGFGNFYKPGEPLSTCVGSPPYAAPEVFEGKEYEGPQLDVWSLGVVLYVLVCGSLPFDGPNLPTLRQRVLEGRFRIPFFMSQDCETLIRRMLVVDPAKRITIAQIRQHRWMQADPTLLQQDDPAFDMQGYTSNLGDYNEQVLGIMQALAIDRQRTIESLQNSSYNHFAAIYYLLLERLKEHRSAQPSSRPTPAPTRQPQLRSSDLSSLEVPQEILPCDPFRPSLLCPQPQALAQSVLQAEIDCDLHSSLQPLLFPLDTNCSGVFRTDP

SEQ ID NO: 15053 - protein, 132 aa, Crithidia fasciculata
MEVNPSGAKEAAFQSGSKSAKAGLIFPVGRVGSMLRRGQYARRIGAAGAVYMTAVVEYLTAELLELSVKAAAQSGKKPRRLSPRTVTMAVRHDDIGSLLKNVTMSRGGVVPSINKALAKKKGGKKSKATPSA

SEQ ID NO: 15054 - protein, 393 aa, Nicotiana tabacum
MDGSGQQTDTMMSDAGAEQPPTAPQPVAGMDNIPATLSHGGRFIQYNIFGNIFEVTAKYKPPILPIGKGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPTAIDLVEKMLTFDPRRRITVEGALAHPYLNSLHDISDEPICMTPFSFDFEQHALTEEQMKELIYRESLAFNPEYQHM

SEQ ID NO: 15055 - protein, 162 aa, Physcomitrella patens
MAGGEEFRCFVGGLAWATTDGRLEGAFRPFGEVVQSKVISDRETGRSRGFGFVTFADENSMNAAIKEMNGQELDGRNITVNQAQSRGGGGGGGGGGGGYGRREQGGGGYGGGYGGSRGGGDREGSGYGGSRGGGYGGGGGGGYGGRGGPSSGNWRNDRQPEY

SEQ ID NO: 15056 - protein, 178 aa, Physcomitrella patens
MGEEFRCFVGGLAWATTDGSLEEAFRPFGEVVQCKVITDRETGRSRGFGFVTFADENSMNEAIKDMNGKELDGRNITVNQAQSRGGGSGGGGGGGYNNRQGGGGGYGGGGYGGGGGGGYGAGGGGAYGSRSSYDREGGGGGGYGGSRGGGGYGSGGGGGGGRGGSGSGNWRGGRENAY

SEQ ID NO: 15057 - protein, 155 aa, Physcomitrella patens
MAFLAQLGGLVRQSIARNALQRHSSAAAIPAMFLVSRGMSGSKLFVGGLAWGTTDDNIKEAFSAFGEVTEVKIICDRDTGRSRGFGFVTFATDQDAEAALQALDGRDLAGRTIRVNYATKQSPQDRQSGGGMYGRRDHSGGNSGNFGGSGTWRGM

SEQ ID NO: 15058 - protein, 521 aa, Rhodococcus sp. YK2
MTLSSLGDEYLATVPTGRSVTPHWESGAEFRDEIFVGGLWRRGTGSLIESVDPSSGKIFATLHGAVEADVDDAVDTGLCAVRQSGWADRLPHERAAVLHRIGALIDAEVEQIATLQTIDTGKTLSETRALARSAAATFRYVAAAVETMEGAVTPSRGSYLTMSTHEPMGVIGSITPWNSPIASDAQKIAPALGAGNAVVAKPPVWAPWVTLLLARICERAGLPAGVLSVLPGPGRTVGDAIVRHPGIAKVTFTGGTDTGRALAHVAAEKLMPITLELGGKSPTIVFEDADLDQAVAGIMFGVFSSSGQSCIAGSRVFVQRSIFDEFVNRLVTATNALELGPGTDPRTQVAPMVAFSHRDNVSAMVDEAVLQGAKVLCGGMIPDEPRLADGAYYLPTILSVTDNSAPICQQEIFGPVAIVLPFDNESDLVDQANDTVFGLACGLWTTDFPRAWRIAKAISAGTVWVNTYKQFSISTPFSGLKDSGLGTEKGRDGIRSYMNQKSIYIDTAGQPLPWARTADNR

SEQ ID NO: 15059 - protein, 543 aa, Drosophila melanogaster
MNRRLQQSRSMGANTGGSLEEPSSAGAAGGPGASPGTAAGVRQMGFWRVNLNDVFSLSTASSTEALRSFISHSNFRYPPATTAAPAAPGPQPAANPVDNSHILLGQQQPSMPEPVSPLRYGRVSAVSGASSAGAMGRSISLREGEMRHNHSLNGGRHNASAIGLNSNPAAFDEREANESQDLDESDGNVENGGGGGNPPEPAENNPEDEHLISDDMVVQILSHFVRYLPLIFILFFKFLHDHLLGIVDLLVLQTVMYNVNRSVRNQVARLAQKNYAVMVRDTFLVAVVVTVRLFLATSPPDPFGLIVPPSRKSVFIEVTALPFHTSSEGDSPTTSSEPIKTNMYKDTYKSLNVIPLGMLLYYIAVSDLIIKLLTMLVKLIITMLPHHLMRLKVRARLYVLVEYISQFYRAMTPITQWLLFLYESYSGLEVVSGGLFSAMYLGAKIFELVERGKSLKKAIVTFRKNIDSERPPTKDELDAAGALCPICHDAFNTPTVLECGHIFCDECVQTWFKREQTCPMCRAKVSDDPAWQDGSTTFFHQLY

SEQ ID NO: 15060 - protein, 237 aa, Lycopodium annotinum
MGRGKIEIKRIENATCRQVTFSKRRSGLLKKAHELSVLCDAQVAVIIFSSTGKLFQFASTRMKEILERYERNSDPLQIDAVIPRDLEYWSREAAKAKDELDRCHQKNRHMLGEDLSALNLNELEELEQQLDSGLRRVRCRKDQVLRDRIEELTKQESFLREENRMLRSKIAVPKESTEPILDEMNMETREPPSMAIVEEELSLKLNSKTWPDIHFSLQLGQYQPPRTETPTANHRPN

SEQ ID NO: 15061 - protein, 234 aa, Lycopodium annotinum
MGRGKIEIKRIENSTSRQVTFSKRRGGLLKKAHELAVLCDAQVALIIFSNTGKLFEYASTSMKEILDRYRKYPDGIQTGRVMEYDNDVMVQHWSREVMRMKQQIERSYQTQRHMMGEDLGLLPLKELQHLEQQLDTGLNRVRARKDQVLREQIDSLRIKELQWHEENEILRRKIAGAHGMTEVAVRSFSSQNIVNPLETREPPSIGQVSVPFSLHVNQKNLRENQNLQTSLQLG

SEQ ID NO: 15062 - protein, 186 aa, Bacillus anthracis str. A2012
MERELALEIVRVTEAAALASAQWMGRGKKNEADDAATTAMRDMFDSVNMAGTVVIGEGELDEAPMLYIGEELGTGNGPEVDIAVDPLEGTNIVAKGLANAMAVIAIADKGNLLHAPDMYMEKIAVGPKAAGKISLDDPIEKTIEIVAEANNKKIRDLTVIVQERERHQDIIDRVRAKGARVKLFGD

SEQ ID NO: 15063 - protein, 108 aa, Bacillus anthracis str. A2012
  unsure (1)..(108): unsure at all Xaa locations
ISAAALKCLKGEMQARXXPMNEEEEARCREMGLEDPRQLLMLDDLVSGDDAIFSATGVSAGELLDGVKFLGGDLAETYSIVMRYKTRTVRFIKTHHHLDHKPHLNLDI

SEQ ID NO: 15064 - protein, 262 aa, Bacillus anthracis str. A2012
MVRLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 15065 - protein, 431 aa, Bacillus anthracis str. A2012
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 15066 - protein, 505 aa, Bacillus anthracis str. A2012
MRKLTKTFIVSLTLCIAFTLWGIIPESIIGKGSLGNVTTAIQTALVSKFGWSYIISVSIILGVSIFLIVSKYGSIRLGKDDDEPDYSYMTWFAMLFSAGMGIGLVFWGVAEPLNHLYAPPFGESATEESARLALRFSFFHWGLHPWGLYAFVALCIAYFTFRKGKASTISATVGPLFKGGDHGRIAHLFDVLAVFATVFGVATSLGLGAKQIAGGVSYLTSIPNSLTTQLVIIAIVTVLFMLSAQTGLDKGIKYLSNTNIILAFALMIIVLFVGPTNFIMNYFTSTIGAYIQELPSMSFRLSPLDEGGNQWIQSWTIFYWAWWIAWSPFVGTFIARVSRGRTIREFVIGVLLVPTVIGALWFSVFGGTGIHMELFGDAHIFEKVKEMGTEVGLFAMFDQMGSFGSALSVLAILLISTFFITSADSATFVLGMLTTHGSLNPPNRIKMIWGIVLAALASILLYVGGLEALQTAAIIAAFPFVFVIFFMMAALFKELQKEGRMKRHK

SEQ ID NO: 15067 - protein, 217 aa, Bacillus anthracis str. A2012
  unsure (1)..(217): unsure at all Xaa locations
MERSLSMELVRVTEAAALSSARWMGRGKKDEADGAATSAMRDVFDTIPMKGTVVIGEGEMDEAPMLYIGEKLGTGYGPRVDVAVDPLEGTNIVAAGGWNALAVIAIADHGNLLHAPDMYMDKIAVGPEAVGAVDIDAPIIDNLRAVAKAKNKDIEDVVATVLNRPRHQAIIEEIRKAGARIKLINDGDVAGAINTAFDRTGVDILFGXGGAXEGVLA

SEQ ID NO: 15068 - protein, 522 aa, Bacillus anthracis str. A2012
MRMKSRKTDWPVFLISGGSLLLFVIAVFLNKSYVEGVINSSFAASIKYFGAFWQILLIGTFVVAMCMAFSKYGRVKLGGLEKPEISTTKWLAIIMSTLLAGGGVFWAAAEPMYHLMTVPPIHEGITAGTKEAVMPALAQSYMHWGFLAWTILGTISAVVMMYGHYHKGMPLKPRTLLYPIFGEKLRKSWLGTLIDAFAIIAVAAGTIGPIGFLGLQASYGLQALFNIPDVFTTQLAIIVCVVAVSTISAVTGIDKGIQIISNLNVRLAILLMVFVLLFGPGGFIIDSFVSSFGFYINEFIPMSTYRGDTTWLGSWTIFFWGWFIGYGPMMAILVSRISRGRTIREIIVAIGIIAPIITTFWFTILGGSGVFYELMKPGSISSALSESGMPAAMIAITEQLPLSHIIGPAFLLLTILFVVTTGDSMAYSISMAVTGDGDPRISLRVFWSLIMGTVAAILLYMGEGSINALQSFIVVTAVPVSILLFPMLWLAPKVAGELALKQGIVKEEEKTSFLFQKASKSK

SEQ ID NO: 15069 - protein, 327 aa, Bacillus anthracis str. A2012
MGNVFDYEDIQLIPAKCIVNSRSECDTTVTLGKHKFKLPVVPANMQTIIDERIATYLAENNYFYIMHRFQPEKRISFIRDMQSRGLIASISVGVKEDEYEFVQQLAAEHLTPEYITIDIAHGHSNAVINMIQHIKKHLPESFVIAGNVGTPEAVRELENAGADATKVGIGPGKVCITKIKTGFGTGGWQLAALRWCAKAASKPIIADGGIRTNGDVAKSIRFGATMVMIGSLFAGHEESPGETIEKDGKLYKEYFGSASEFQKGEKKNVEGKKMFVEHKGSLEDTLIEMEQDLQSSISYAGGTKLDSIRTVDYVVVKNSIFNGDKVY

SEQ ID NO: 15070 - protein, 487 aa, Bacillus anthracis str. A2012
MWESKFVKEGLTFDDVLLVPAKSDVLPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLSEAEKILQKYKIEKLPLVDNNGVLQGLITIKDIEKVIEFPNSAKDKQGRLLVGAAVGVTADAMTRIDALVKASVDAIVLDTAHGHSQGVIDKVKEVRAKYPSLNIIAGNVATAEATKALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLLESHPHHVQITKEAPNYSL

SEQ ID NO: 15071 - protein, 166 aa, Bacillus anthracis str. A2012
MERDQDIYFMQLAIEEAKKAEAIQEVPIGAVIVLNGEVISAAHNLRETEQRSIAHAELLAIDEACKKLGTWRLEDATLYVTLEPCPMCAGGIVLSRVKRVVYGAGDPKGGCAGTLMNLLTDERFNHQCEVVAGVLEEECGTLLTNFFRELRKKRKAIKKLEKSNEN

SEQ ID NO: 15072 - protein, 221 aa, Bacillus anthracis str. A2012
MFKRLREDIEVVFEQDPAARSYFEVILTYSGLHAVWAHRIAHAFYKKNFFFIARWISQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKVMEVELDKLKKQLEVKVERKDKNDYSHL

SEQ ID NO: 15073 - protein, 354 aa, Bacillus anthracis str. A2012
  unsure (1)..(354): unsure at all Xaa locations
MVMKEQVVEALEGIVDPFLHKTLKETGAIKEVTVKPEKKHVSVKIAIVKTGTAEQMQLQSGIVKLVKELGAATVGLRFAEFTEEELAQFAPEQEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVXBLPPGTGDVALDLHSMLPXCKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTAFAQK

SEQ ID NO: 15074 - protein, 277 aa, Bacillus anthracis str. A2012
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSSDDMKAIQALNEDHRVGPDPDNFNF

SEQ ID NO: 15075 - protein, 516 aa, Bacillus anthracis str. A2012
MIKKENSVFYISILLTTLFIIWGITPASWIQGYDLQSVTSSLNSFILNKFGWFYSLLMTAMIILATYLAFSKYGSIRLGKDGEKPKYSYPSWLSMLFGAGMGIGLLFYGIAEPISHFTDPLTGKAGTEESAKLAMQYSFFHWGLFPWALYAMVALTIAYFTFRKQKGSTIGATVTPLFNRSKNSPIGKTVDILAVLATVFGIVPSVGIGAQQIAGGLSYLFPSIHNTLLTQLVLIAIFAVLYLTSAQTGLDRGIKYLSNLNFSLTGILLVSFLLLGPTVFIMKYFTSTLGSYIGALPSMGLNLGAFNEKSSSWIENWTIFYWGWWISWSPFVGTFIARISKGRTIKEFIFGVVLVPTLICTFWFAVFGGTAIHMEMFQSLGVADEIAKNGTEIGLFAVISHLPFSTFLTIIGLILVATFFVTSADSATFVVSMQTSNGSLSPKNSLKLIWGLTIAIIAAILLQAGGLNALQIAAIIAALPFSIVVVLMVTSLFKELRKEDINSQTKEVPKKIKKVM

SEQ ID NO: 15076 - protein, 463 aa, Bacillus anthracis str. A2012
MKRISIQFGFYFLIVTLLIESVLFVLLYYSLVNTRVNEEMTALLKRGNSHRDVLEKYYDEQTISHVALMESEAETTVVITNTNKEVLAKSNKINTTIKNHISSMQTRTNHDGAIIENHWKTSNYICTVSPIIVAGKHEGYVYMFLGTESIEKLVNGLTKQFIIAGAITFLLTVITIFLLSRLLTKPLLHMKHATEKMSKGDLSVSLTTTRNDEIGELSSSIQTLANDLHYMKTERSEFLASVAHELRTPLTYVRGYADIALKETTSPEQRLRYLSIIKDESDYITNLVQDLFSLAQMEQHNFSIQVKEVHLHTFLTRISEKVNAMYKERYITVSFSCPPTLLVNLDEQRFEQVVVNILNNAYRHSKEHSQIHISVIEENKRISITMEDEGEGIPPEDLPHIFERFYRVDKARSRATGGTGLGLSIVKEIVELHGGNITVTSEVDHGSCFTISLPSIKKHDYHQ

SEQ ID NO: 15077 - protein, 896 aa, Bacillus anthracis str. A2012
MKSKAKFSIRYKIMAGYLVIILFLLISFIMLNNQISNLQKSRNFIIDHDFKVLNLTNQVEKDLLTIENKAKGFITSNNANYLQSLNSAERDYEKHYHDLFSLLEDNPSQQEKLKEINGNITNWMNKEIHPLIANHNSNKIQEIDTTEIQSLQSQLTDFRSTEEQLTKKRAAQLDTKNNKLELWLYSLLFLLSCISIIVSLYISNSITKTIKNVIQAIKSISSKEKITERIHVNTHDEIKDLAHTTNHLLDEISKREWLQTEIAELILMYQGVSSIEMLGNKILSGIIQKTQTSCGAFYVREEYEETVYYVKKASFADQGFDIGKQSIKMGEGFIGQSALEKKSFILRDIPEEFRYVTTGLLEIRPKNLLVIPVLFEDEVIAVMELVSVTDISDLHQDLIQQTVDNLGLTIHSIMGRMRIQTLLHESQAMTEELQVQSEELQTQAEELQMQAEELRTTNEQLESRTEEAEQKTADLQITKLELEEKASELLRSSKYKSEFLANMSHELRTPLNSILLLSEMLKENHDNHLSDDEIELATVIHSSGKDLLTLINDILDLSKVEAGKLDVIFEATNISDMAASMHQNFLHIAAQKNVEFTVEDSDTIPDLFYTDAKRIEQIIKNLLSNAFKFTEKGSVSLHFDSIETSNLSHDMQSISKDWITISVKDTGIGIAKEQHQLIFEAFQQADGATIRKYGGTGLGLSICKEFARLLGGWITLESHVGEGSTFTVYIPNLPNGLHDVQLSNLEVAATVDEVIPAEVIEETIVLPEANNVFQEKTIMIVDDDHRNIFALQNALKKQHANIITAQNGLECLEILKNNTNIDLILMDIMMPNMDGYETMEHIRMNLGLHEIPIIALTAKAMPNDKEKCLSAGASDYISKPLNLHQLYSVMSVWLIK

SEQ ID NO: 15078 - protein, 247 aa, Bacillus anthracis str. A2012
MVQLNGKVAIVTGGAKGIGKAITVALAQEGAKVVINYNSSKEAAENLVNELGKEGHDVYAVQADVSKVEDANRLVEEAVNHFGKVDILVNNAGITRDRTFKKLNREDWERVIDVNLSSVFNTTSAVLPYITEAEEGRIISISSIIGQAGGFGQTNYSAAKAGMLGFTKSLALELAKTNVTVNAICPGFIDTEMVAEVPEEVRQKIVAKIPKKRFGQADEIAKGVVYLCRDGAYITGQQLNINGGLYM

SEQ ID NO: 15079 - protein, 453 aa, Bacillus anthracis str. A2012
MKETNSFSQKLKQFVLLFFPIFVTQMSLFAMSFFDTTMSGHASPIDLAGVAIGTSIWIPVSTGLTGILMATTPIVAQLVGSKKKEDVPHVIIQAVYLAICASFVVILIGLFTVTPILNGMRLEEPVERIAAQFLSIIAIGIIPLFTYTVLRGFIDALGKTRTTMIITLLSLPINVVLNYVLIFGNFGFPKLGGVGAAIASAATYWCILIITVMIIRTKEPFASFNIFKQLYRPSLSSWKEFLKLGVPIGFAIFFETSIFAAVTLMMSNFSTTTIAAHQAAMNFASLLYMTPLSLAMAMTIAVGFEVGAKRYNNAKQYGFIGIGLALAFALLYSILLYFFDDEIASIYTTDIQVHHLAKEFLIFAILFQISDAIATPVQGALRGYKDVNVALIMTLIAYWVIGLPLGYILATYTDWAAKGYWIGLIIGLAFGATFLLIRLFQVQRKYTTQNSRS

SEQ ID NO: 15080 - protein, 438 aa, Bacillus anthracis str. A2012
  unsure (1)..(438): unsure at all Xaa locations
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKXEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEEVRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEETVSIAGKCCESGDMLIWDITLPKVASADLLAISCTGAYGYSMANNYNRIRRPAVVFVKGGTSQIVVERETYENIIGNDRIRIKELV

SEQ ID NO: 15081 - protein, 402 aa, Bacillus anthracis str. A2012
MLSEKTIEIVKSTVPLLQEKGVEITTRFYEILFSEHPELLNIFNHTNQKKGRQQQALANAVYAAATYIDNLEAIIPVVKQIGHKHRSLGIKAEHYPIVGTCLLRAIKEVAGAPDEVLNAWGEAYGVIADAFISIEAEMYEEAAHKEGGWKDFRNFVVVKKVKESDVITSLYLKPEDGGKVSSFIPGQYVTVQINIEGETYTHNRQYSLSDAPGKEYYRISVKKEKGVDTPDGKVSNYLHDHVKEGDMLPVSAPAGDFVLNMDSTLPVVLISGGVGITPMMSMLNTLIEQDSKRNVCFVHAAINSNTHAMKEHVEAVDNEYEQVKAYTCYSAPTEKDLEMKNFDKEGFVEREWLQTIIPTTEAEFYFCGPVPFMKHINAVLTDLGVKQEHIHYEFFGPAASLQ

SEQ ID NO: 15082 - protein, 301 aa, Bacillus anthracis str. A2012
MKKDWIAPLALLFVSFIWGATFVVVQNAMSFVGPFTFNGIRFLFAGIILLFVQILFSKKASKQHIKQSSLAGLIVGFFLCIGYVLQTFGLLYTTSSKAGFLTGLSIVMVPILSFIFLKQKATIFIVIGIAVATAGLYLLTAGDSFQLNIGDILVLGCAVAFAAHILVNGFFSKKISPLLLSTSQVLAVGLFSSICAFLFEDWEKLFSVALWTNSSFLFALFLTSLFATSIAFFIQTSAQKHTSPTRVAIIFAMEPVFAALTGVLVANEQLSISAIIGCLCIFLGMVFVELPSKTKKEAQAA

SEQ ID NO: 15083 - protein, 551 aa, Bacillus anthracis str. A2012
MMRYILTAVTVSVIFLIAACSVTTNTTNDHKNRNDKKTKQTETATKPLEIVKGPEVTLIAKEEKQKLSNGVIVPVWTFNGSSPGPEIRVKKGEKVKVTLKNELSAPVSIHWHGYPVPNDMDGIPGVTQDAVEPGKSFTYEFEANVLGTYWYHSHQDSVNQLDRGLYGTFVVEDTNEKYDKDYTLMLDEWITDKEEMNKQLKEMTKGKTEKADGNKSSKGNENTKKNDDKNSMDHSGMDMDSDKKDSGNMAGMDHGNMKMEGHDMSMYDLFTINGKSGDLVAPLKVNKGDKVRLRLVNAGYLSHNIHVHGHDIKVIATDGQPINDPKVIKDKVISIAPGERYDVEFTANNPGKWYVEDHSENKGAKGMKAIIEYDGSKEMKDIADEKEKLSKLDMTKYGAKKLGGFTLNQQYTATYNMDLNTQMNGNEMVYTINGKVFPDIDPVQVKKDDLVKVKLVNRSKMDDHPMHLHGHFFQVLSKGGKPVEGSPIVKDTLNLKPGEEYEVAFVADNPGEWMFHCHDLHHASAGMVTEVKYKDYKSDYVPNPNIPNKPE

SEQ ID NO: 15084 - protein, 301 aa, Bacillus anthracis str. A2012
MTQLSRTKTAIILTFLVFMWGINWPLSKFALHYTPPVLFAGVRTLIGGFILLLFALPKYKELHLKETWHLYVISSLLNIIIFYGLQTVGLQYMPAGLFSAIVFLQPVLLGIFSWIWLEESMYGLKIFGLILGFIGVGVISSSSLTGHISIIGILLAIGCAIGWALGTVFIKKTGHRVNSIWMVTLQLIIGGLCLIGFGSEFESWSSIAWSMPFVSVLLFISFFVIAMGWLAYFTLVGAGEASKVGAYTFLIPLIAIIVSSIFLHEAITISLFIGLLFIVVSICFVNIKPKTLAVGQRVEVK

SEQ ID NO: 15085 - protein, 283 aa, Bacillus anthracis str. A2012
MKIKSLKLYDTGYCTHPEKIAYSKGSWKQICFPATVGLLQHPELGYILFDTGYAEHFKEATKKFPYSVYAKLTPVHFTEEQSIKQQLLLDGIQPEEIKYIILSHFHGNHTAGLPDFPKAKILTFAKAYEDIKKRSKFGALLKGCLKDTLPVDLEQRMSFIDQTPSLNLPSTYGKFEEGYDVFDDGSLFAVDLTGHATGQFGIFVHLQSNKIVFLCADAVWLSKTYQNLFFPSKVANLLTSDPKSYRKNIEKLYHLSQTSPEIEIVPTHCEHTWDKIKAGVYYE

SEQ ID NO: 15086 - protein, 445 aa, Bacillus anthracis str. A2012
  unsure (1)..(445): unsure at all Xaa locations
MKSSIDSIQESKRLKNQQKEEKATWKAMSMFLVPLLLSNILQSVGQLFGMVVVGRWLGVNELAAISAFFPLFFLLVSFVIGIGSGSSILIGQAFGAHNEERLKAIVGTTLTFTFIIGVILAIVGNVFALNIMRLMGTPENIIDMSVHYARILFISMPVLFLYFSYTTFIRGTGDSKTPFYFLIVSTVLNIMLLPILIFGWVGIPKIGVYGAAYASVISTIITFIVMIIYLKKKNHPLQLDETVRKYLRMDWGLLKLLLRLGIPASINMILVSLSEIAVIAFVNRFGSDATAAYVVVNQVASYVQMPAVSLGITVSIFAAQSIGAKQFNRLQEVIRAGIVMNYIIGGILIAFIYLFSREILSLFLTSSNTIEIAHSLVMITLWSYLIFGHAQIIGATMRASGTVLWPTIIGVVSIWLVEVPVAYYLSYHTNLGIKGIWIGYPAAXL

SEQ ID NO: 15087 - protein, 217 aa, Bacillus anthracis str. A2012
ELSKAKKDIAIANKETLVAAGHIVTELAKQNGCRLIPVDSEHSAIFQCLNGENNKEIDKLIVTASGGAFRDKTREEMKTLQAKDALKHPNWLMGAKLTIDSATLMNKGFEVMEARWLFDIPYEKINVMIHKESIIHSLVEFIDGSVIAQLGAPDMRMPIQYAFHYPTRLPSSYEKLNLLEIGSLHFEKPDLEKFPCLQYAYECGKIGGITPAVLTQQ

SEQ ID NO: 15088 - protein, 279 aa, Bacillus anthracis str. A2012
MKNLQSTTKLHNGVEMPWFGLGVFKVEEGPELVEAIKSAIKTGYRSIDTAAIYGNEAAVGEGIRAGIEATGISREELFITSKVWNADQGYKETIAAYEESLKKLQLDYLDLYLVHWPVEGKYKDTWRALETLYKEKRVRAIGVSNFQIHHLQDVIQDAEIKPMINQVEYHPRLTQKELQAFCKEQGIQMEAWSPLMQGQLLDNETLQAIAEKHGKTTAQVILRWDLQNGVITIPKSTKEHRIIANADVFNFELTKEDMEKIDALNENHRVGPDPDNFDF

SEQ ID NO: 15089 - protein, 250 aa, Bacillus anthracis str. A2012
MTVKKLYFIPAGRCMLDHSSVNSTIAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSILLTIDASYTKENFEDEVPFAGFDPELALSSIKRLKEVVAKEKPIIFFGHDIEQEKGCKVFPEYI

SEQ ID NO: 15090 - protein, 246 aa, Bacillus anthracis str. A2012
  unsure (1)..(246): unsure at all Xaa locations
MEFLNGKTAVVTGAAQXIGKEIARVYAKLGAKVLISDVNEEKLQKTTRELLDEGYEVSLYRCDVSNQNEAKSLIEYAVQKFGTLHILVNNAGITRDAMLHKMEKSSWEXVLQVNLTGVFYCMQPALLYMRQQGYGRIINISSISREGNIGQANYAATKAGVVGLTKTAAKEVGSFGITCNAICPGFMDTDTTKTIPDKVKEKMVGAIPVGRIGTPEDIANAAAFLASEYASYITGEVLNVSGGLQV

SEQ ID NO: 15091 - protein, 349 aa, Bacillus anthracis str. A2012
MLTQEQIMNALKHVEDPELHKSIVELNMVRNIQMNGTEVKLEVVLTIQGCPLKAKIQQDIEESLYAIGASKVDLTFGSMTKEERADLTEKLKKNTRTETGMPNMLRPDSGVQFLTVTSGKGGVGKSTVTINLATALARMGKKVGILDADIYGFSIPAMMETNQKPTMIDQTAIPVVSHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYFEEQDGSKNYLFGKGGGEMLAEQLQTEVIAQVPFAKREENNGSSVYDEDSLVGEVFTSLAEDIIYKG

SEQ ID NO: 15092 - protein, 237 aa, Bacillus anthracis str. A2012
MKKYALVTGGSGGIGSAISKQLIQDGYTVYVHYNNSEEKVNELQKEWGEVIPVQANLASSDGAEQLWEQIEHPLDAIIYAAGKSIFGLVTDVTNDELNDMVELQVKSIYKLLSMALPSMIQRRSGNIVLVSSIWGQIGASCEVLYSMVKGAQNSYVKALAKEVSLSGIRVNAVAPGAIETEMLNVFSEEDKNEIAEEIPLGRLGLPEEVAKTVSFLVSPGASYITGQIIGVNGGWHC

SEQ ID NO: 15093 - protein, 380 aa, Bacillus anthracis str. A2012
MKNISLLGASGSIGTQTLDVLRSHPDQFRLVAFSVGKNIDYAVKVIQEFSPQIVSVQREEDVLKLQAVSGNTKIVYGSEGLLEVALHPDAEIVVNAVVGSVGLLPTLRAIEAKKTIGIANKETLVTAGHLVMEAARKHNVSLLPVDSEHSAIFQCLNGENEKRISRLIITASGGSFRDKTRDELHHVTVEDALRHPNWSMGSKITIDSATMMNKGLEVIEAHWLFGIPYEQIDVVLHKESIIHSMVEFEDRSVMAQLGSPDMRVPIQYALTYPDRLPLSDTKQLNLWEIGTLHFEKMNQERFRCLRFAYEAGKAGGSMPAVMNAANEVAVEAFLQKRIGFLTVEDLIEKAMNHHNVIARPSLEEILEIDAATRRFVMEQI

SEQ ID NO: 15094 - protein, 246 aa, Bacillus anthracis str. A2012
MLKGKVALVTGASRGIGRAIAIDLAKQGANVVVNYAGNEQKANEVVDEIKKLGSDAIAVRADVANAEDVTNMVKQTVDVFGQVDILVNNAGVTKDNLLMRMKEEEWDTVINTNLKGVFLCTKAVSRFMMRQRHGRIVNIASVVGVTGNPGQANYVAAKAGVIGLTKTSAKELASRNITVNAIAPGFIATDMTDVLDENIKAEMLKLIPAAQFGEAQDIANAVTFFASDQSKYITGQTLNVDGGMVM

SEQ ID NO: 15095 - protein, 401 aa, Bacillus anthracis str. A2012
MLKGKKILLCVTGGIAVFKAAALTSKLTQAGAIVKVMMSESAVKFVTPLTFQALSRHDVYTDTFDEKDSAVIAHIDLADWADVVLVAPATANCIGKLANGIADDMITTTLLATTAPVWIAPAMNVHMYENKIVQKNMMTLKTLGYTFIEPGEGFLACGYVAKGRLEEPEAIIARLEEAFSEQKPLQGKRILITAGPTREKIDPVRFMTNFSSGKMGYAIAEVAVNLGAEVILVSGPTALNPPLHVTTVQVESAQDMLEAVIQHYQNVDVVIKTAAVADYRPKYVHDNKMKKKNGDAVIELERTVDILKTLGEMKDKQLLIGFAAETTNVEEYATKKLREKNANMIVANDVKAQGAGFGTDTNIVTMYRKDGEVIELPLLTKKEVAREILKQIEMMLEDDRL

SEQ ID NO: 15096 - protein, 240 aa, Bacillus anthracis str. A2012
MKMMDANEIISFIQKSEKKTPVKVYIKGDLKEVTFPETVQAFVNKKSGVLFGEWSEIKTILDENSKYIVDYVVENDRRNSAIPMLDLKGIKARIEPGAIIRDHVEIGDNAVIMMNATINIGAVIGEGSMIDMNAVLGGRATVGKNCHVGAGAVLAGVIEPPSAKPVIVEDDVVIGANVVVLEGVTVGKGAVVAAGAVVTEDVPPYTVVAGTPARVIKEIDEKTKAKTEIKQELRQLNPEK

SEQ ID NO: 15097 - protein, 219 aa, Bacillus anthracis str. A2012
MSIQVFCDFDGTITNNDNIMSIMEKFAPPEAEEVKNRILSQELSIQEGVSQLFQLIPTNLHDEIIQFLIETAEIRNGFHEFIQFVNENNISFYVISGGMDFFVYPLLQGLIPKEQIYCNETDFSNEYITVNWPHPCDRLCQNHCGLCKSSLIRKLSDTNDFHIVIGDSITDLQAAKQADKVFARDFLITKCEENHISYTPFETFHDVKTELKHLLEVKL

SEQ ID NO: 15098 - protein, 570 aa, Bacillus anthracis str. A2012
MTLNIQGIAASSGIAIAKAFRLENPEFNIEQKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTNSEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTLNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEVGTTVSDSIEVGMMVEIPASAVLADQFAKEVDFFSIGTNDLIQYTMAADRMNEQVSYLYQPYNLSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 15099 - protein, 252 aa, Bacillus anthracis str. A2012
MDIEVKNEKKKPQLKDHELKALIQKSQDGDQQARDTIVQSNMRLVWSVVQRFLNRGYEPDDLFQIGCIGLLKSVDKFDLSFDVKFSTYAVPMIIGEIQRFLRDDGSVKVSRSLKETGNKIRKMRDELSKEFGRAPTINEVAEALELTPEEVVLAQEASRAPSSIHETVYENDGDPITILDQIADQSETKWFDKIALKEAIRELDERERLIVYLRYYKDQTQSEVAERIGISQVQVSRLEKKILKQMKDRIDE

SEQ ID NO: 15100 - protein, 275 aa, Bacillus anthracis str. A2012
MHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 15101 - protein, 327 aa, Bacillus anthracis str. A2012
MAVMSYIDAITLAMREEMERDEKVFVLGEDVGKKGGVFKATHGLYDQFGEDRALDTPLAESAIAGVAIGAAMYGMRPIAEMQFADFIMPAVNQIVSEAAKIRYRSNNDWTCPITVRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 15102 - protein, 630 aa, Bacillus anthracis str. A2012
  unsure (1)..(630): unsure at all Xaa locations
MDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVIMMPKDENEGQHLVYTAMQYEDGPIAXRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 15103 - protein, 373 aa, Bacillus anthracis str. A2012
MADKPARSKQIETEMTLEQVKEQLTELGKKRGVLTYEEIAERMNGFEIESDQMDEYYEYLGEQGIDLVGDNDEGPNNHQITKTEEEFDLNDLSVPPGVKINDPVRMYLKEIGRVDLLSAEEEIRLATRIEEGDEEAKRRLAEANLRLVVSIAKRYVGRGMLFLDLIQEGNMGLIKAVEKFDYRKGFKFSTYATWWIRQAITRAIADQARTIRIPVHMVETINKLIRVQRQLLQDLGREPSPEEIGEEMDLAPEKVREILKIAQEPVSLETPIGEEDDSHLGDFIEDQEATSPADHAAYELLKEQLEDVLDTLTDREENVLRLRFGLDDGRTRTLEEVGKVFGVTRERIRQIEAKALRKLRHPSRSKRLKDFLE

SEQ ID NO: 15104 - protein, 587 aa, Bacillus anthracis str. A2012
MNKFRSRLLFTFVSLIVFILVGLGLLLETVFENYYIDHAKERMVKETEYVAVLAEEQGFDDVLKNPYVFEKLEEKIQASIAFVDEKKKVQYSGGEQSAFSQGIMKELSSETKKQRNKVITKEADQNNEFYHAVFVQDVTGKQGYILVKSTIEPLKDVHQKTWGLLIIGFVIACLVVVFLGMKITGQYIRPIESVTKVAIELAKGNYKARAYESHSDETGMLSKAINILARNLQEMTLEQEMQQDRLHTLIENMGSGMILIDSRGYINLVNRSYKETFHVTDEEYLDRLYYESFHHTEIIELVEEIFMTEVKVRKQMLLPLGIERKHFEVYGAPIIGTNHEWKGIVLVFHDITELKKLEQMRKDFLANVSHELKTPITSIKGFSETLLDGAMDNKKFCEHFLHIILKESERMQGLIEDLLDLSKIEQQGFKLSMGTVDMKGLLEDIHMVLDNKAGEKEISLQVNTLKRVSVIGDPSRLQQIFINLMNNAIVYTPAGGVVSVELAEDKYNAYIKVSDTGIGISKDEIPRIFERFYRVDKARSRNTGGTGLGLSIVKHLVEAHHGTITVDSEVGEGTTFTVVLPKSATEK

SEQ ID NO: 15105 - protein, 261 aa, Bacillus anthracis str. A2012
MYSDLAGKVVVITGSATGLGRAMGVRFAKEKAKVVINYRSRESEAHDVLEEIKKVGGEAIAVKGDVTVESDVVNLIQSAVKEFGTLDVMINNAGIENAVPSHEMPLEDWNKVINTNLTGAFLGSREAIKYFVEHDIKGSIINMSSVHEKIPWPLFVHYAASKGGVKLMTETLAMEYAPKGIRVNNIGPGAINTPINAEKFADPKKRADVESMIPMGYIGKPEEIAAVATWLASSEASYVTGITLFADGGMTLYPSFQAGRG

SEQ ID NO: 15106 - protein, 359 aa, Xenopus laevis
MTLESIMACCLSEEAEEARRINDEIERQLRRDKRDARRELKLLLLGTGESGKSTFIKQMRIIHGSGYSDEDKRGFTKLVYQNIFSAMQAMIRAMETLKIPYKYEHNKGHALLVREVDVEKVASFENPYVDAIKYLWNDPGIQECYDRRREYQLSDSTKYYLNDLDRIATHGYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 15107 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVFGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIHDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTGHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 15108 - protein, 572 aa, Rattus norvegicus
MEGERAPLLGSRRAAAAAGVFAGRRAACGAVLLAELLERAAFYGVTANLVLFLNGAPFNWEGAQASQALLLFMGLTYLGSPFGGWLADARLGRARAILLSLALYLLGMLAFPLLAAPRSRSFLCGDPHPELVRNCSAPFPNGTAVCPDAAARRCAPATFAGLVLVGLGVATVKANITPFGADQVKDRGPEATRRFFNWFYWSINLGAILSLGGIAYIQQNVSFLTGYLIPTVCVAIAFLVFLCGQSVFITKPPDGSAFTDMFRILTYSCCSQRGGQRRSGEGLGVFQQSSKHSLFDSCKMSRGGPFTEDKVEDVKALVKIVPVFLALIPYWTVYFQMQTTYVLQSLHLKIPEISSITTTHHTLPAAWLTMFDAVLILLLIPLKDKLVDPVLRRHGLLPSSLKRIAVGMFFVTCSAFAAGILESKRLDLVKEKTINQTIGGVVYHAADLPIWWQIPQYVLIGISEIFASIAGLEFAYSAAPKSMQSAIMGLFFFFSGIGSFVGSGLLALVSLKAIGWMSSHTDFGNINSCHLHYYFFLLAAIQGATLLLFLIVSVKYDRQRARTDGGTASTRT

SEQ ID NO: 15109 - protein, 751 aa, Rattus norvegicus
MIPPAGSTPPGEALIPSVAPQDFWRSPISGYSGSVTRHISHRANNFKRHPKRRKYIRPSPPPPPNTPCPIELVDFEDLHPQRSFWELLFNGCILFGIEFSYAMETAYVTPVLLQMGLPDQLYSLVWFISPILGFLLQPLLGAWSDRCTSRFGRRRPFILVLAIGALLGLSLLLNGRDIGMALADTATNHKWGILLTVCGVVLMDFSADSADNPSHAYMMDVCGPVDQDRGLNIHALMAGLGGGFGYVVGGIHWDKTSFGRALGGQLRVIYIFTAITLSVTTVFTLVSIPERPLRPLGEKRTAMKSPSLPLPPSPPVLLEEGAGDTLPSTTATSLYASFSSPISPPSPLTPKYGSFISRDSSLTGINEFASSFGTSNIDSVLIDCFTAGHDNYLALPSSVPRQAISVSFPRAPDGFYCQERGLERREGPLTLGLDGDVLRVGSLDTSKPRASGILKRPQTLALPDVAGGNGPETSRRRNVTFSQQVANILLNGVKYESELTGSSEQSEQPLSLRRLCSTIYNMPRPVRNLCVNHFLGWLSFEGMLLFYTDFMGEVVFQGDPKAPHASEAYQKYNSGVTMGCWGMCIYAFSAAFYSAILEKLEECLSVRTLYFIAYLLFGLGTGLATLSRNLYVVLSLCTHYGILFSTLCTLPYSLLCDYYQSKKFAGSSADGTRRGMGVDISLLSCQYFLAQILVSLVLGPLTSAVGSANGVMYFASLVSFLGCLYSSLCVTYEIPSADAADEERQPLLLNV

SEQ ID NO: 15110 - protein, 100 aa, Neisseria meningitidis
LDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 15111 - protein, 100 aa, Neisseria meningitidis
LDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15112 - protein, 105 aa, Neisseria meningitidis
VKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15113 - protein, 100 aa, Neisseria meningitidis
LDDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 15114 - protein, 101 aa, Neisseria meningitidis
KLDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 15115 - protein, 98 aa, Neisseria meningitidis
DVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 15116 - protein, 99 aa, Neisseria meningitidis
DDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 15117 - protein, 99 aa, Neisseria meningitidis
DDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15118 - protein, 99 aa, Neisseria meningitidis
DDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 15119 - protein, 108 aa, Neisseria meningitidis
EADVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15120 - protein, 101 aa, Neisseria meningitidis
KLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15121 - protein, 98 aa, Neisseria meningitidis
DVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 15122 - protein, 224 aa, Drosophila melanogaster
MAELICRKCDLPVSWESFRFQLNERTSDLIANPTLMPGVERLVTHLGRCCMGLGLITSCSESMYCTKIRDREDFFQNFSSVICADDADLKAPKPEPDVYLIAMRRLGDAGPDCTLVFDGTPKGVQAATDARLPVVMLAEKDLPCCWSELATLRLETLEEFDPAEFNMPPYSCTEPPPKKPKASSHRSSQKSAGSQRGSAALKKAAADSEADEGEEEEGEGQEVA

SEQ ID NO: 15123 - protein, 846 aa, Drosophila melanogaster
MPKFSENSWDASAGTGRSEGRQLHFDIKQDAITFEGTERKNSVSETTSTGLQILSIEDEIMSEVKANIDDANNASIESIAPEPVQVPAPPKVNPPPPPRPASPKVEPPPPAPPGVESPPGPQPPASPRFDPPPPHTIEPPPPPAPPTLVPPPPPAPPTIKPPPPPAPPTVEPPPPPPPAPPTVEPPPPPPPAPTKVEPPPPPAPAEVEPPPPPAPTELEPPPPPAPPKVELPPPPAPPKAEAAITPRRAKGSNGFITELAVTPKESETRDKPHNVNTDVKEDEQPATTEDKQDKPLELGLDAPKDAVSTASESTESPTSTSSQSKSHSKSRDKEKEKDRRHHRHSDDKHRRRSTDRDRDRSRDKSHSKHSSSSSSKHSSSNSSSSKHKSSSSKNDKSSSSSSSRSNRESSSSKRSGTTSSSRHESSSHKKHKSSSSSSRSERDKGKEKDKEREKDSQSRSHHSSSSSSSSSRRKDHDRGRDRDRNKSNTSGSAENKAIHDDHSESKEKYKQRRGSDSNDEGKPPSSGGPAKNSQPEDSAATMKSDAPVENANGTNGNSNGSTNGACDNVSGVVIVSDILQQSTSSFVELTAGSQSHDRAESSKHEPEDIDGKEADNQPEKTELEARQDECASQNEVPTVEPQTLADSVPDLPAKESMDTLEDEKVETNVEENKSEEESKPENPPEECVDEPAQVGDVEDPPQDADKPATPVPISNEQSDEFSADFVTHFEENTDEFRTRLQLINQLIEDRKNLLNRLSEDGTQEEAVDIRALRRSLSKRRRSSMQEQHRVERETTPPQPRSPSSSSTAGSPAKRLRQDEPKSSPTPSDASINSKENEALEKQEHAV

SEQ ID NO: 15124 - protein, 85 aa, Drosophila melanogaster
MHRKYMQGDFESCPNISCDRQNTLPVGLSDVWGKSTVKIYCPRCKKNFHPKSDTQLDGAMFGPSFPDIFFSLLPNLRSPLDDPRT

SEQ ID NO: 15125 - protein, 384 aa, Caenorhabditis elegans
MLRSQAKNVDLTSQADSRHQQKRKQAEQLDALKNPSEPAAKKQHSKGLTELRAHISGFKIDSAKRDPLGKSRTSRRDVENLPPQKSRYVDPCPHYDYDLEEAGNPDSISDYAQGIFDYYRHREVHFRVRKYLHKHPEVDVKTRAILIDWMVEIQETFELNHETLYNAVKLTDMYLCKTKNVDKNTIQKLACVAIFIAAKYDERSPPLVDDLIYLSGDRFSRDELLAMERELFATVGYDLGSPLSYRYLRRFGRVCRVDMKTLTMGRFILETSLMVYEYAMVSQSRLAAAAFVLAMRMLDKNNEYEWNPVLEKYSGFTGEEVMPLVEHMNHILHFSKDKWAQLTSVRQKYSHEVFFHVASIPMLPDTLKVVDSHTYAPVPMLSYP

SEQ ID NO: 15126 - protein, 432 aa, Mus musculus
MSDKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKYPQLLSGIRGISEETTTGVHNLYKMMSNGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYWLKNGRRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 15127 - protein, 441 aa, Mus sp.
REERDVLVKGDRRWITQLHFAFQDENYLYLVMEYYVGGDLLTLLSKFGERIPAEMARFYLAEIVMAIDSVHRLGYVHRDIKPDNILLDRCGHIRLADFGSCLKLQPDGMVRSLVAVGTPDYLSPEILQAVGGGPGAGSYGPECDWWALGVFAYEMFYGQTPFYADSTAETYAKIVHYREHLSLPLADTVVPEEAQDLIRGLLCPAEIRLGRGGAGDFQKHPFFFGLDWEGLRDSVPPFTPDFEGATDTCNFDVVEDRLTAMVSGGGETLSDMQEDMPLGVRLPFVGYSYCCMAFRDNQVPDPTPMELEALQLPVSDLQGLDLQPPVSPPDQVAEEADLVAVPAPVAEAETTVTLQQLQEALEEEVLTRQSLSRELEAIRTANQNFSSQLQEAEVRNRDLEAHVRQLQERMEMLQAPGAAGESLTCFQPRGHWVEMGGMLGV

SEQ ID NO: 15128 - protein, 516 aa, Mus sp.
REERDVLVKGDRRWITQLHFAFQDENYLYLVMEYYVGGDLLTLLSKFGERIPAEMARFYLAEIVMAIDSVHRLGYVHRDIKPDNILLDRCGHIRLADFGSCLKLQPDGMVRSLVAVGTPDYLSPEILQAVGGGPGAGSYGPECDWWALGVFAYEMFYGQTPFYADSTAETYAKIVHYREHLSLPLADTVVPEEAQDLIRGLLCPAEIRLGRGGAGDFQKHPFFFGLDWEGLRDSVPPFTPDFEGATDTCNFDVVEDRLTAMVSGGGETLSDMQEDMPLGVRLPFVGYSYCCMAFRDNQVPDPTPMELEALQLPVSDLQGLDLQPPVSPPDQVAEEADLVAVPAPVAEAETTVTLQQLQEALEEEVLTRQSLSRELEAIRTANQNFSSQLQEAEVRNRDLEAHVRQLQERMEMLQAPGAAAITGVPSPRATDPPSHMAPRPWLWASARWWGQAPCTAVTCCSLPGSLGLAYPRRVACSCSPLLWLLPPHWAALGWWPIPAVSPQSGVSREPPSPPEP

SEQ ID NO: 15129 - protein, 412 aa, Mus sp.
REERDVLVKGDRRWITQLHFAFQDENYLYLVMEYYVGGDLLTLLSKFGERIPAEMARFYLAEIVMAIDSVHRLGYVHRDIKPDNILLDRCGHIRLADFGSCLKLQPDGMVRSLVAVGTPDYLSPEILQAVGGGPGAGSYGPECDWWALGVFAYEMFYGQTPFYADSTAETYAKIVHYREHLSLPLADTVVPEEAQDLIRGLLCPAEIRLGRDFEGATDTCNFDVVEDRLTAMVSGGGETLSDMQEDMPLGVRLPFVGYSYCCMAFRDNQVPDPTPMELEALQLPVSDLQGLDLQPPVSPPDQVAEEADLVAVPAPVAEAETTVTLQQLQEALEEEVLTRQSLSRELEAIRTANQNFSSQLQEAEVRNRDLEAHVRQLQERMEMLQAPGAAGESLTCFQPRGHWVEMGGMLGV

SEQ ID NO: 15130 - protein, 474 aa, Mus sp.
REERDVLVKGDRRWITQLHFAFQDENYLYLVMEYYVGGDLLTLLSKFGERIPAEMARFYLAEIVMAIDSVHRLGYVHRDIKPDNILLDRCGHIRLADFGSCLKLQPDGMVRSLVAVGTPDYLSPEILQAVGGGPGAGSYGPECDWWALGVFAYEMFYGQTPFYADSTAETYAKIVHYREHLSLPLADTVVPEEAQDLIRGLLCPAEIRLGRGGAGDFQKHPFFFGLDWEGLRDSVPPFTPDFEGATDTCNFDVVEDRLTAMETLSDMQEDMPLGVRLPFVGYSYCCMAFRAEEADLVAVPAPVAEAETTVTLQQLQEALEEEVLTRQSLSRELEAIRTANQNFSSQLQEAEVRNRDLEAHVRQLQERMEMLQAPGAAAITGVPSPRATDPPSHMAPRPWLWASARWWGQAPCTAVTCCSLPGSLGLAYPRRVACSCSPLLWLLPPHWAALGWWPIPAVSPQSGVSREPPSPPEP

SEQ ID NO: 15131 - protein, 426 aa, Pennisetum glaucum
MDDHANSMEEIIIPDPFWEDLPPPPEPPLVVSDGFTDGVVTNGGGEGTGATDQNQSPSEWSFERLLEEELLIDATPLENFSGSAPHADTTVVDEVDRATTMVPAAVSTVGDPMEYNNILKRKLDEDLATVAMWRASSVVHLEHSQDSNNHIGGDKNFVQNMLSISDSPIKRVRNTYSRARLASSSSSRDPSPSDDDDMDGEVEILGFNMPTEEKMRKRKESNRESARRSRYRKAAHLKEMEDQVAQLKVENSSLLRRLATLNQKYTDATVDNRVLKANMETLRTKVNMAEDALKRITGTMSSSQPLSRPSPLVPAAANADASGHILDNIIIDYLMNSTDATIDHSFELRTTAPPAPAFSQAETPAVGTNSAMISRMAAHHAVAVELLHKRLGGGAMPPATTFSGVAPPETAALPSDVVESTDMGIH

SEQ ID NO: 15132 - protein, 188 aa, Rattus norvegicus
SWRVVSSIEQKTEGAEKKQQMAREYREKIETELRDICNDVLSLLEKFLIPNRSQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 15133 - protein, 185 aa, Forsythia x intermedia
SYPHKILTGRRDKMHTLRQTNGLSGFTKRSESDYDCFGAGHSSTTISAGLGMAVGRDLKGRKNNVVAVIGDGAMTAGQAYGAMNNAGYLDSDMIVILNDNKQVSLPTANLDGPIPPVGALSSALSRLQSNRPLRELREVAKGVTKQIGGPMHEIAAKVDEYARGMISGSGSTLFEELGLYYIGPV

SEQ ID NO: 15134 - protein, 170 aa, Forsythia x intermedia
ALAAGSNVTLLADQIKRFHPQLVAVRNESLVDELKEALADMKDKPEIIPGEQGTIEVARHPDAVTVVTGIVGCAGLKPTVAAIEAGKDIALANKETLIAGGPFVLPLAHKHKVKILPADSEHSAIFQCIQGLPEGALRRIILTASGGAFRDWPVDKLKEVKVADALKHPT

SEQ ID NO: 15135 - protein, 496 aa, Rattus norvegicus
MDRMKKIKRQLSMTLRGGRGIDKTNGVPEQIGLDESGGGGGMTLGEAPTRVAPGELRSIRGPLSSAPEIVHEDMKMGSDGESDQASATSSDEVQSPVRVRMRNHPPRKISTEDINKCLSLPADIRLPEGYLEKLTLNSPIGDKPLSRRLRPVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNVINMHNVKLFLFQLLRGLAYCHRQKVLHRDLKPQNLLINERGELKLADFGLAYAKSIPTKTYSNEVVTLWYRPPDILLGSTDYSGQIDMWGVGCIFYEMATGRPLFPGSTVEEQLHFIFRILGTPTEDTWPGILSNEEFRTYNYPKYRAEALLRHAPRLECDGADLLTKLLQFEGRNRISAEDAMKHPFFLSLGERIHKLPDTTSIFALKEVQLQKEANIRSTSMPDSGRPAFRVVDTEF

SEQ ID NO: 15136 - protein, 215 aa, Coccomyxa sp. PA
MATERKLYWGSGSTPAWRVLIALKEKGLEFDSRLIEFSKGEHKSEDILKLNPRGQVPTFVDGDVVVNESLAALLYIQDKYPSPSLLPATVEGRALVYQRLQESSNLQDKATQVILFKMKNADADVPQEKLDAAKNELKYWESYVSEEGFIAGPDFTLADVAAGPFLIAMQRFGATLEDFPKLAKYTETLKARPSVAETSPPHWKGTPGKDWLAAL

SEQ ID NO: 15137 - protein, 955 aa, Flaveria brownii
MSSLFVEGMPLKSANESCLPARVNQRRTGDLRRLNHHRQPAFVRGICRRKLSGVSRIELRTGGLTLPRAVLNPVSPPVTTTKKRVFTFGGKNSEGNKDMKSLLGGKGANLAEMASIGLSVPPGLTISTEACEEYQQNGKKLPPGSWDEILEGLQWVQKEMSASLGDPSKALLLSVRSGAAISMPGMMDTVLNLGLNDEVVDGLAAKSGARFAYDSYRRFLDMFGNVVMGIPHSLFDEKLEQMKAEKGIHLDTDLTAADLKDLAEQYKNVYVEAKGEKFPTDPKKQLELAVNAVFDSWDSPRANKYRSINQITGLKGTAVNIQCMVFGNMGNTSGTGVLFTRNPSTGEKKLYGEFLLNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTIEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 15138 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 15139 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 15140 - protein, 302 aa, Saccharomyces cerevisiae
MNRFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 15141 - protein, 593 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNIRYTPRKVSSGSVLRKISSFFRKD

SEQ ID NO: 15142 - protein, 395 aa, Homo sapiens
MGCLGNSKTEDQRNEEKAQREANKKIEKQLQKDKQVYRATHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 15143 - protein, 348 aa, Actinosynnema pretiosum subsp. auranticum
MWIGYSADGRRRRPVRWWGVTEAFTWETDEDIKLAATLRRDAEAANAADSTRAYLKAIGRVRLLTADQEVELARRVEAGLYAEHLLDLPPAARGSRRPVELRRVVRDGQRAKDHLLEANLRLVVSIAKRYTGKGMALLDVIQEGNLGLVRAVEKFDYAKGFKFSTYATWWIRQAITRALADQSRTIRLPVHMVEVVTKLARIERDLLHRNGREATAEEVAVELDVTPEKVVELRQHARTPVSLDQTIGAEADTSIGDLIADENAVAPLEAVSSALLSADLRAVLETLTPREAGVVRMRYGFPDGVLHTLDEVGRVYGVTRERIRQIESRTMAKLQHPARSRGLEGYLD

SEQ ID NO: 15144 - protein, 804 aa, Mus musculus
MTSSPFLDPWPSKAVFVRERLGLGERPNDSYCYNSAKNSTVLQGVTFGGIPTVLLLDVSCFLFLILVFSIIRRRFWDYGRIALVSEAGSEARFQRLSSSSSGQQDFENELGCCPWLTAIFRLHDDQILEWCGEDAIHYLSFQRHIIFLLVVISFLSLCVILPVNLSGDLLGKDPYSFGRTTIANLQTDNDLLWLHTVFSVIYLFLTVGFMWHHTRSIRYKEESLVRQTLFITGLPREARKETVESHFRDAYPTCEVVDVQLCYSVAKLIYLCKERKKTEKSLTYYTNLQAKTGRRTLINPKPCGQFCCCEVQGCEREDAISYYTRMNDSLLERITAEESRVQDQPLGMAFVTFREKSMATYILKDFNACKCQGLRCKGEPQPSSYSRELCVSKWTVTFASYPEDICWKNLSIQGVRWWLQWLGINFSLFVVLFFLTTPSIIMSTMDKFNVTKPIHALNNPVISQFFPTLLLWSFSALLPSIVYYSTLLESHWTRSGENRIMVSKVYIFLIFMVLILPSLGLTSLDFFFRWLFDKTSSETSIRLECVFLPDQGAFFVNYVIASAFIGSGMELLRLPGLILYTFRMIMAKTAADRRNVKQNQAFEYEFGAMYAWMLCVFTVIMAYSITCPIIVPFGLIYILLKHMVDRHNLYFAYLPAKLEKRIHFAAVNQALAAPILCLFWLFFFSFLRLGLTAPATLFTFLVVLLTILACLLYTCFGCFKHLSPWNYKTEESASDKGSEAEAHVPPPFTPYVPRILNGLASERTALSPQQQQTYGAIRNISGTLPGQPVAQDPSGTAAYAYQES

SEQ ID NO: 15145 - protein, 477 aa, Mus musculus
MGRKEEEDCSSWKKQTTNIRKTFIFMEVLGSGAFSEVFLVKQRVTGKLFALKCIKKSPAFRDSSLENEIAVLKRIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGVMSTACGTPGYVAPEVLAQKPYSKAVDCWSIGVITYILLCGYPPFYEETESKLFEKIKEGYYEFESPFWDDISESAKDFICHLLEKDPNERYTCEKALRHPWIDGNTALHRDIYPSVSLQIQKNFAKSKWRQAFNAAAVVHHMRKLHMNLHSPSVRQEVENRPPVSPAPEVSRPDSHDSSITEAPILDPSTPLPALTRLPCSHSSRPSAPSGGRSLNCLVNGSLRISSSLVPMQQGPLATGPCGCCSSCLNIGNKGKSSYCSEPTLFRKANKKQNFKSEVMVPVKAGGSTHCRGGQTGVCLVM

SEQ ID NO: 15146 - protein, 364 aa, Mus musculus
MGRWALDVAFVWKAALTLGLVLLYYCFSIGITFYNKWLTKSFHFPLFMTMLHLAVIFLFSALSRALVQCSSHKARVVLSWTDYLRRVAPTALATALDVGLSNWSFLYITVSLYTMTKSSAVLFILIFSLIFKLEELRAALVLVVLLIAGGLFMFTYKSTQFNVEGFALVLGASFIGGIRWTLTQILLQKADLGLQNPIDTMFHLQPLMFLGLFPLFAIFEGLHLSTSEKIFRFQDTGLLLWVLGSLLLGGILAFGLGFSEFLLVSRTSSLTLSIAGIFKEVCTLLLAAHLLGDQISLLNWLGFALCLSGISLHVALKALHSRGDGGPKPLKSLGSSADLELLLRSSQQEEEDGEEEYFVTQGQQ

SEQ ID NO: 15147 - protein, 409 aa, Mycobacterium leprae
MNVYVLQSALHLARRGIEVEIFTRATASADPPIVWVAPGVLVRNVVAGPFEGLDKYDLPTQLCAFAAGVLRAEAAHEPGYYDIVHSHYWLSGQVGWLARDRWAVPLVHTAHTLAAVKNAALADGDAAEPPLRSVGEQQVVDEADRMIVNTDDEARQLISIHRADPAKIDVAHPGVDLDMFRPGDRRAARAALGLPLDGNVVAFVGRIQPLKAPDIVLRAAAKLPQVRIVVAGGPSGSGLASPDGLVRLADELGITARVTFLPPQSRTNLATVFQAADLVAVPSYSESFGLVAVEAQACGTPVVAAAVGGLPVAVRDGVTGTLVFGHNVGHWADAVDQLLRLSAGPQARAISRAAVVHAAQFSWDNTTDALLASYRRAIGDFTATRQHRVRDLVATRKPRRWISRRGMGA

SEQ ID NO: 15148 - protein, 391 aa, Homo sapiens [sequence omitted]

SEQ ID NO: 15149 - protein, 323 aa, Homo sapiens
DDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 15150 - protein, 325 aa, Homo sapiens
GAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 15151 - protein, 332 aa, Thermus aquaticus
TSDPVRQYLHEIGQVPLLTLEEEIDLARKVEEGMEAIKKLSEATGLDQELIREVVRAKILGTARVEEVDGKLKSLPKELKRYLHIAREGEAARQHLIEANLRLVVSIAKKYTGRGLSFLDLIQEGNQGLIRAVEKFEYKRRFKFSTYATWWIRQAINRAIADQARTIRIPVHMVETINKLSRTARQLQQELGREPSYEEIAEAMGPGWDAKRVEETLKIAQEPVSLETPIGDEKDSFYGDFIPDENLPSPVEAAAQSLLSEELEKALSKLSEREAMVLKLRKGLIDGREHTLEEVGAYFGVTRERIRQIENKALRKLKYHESRTRKLRDFLE

SEQ ID NO: 15152 - protein, 438 aa, Thermus aquaticus
MKKSKSKKKAAKAQEVEVKEPVKEPEPLPELEAAEDLQDLPEPDPELLASEPELEDLADPLDLEGPLEADLLPEEGLLEEEEEELSLPKVSTSDPVRQYLHEIGQVPLLTLEEEIDLARKVEEGMEAIKKLSEATGLDQELIREVVRAKILGTARIQKIPGLKEKPDPKTVEEVDGKLKSLPKELKRYLHIAREGEAARQHLIEANLRLVVSIAKKYTGRGLSFLDLIQEGNQGLIRAVEKFEYKRRFKFSTYATWWIRQAINRAIADQARTIRIPVHMVETINKLSRTARQLQQELGREPSYEEIAEAMGPGWDAKRVEETLKIAQEPVSLETPIGDEKDSFYGDFIPDENLPSPVEAAAQSLLSEELEKALSKLSEREAMVLKLRKGLIDGREHTLEEVGAYFGVTRERIRQIENKALRKLKYHESRTRKLRDFLE

SEQ ID NO: 15153 - protein, 90 aa, Homo sapiens
KKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 15154 - protein, 363 aa, Toxoplasma gondii
MAVDSSNSATGPMRVFAIGNPILDLVAEVPSSFLDEFFLKRGDATLATPEQMRIYSTLDQFNPTSLPGGSALNSVRVVQKLLRKPGSAGYMGAIGDDPRGQVLKELCDKEGLATRFMVAPGQSTGTCAVLINEKERTLCTHLGACGSFRIPENWTTFASGALIFYATAYTLTATPKNALEVAGYAHGIPNAIFTLNLSAPFCVELYKDAMQSLLLHTNILFGNEEEFAHLAKVHNLVAAEKVALSVANKEHAVEVCTGALRLLTAGQNTGATKLVVMTRGHNPVIAAEQTADGTVVVHEVGVPVVAAEKIVDTNGAGDAFVGGFLYGLSQGKTVKQCIMCGNACAQDVIQHVGFSLSFTSLPC

SEQ ID NO: 15155 - protein, 314 aa, Arabidopsis thaliana
MATCIHTCRTGNTQDDDSRFCCINKFFRPGFSVNRKIHHTQIEDDDDVWIKMLKEAESDVKQEPILSNYYYASITSHRSLESALGHILSVKLSNLNLPSNTLFELFISVLEESPEIIESTKQDLIAVKERDPACISYVHCFLGFKGFLACQAHRIAHTLWKQNRKIVALLIQNRVSESFAVDIHPGAKIGKGILLDHATGVVIGETAVVGDNVSILHGVTLGGTGKQSGDRHPKIGDGVLIGAGSCILGNITIGEGAKIGSGSVVVKDVPARTTAVGNPARLIGGKENPRKHDKIPCLTMDQTSYLTEWSDYVI

SEQ ID NO: 15156 - protein, 915 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNALLQ

SEQ ID NO: 15157 - protein, 444 aa, Hypocrea jecorina
MTPHSIDRAARPSVWSGLALLLSTAHAIVMPDGVTGKVPSLGWNSWNAYHCDIDESKFLSAAEVIVSSGLLDAGYNYVNIDDCWSMKDGRVDGHIAVNTTRFPDGIDGLAKKVHDLGLKLGIYSTAGTATCAGYPASLGYEDVDAADFADWGVDYLKYDNCNVPSDWQDEYVACAPDAVQTGPNGTCSTALEPNLAPPGYDWSTSKSAERFNAMRNALAKQSREIVLSLCIWGVADVFSWGNETGISWRMSGDISPEWGSVTHIINMNSFKMNSVGFWGHNDADILEVGNGNLTAAETRTHFALWAAMKSPLLIGTDLAQLSQENIELLKNKHLLAFNQDSVYGQPATPYKWGVNPDWTFNYTNPAEYWAGPSSKGHLVLMMNTLDHTVRKEAKWSEIPGLSAGRYEVRDVWTDKSLGCLSSYKTAVAAHDTAVILVGKKCRNW

SEQ ID NO: 15158 - protein, 826 aa, Plasmodium falciparum
MPKEDCKTEKSIDSIDENVLKKYDILKKVGKGAYGVVFKGRCKKNKNIVAVKKIFGAFQNCTDAQRTFREIIFLYELNGHDNIIKLMDVIKAKNDNDIYLIFDFMETDLHEVIKADLLEEIHKKYIIYQLLRALKYIHSGGLLHRDIKPSNILVNSECHIKVADFGLARSISTHVNENKVPILTDYVATRWYRAPEILLGSTHYTEDVDMWSLGCIMGELLCGKPLFTGNSTMNQLEKIIQVIGKPNKKDIEDIRSPFAEKIISSFVDLKKKNLKDICYKASNESLDLLEKLLQFNPSKRISAENALKHKYVEEFHSIIDEPTCRHIITIPINDNTKYRVNFYRNVVYFVIMRRNKFHSNVLNQGESKKEEKKDRYYRRDKDKKKCICENNKVHMEDKEYKNKIIFSQGDKPEDIKEDHKKCKICDEIHVDTSKQIDSINLEHVVLNNNDVSYVDKKKKTKYEPVYKERGKMKKDKMGNVYCKDRERRVFYEARKKESITNFTTATTISKSDDTEVEMSQMEINEIESNEMKGKIKEQIKEQIKEQIKEQIKEQIKKTQNNISKISIGSNTMSSTISKTEPNSRNYFINKKRVESFYTKERKNNDILFHANNKKVIFFKDKNKIKNHSSEKKKIKYKVFYGFKKSYENEQNVPHYLETKCSNTPLGKNYYYKKYVDGSNKKYVDGGNKKYVDGGNKKYVDGSNKKYVDGSNRKYVDGGNKKYVDGSSKKYVDGGNKKYVDGSSKKYVDEGNKKYVDGGNKKYVDGGNKKYVDGLNKKYNHNYNHFNNNYHYYSRKGPLKSVNKKKKNCPQKTWKNTPKFTFTPCSK

SEQ ID NO: 15159 - protein, 875 aa, Loligo forbesi
MAGVETAVRQIELKWPNVPEQIIKGDKFLKWEEGSSSFTEILLRVDPKGYFLYWKIEGKEDTELLDLAYLRDIRAGKYAKPPKDKKIKEAGTNYGSSNIPLQDKCVTICHGYNYIDLEWIHLVAENSSVASKWAEEVFSYAYNLLSLNKNQLGEWEKLYFRFTTVEMEKNKIPVKTIQKCLSKDKDDRARVAKAIEKIGWPSGKNDAIEIKAFDFDTFFKFYLSLLERSEIEGIFKELSQNKGNITTVMFRDFLNDIQRHPSLHKTLFPLYTDSQCEALINEYESAVNKKGKKKGQLTKEGLLYFLMCEENNLTPMHRLDLGANMKLPLAAYYINSSHNTYLTGHQLTGKSSVEVYRQVLLTGCRSLELDCWDGKDGEPIITHGFTMCTEVLFKDVVTAIGESAFKVSDYPVILSFENHCSVPQQKLLAQYCHEAFGDLLLDKAIDGHPLKPGISLPTPYDLRKKILIKNKKIHKGAGDDDELAGLTEEEKKKIEKEKKDAGTAAKEAEAAEEMSALVNYIQPVHFTTFEQAQKKDRHYEMSSMVETQALNKLEDNPEDFVDYNKKQLTRIYPKGTRVDSSNYVPQIYWNAGCQLVALNFQCFDVAMCVNLGVFEYNGCSGYLLKPEFMRKLDKRFDPFTESTVDGVVAGTIEIKIISAQFLSDKQISSYVEVEMYGLPTDTVRKKFKTKTVNNNGMDPYYNENTFVFKKVVLPDLAVVRVIVNEDNGKFIGHRLMPLDGIKPGYRHIPLRNESNRPLGLASVFAHIVAKDYVSDAFADFADALLNPIAYQSAQEARSAALCAFEDDPDAALDAAKPVKGKSPKAGKKAWGAAGKKVSHGNIAKAAMTGGAKKPAGGGAGKSSYACKSTTTPSSS

SEQ ID NO: 15160 - protein, 375 aa, Geomys bursarius
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCKHGDLGRAQGTLMDGTTRFTCKGKPIHHFLGVTTFSEYTVVSEISVTKIDATSPLEKVCLIGCGFSTGYGSAVKVGKVARGSICSCVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 15161 - protein, 375 aa, Geomys knoxjonesi x Geomys bursarius major
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCKHGNLGRAQGTLMDGTTRFTCKGKPIHHFLGVTTFSEYTVVSEISVTKIDATSPLEKVCLIGCGFSTGYGSAVKVGKVARGSICSCVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 15162 - protein, 308 aa, Barbatia lima
MSVAEKVDEVTQPVNKSLIRQTWNMMAGDSKNGVDLMALLFQIAPESKKEFTRLGDVSPENIPNNRKLNGHGITLWYALTSFVDQLDSPNDLEDLCRKFAVNHVARGVLDVRFGWIKEPLAKLLRRNCGNCDEAIQAWWELIDVICAVVKENKMSVAEKIEEATQSDNKSLIRETWEMIAGDRKNGVELMALLFEMAPESKKEFRRLGDISPENIPNNRKLNGHGITLWYALTSFVDQLDNKNDLEDLCRKFAVNHVSRGVLNVKFGWIKEPLAELLRRKCGSRCEDRHINAWWKLIDVICAILEEQK

SEQ ID NO: 15163 - protein, 599 aa, Thanatephorus cucumeris
MARSTTSLFALSLVASAFARVVDYGFDVANGAVAPDGVTRNAVLVNGRFPGPLITANKGDTLKITVRNKLSDPTMRRSTTIHWHGLLQHRTAEEDGPAFVTQCPIPPQESYTYTMPLGEQTGTYWYHSHLSSQYVDGLRGPIVIYDPHDPYRNYYDVDDERTVFTLADWYHTPSEAIIATHDVLKTIPDSGTINGKGKYDPASANTNNTTLENLYTLKVKRGKRYRLRIINASAIASFRFGVQGHKCTIIEADGVLTKPIEVDAFDILAGQRYSCILKADQDPDSYWINAPITNVLNTNVQALLVYEDDKRPTHYPWKPFLTWKISNEIIQYWQHKHGSHGHKGKGHHHKVRAIGGVSGLSSRVKSRASDLSKKAVELAAALVAGEAELDKRQNEDNSTIVLDETKLIPLVQPGAPGGSRPADVVVPLDFGLNFANGLWTINNVSYSPPDVPTLLKILTDKDKVDASDFTADEHTYILPKNQVVELHIKGQALGIVHPLHLHGHAFDVVQFGDNAPNYVNPPRRDVVGVTDAGVRIQFRTDNPGPWFLHCHIDWHLEEGFAMVFAEAPEDIKKGSQSVKPDGQWKKLCEKYEKLPEALQ

SEQ ID NO: 15164 - protein, 529 aa, Thanatephorus cucumeris
MLSSITLLPLLAAVSTPAFAAVRNYKFDIKNVNVAPDGFQRPIVSVNGLVPGTLITANKGDTLRINVTNQLTDPSMRRATTIHWHGLFQATTADEDGPAFVTQCPIAQNLSYTYEIPLHGQTGTMWYHAHLASQYVDGLRGPLVIYDPNDPHKSRYDVDDASTVVMLEDWYHTPAPVLEKQMFSTNNTALLSPVPDSGLINGKGRYVGGPAVPRSVINVKRGKRYRLRVINASAIGSFTFSIEGHRLTVIEADGIPHQPLPVDSFQIYAGQRYSVIVEANQTAANYWIRAPMTVAGAGTNANLDPTNVFAVLHYEGAPNAEPTTEQGSAIGTALVEENLHALINPGAPGGSAPADVSLNLAIGRSTVDGILRFTFNNIKYEAPSLPTLLKILANNASNDADFTPNEHTIVLPHNKVIELNITGGADHPIHLHGHVFDIVKSLGGTPNYVNPPRRDVVRVGGTGVVLRFKTDNPGPWFVHCHIDWHLEAGLALVFAEAPSQIRQGVQSVQPNNAWNQLCPKYAALPPDLQ

SEQ ID NO: 15165 - protein, 288 aa, Riccia fluitans
MASKQYEQSYDTTAQKTEEAKNAAAGTAEQTKQSAAETSDKTKQLGAEKTEQANRAASEAAGTVQEKAQVARDTGAEKAEQAKNYGAEKTEQAKSAASDMAGTLQEKAQATRDVGAEKTEQAKQYGAEKTEQAKGAASETAGTAQDKAQTVWEQAKQTAADATQYVQEKATQAWESTKQTTSDTTTTAGNKAVEAKDYAVDTAVQGKDFAVDKAVQGKDYAVDKALQGKDYTGEKAGQAGQYTTDRAVQGKDFTVAKTAEAVKGVVLGVKDAIVGETGANKPGPTSKH

SEQ ID NO: 15166 - protein, 262 aa, Streptomyces nogalater
MPDTDGRVAVVTGGTSGIGLAVVKALAATGYACRSLCARSQDAVDSTVEELRDEKLEVDGRSCDVRSTDDVREFIGFATRRFGGVDVLVNNAGRNGGGPTARITDELWLDVIETNLTSVFRVTREVLTTGGMLAAGRGRIINIASTGGKQGVVLGAPYSASKHGVVGFTKALGLELAKSGITVNAVCPGYVETPMGERVGRGYAEVWDTSEEAVLERFQAKIPLGRYAQPEEVAGLVTYLTTPTADSITAQALNVCGGLGNY

SEQ ID NO: 15167 - protein, 353 aa, Drosophila melanogaster
MDCCLSDQACEERRISREIDKFLKAEKKKARRELKLLVLGTGESGKTTFIKQMRIIHGKGFLDKERKQFTKNVFQNIFMAIQSMISAMDTLRIPYGQQEHSKLADLVKSIDYKTVTRLEAPYLNAIKTLWKDAGIKECYNRRREYQLTDSTEYFLNDIARIERSDYQATDQDILHVRAPTTNIVEYPFNLDGFLIRLVDVAGQRTERRKWIHCFSNVTSIMFLVAMSEFDLSLAESENDNRMKESKALFHNIISFSWFQHSSVILFLNKEDLFKKKILSTHLADYFPEYNGPKKDAKAAREFILYMFTSVNPDPYKCIYPHFTVATNTENIKFVFTAVKDTILELHLSETNLL

SEQ ID NO: 15168 - protein, 247 aa, Equus caballus
MIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMMEEMYKKAHSAIRENPVYEKKPKKEVKKKRWNRPKMSLAQKKDRVAQKKASFLRAQERAAES

SEQ ID NO: 15169 - protein, 380 aa, Mus musculus
MAAAAAAPGGGGGEPRGTAGVVPVVPGEVEVVKGQPFDVGPRYTQLQYIGEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEGP

SEQ ID NO: 15170 - protein, 708 aa, Canis familiaris
MGMSKSYGCFGYPLSIFFIVVNEFCERFSYYGMRALLILYFRRFIGWDDNLSTAIYHTFVALCYLTPILGALIADSWLGKFKTIVSLSIVYTIGQAVTAVSSINDLTDYNKDGTPDNLSVHVALSMIGLALIALGTGGIKPCVSAFGGDQFEEGQEKQRNRFFSIFYLAINAGSLISTIVTPMLRVHECGIYSQKACYPLAFGVPAALMAVSLIVFVIGSGMYKKFQPQGNVMGKVVKCIGFALKNRFRHRSKQFPKREHWLDWAKEKYDERLISQIKMVTKVMFLYIPLPMFWALFDQQGSRWTLQATAMSGKIGLLEVQPDQMQTVNAILIVVMVPIMDAVVYPLIAKCGFNFTSLKRMTVGMFLASMAFVMAAIVQLEIDKTLPVFPKQNEVQIKVLNIGNGAMNVSFPGAVVTVSQMSQSDGFMTFDVDKLTSINISSTGSPVIPVTYNFEQGHRHTLLVWAPNNYRVVKDGLNQKPEKGENGIRFINSLNESLNITMGDKVYVNVTSHNASEYQFFSLGTKNITISSTQQISQNCTKVLQSSNLEFGSAYTYVIGTQSTGCPELHMFEDISPNTVNMALQIPQYFLITCGEVVFSVTGLEFSYSQAPSNMKSVLQAGWLLTVAVGNIIVLIVAGAGQFSEQWAEYILFAALLLVVCVIFAIMARFYTYVNPAEIEAQFDDDEKKNLEKMNVYSTVTPVSQTQM

SEQ ID NO: 15171 - protein, 280 aa, Rhizobium etli
MERFKGKVAVVTGAGAGIGKACALAIAREGGRVVVADIDGPAAIACTAQIAAEAGQALAVAMDIADAQAVAELFKTAKRRFGGVDVLVNNASAMHLTPHDRAILDLDVAVWDQTMATNLRGTLLCCRQAIPQMIGRGGGAIVNMSSCQGLSGDTALTSYAASKAAMNMLSASLATQYGHAKIRCNAVAPGLVMTERLFAKLDECMQRHLHRHQLLPHVGRPEDVAALVAFLLSEEAAFITGQVVCIDGGMLAHVPTYADGGSSAARPAGDAAEAAAASHW

SEQ ID NO: 15172 - protein, 394 aa, Rhizobium etli
MRARVASSPSGRSSHSRSNCGRTQENIMVKITAAVAVKPKSPLEFRELELADPEGNEILVRTVASGICHTDLLLRDGIFGPPAPVIPGHEGVGVVEAVGPEVQSLKVGDHVALSQSSCGFCADCRRSHPMNCQNYTQYNLTGLRPNGKKALLCDEVGIGSNFVGQSSFATHILATENNAALLPKTDLDLTDAAPLGCGMATGAGTVINAMKPEIGSTIAVFGAGAVGMAAVMAAKVRRCSKIIIIDLNQQRLDMAMGLGATHAINGKDPDVVNQIHALTGGGADFAIDAVGIIPVILNSIKCTRAGGHVVLLGLDALGNDIPIPLDLMVFNRKIQGAILGDQIPQLFIPQMMDLNQAGLFPFQKLITKYPFEKINEAIADAEAGRVIKPVVVFN

SEQ ID NO: 15173 - protein, 368 aa, Rhizobium etli
MKQAYAAVSREKAKPLILECIGIEEPRADEILVRIVASGVCHTDLVVRDQGYDVPQPVVLGHEGSGVVEAVGSAVKDLVPGDHVALSYAYCGKCEKCLSGTPFYCEDFFGRNFRGTRPDGTCPIHDSHGKQISGCFFEQSSFATYAIASERNAVKVAKDVPLELIGPLGCGLQTGAGAVLNCLKPKPGSSIAVFGAGAVGMAATMAAKIAGCATIIVIDLNDERLELSRELGATHTINARKLDSVAAIRKIVPAGVDFSLECTSSPRVFRQAVDCLGTPGTCGLVGSSALGTEGTIDIGNFLFGRTLIGVVEGQSVPSEFVPQLIEYWQQGLFPFDKLVQFYDLDQINEAMADSESGKVIKPILRMKH

SEQ ID NO: 15174 - protein, 274 aa, Rhizobium etli
MTDCLLKCLLRHPKMRRWSMDLNQRVCIVTGGGSGIGRATAELFAKNGAYVVVADVNEDAAVRVANEIGSKAFGVRVDVSSAKDAESMVEKTTAKWGRVDVLVNNAGFGTTGNVVTIPEETWDRIMSVNVKGIFLCSKYVIPVMRRNGGGSIINTTSYTATSAIADRTAYVASKGAISSLTRAMAMDHAKEGIRVNAVAPGTIDSPYFTKIFAEAKDPAKLRSDFNARAVMDRMGTAEEIAEAMLFLASDRSRFATGSILTVDGGSSIGNHLVK

SEQ ID NO: 15175 - protein, 375 aa, Rhizobium etli
MQMRSVILRESGLPKPYSNSKPLKIELVELTPPGPMEVLVKIKAAGVCHSDLSAINGDRPRPLPVALGHEASGVVAAIGPSVEKVEVGDHVVMSFLPVCGHCSYCAEGRASLCEPGYQANAAGTLLSGGKHIRLRGYEINHHSGVSAFSEYAVVSASSVVKVTKDIDLATAALFGCAVMTGVGAVMNTCGVRPGRSVAVIGLGGVGLSAILGAVASGASDIVAIDLIQAKLDLAKELGATKTFLATSPNIVAQVKGATSGGVDYAIEMAGSKKAFELAYEITRRGGMTATAGLASANSRFEVSPLPLVGEERTIKGSYMGSCVPSRDIPRYIDLYLKGKLPVDKLLSSTGPLDEINEVFDRLDRAEINRHLVLMD

SEQ ID NO: 15176 - protein, 495 aa, Rhizobium etli
MAISSTLLGRLKDQTLVREQMLVGGKWSSEGVNGTRINVLNPSTMDVLASLPSAGLAEVRASIDAAKAAQKKWAKVSAKERSLIMRKFYEEVVANAEDLAVILTSEMGKPLAEARGEIAYGASYIEWFGEEAKRVYGDTIPGHQADKRLLVIKQPVGVVAAIAPWNFPSAMVCRKIAPALASGCAIVFKPAAETPLSALALAILAERAGIPDGLFSVLPTDNARMFGEEVCSNPVVKKLTFTGSTEVGRILMAQGAQKIMKLSLELGGNAPFIVFDDADLDQAVEGAMLSKFRNAGQTCVCANRIYVQSGIHDRFVEKLAMRVSALQVLDGFESGATIGPLINDEAVAKLYGHIDDAVTKGATVVVGGDRDARGGTFVQPTLLSGATKDMKVAREETFAPLAPVFKFDTVEEVIELANDTEFGLAAYFFANDLRNVWKVTEALEYGMVGVNTGLISTELAPFGGVKQSGFGREGSKYGMDDFLSMKYVCMGGIGA

SEQ ID NO: 15177 - protein, 253 aa, Rhizobium etli
MKMHFLEAGRLRMRRSIYVPGALKEEAIELPVHATLMRHPQGNALFDSGCNPEAAIDPGARWGGLSKVMTPIFSPERTVVHQLKTLALDPEDIDVVICSHLHPDHCGCNAYFRRATILCHEAEAQAATASGAENQGYLRGEWDQPQGFQTFNAEHDVFGDGRIVLLPMPGHTPGMTVARVELEKDGSFILASDAAPLQASVDTGIAPRNTWNIELAAEALARLKALRERGASIIFGHDDAQWQELRKGVEFYE

SEQ ID NO: 15178 - protein, 153 aa, Meriones unguiculatus
GGEQINNIGLLDTLLFGSIISAVDPVAVLAVFEEIHINELLHILVFGESLLNDAVTVVLYHLFEEFASYESVGISDIFLGFLSFFVVALGGVFVGVVYGVIAAFTSRFTSHIRVIEPLFVFLYSYMAYLSAELFHLSGIMALIASGVVMRPYV

SEQ ID NO: 15179 - protein, 156 aa, Meriones unguiculatus
IASFTLTPTLFFFYLLPPIVLDAGYFMPNRLFFGNLGTILLYAVIGTIWNAATTGLSLYGVFLSGLMGELKIGLLDFLLFGSLIAAVDPVAVLAVFEEVHVNEVLFIIVFGESLLNDAVTVVLYNVFESFVTLGGDKVTGVDCVKGIVSFFVVSLG

SEQ ID NO: 15180 - protein, 442 aa, Homo sapiens
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 15181 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNRLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLFSQTPNGVLEVSACCFSFKTHDSSSSYTHLS

SEQ ID NO: 15182 - protein, 449 aa, Arabidopsis thaliana
MSQRWSRKKSRLPLAGLLFILVVTFMILFNERSIQQIHHHAASHTQNLREPSTFDFVKPNVPRINYLGAHEVLGRFSKCNSTKEYSGKKIGCVDPFEDHPGQVTKEEQKCDVFSGKWVFDNSSSYPLHKESQCPYMSDQLACQKHGRKDLEYQHWRWQPHACNLKRWNVIEMWEKLRGKRLMFVGDSLNRSQWISMVCLLRSVIPRDKQSMSPNAHLTIFRAEDYNATVEFLWAPLLVESNSDDPVNHRLSERIIRPDSVLKHASKWQHADILIFNTYLWWRQDSVKLRWSSEEKGSCEEVKSAEGMEMAMDSWGDWVANNVDPNKKRVFFVTMSPTHQWSREWNPGSEGNCYGEKKPIEEESYWGSGSDIPTMRMVKRVLERLGPKVSVINITQLSEYRKDGHPSVYRKFWEPLNEDRLKNPASYSDCTHWCVPGVPDVWNQLLFHFL

SEQ ID NO: 15183 - protein, 348 aa, Arabidopsis thaliana
MEKAENENKPSAVSDVGAWAMNVTSSVGIIMANKQLMSSSGFGFSFATTLTGFHFALTALVGMVSNATGLSASKHVPLWELLWFSLVANISIAAMNFSLMLNSVGFYQISKLSMIPVVCVMEWVLHSKHYSREVKASVMVVVVGVGICTVTDVKFNAKGFICACTAVFSTSLQQISIGSLQKKYSIGSFELLSKTAPIQAISLLIFGPFVDYFLSGRFISTYKMTYSAMLCILLSCALAVFCNISQYLCIGRFSATSFQVLGHMKTVCVLTLGWLIFDSEMTFKNIAGMVLAVVGMVIYSWAVELEKQRKSKVIPHGKHSMTEDEIKLLKEGIEHMDLKDMELGNNKA

SEQ ID NO: 15184 - protein, 264 aa, Arabidopsis thaliana
METDKRWSLAGKTALVTGGTRGIGRAVVEELAKFCAKVHTCSRNQEELNACLNDWKANGLVVSGSVCDASVRDQREKLIQEASSAFSGKLNILINNVGTNVRKPTVEYSSEEYAKIMSTNLESAFHLSQIAHPLLKASGVGSIVFISSVAGLVHLSSGSIYGATKGALNQLTRNLACEWASDNIRTNCVAPWYIKTSLVETLLEKKEFVEAVVSRTPLGRVGEPEEVSSLVAFLCLPASSYITGQVISVDGGFTVNGFSYAMKP

SEQ ID NO: 15185 - protein, 330 aa, Arabidopsis thaliana
MCISKEDEEDPSRNRRNQSPLSLPQTLKHFQKDLLAGAVMGGVVHTIVAPIERAKLLLQTQESNIAIVGDEGHAGKRRFKGMFDFIFRTVREEGVLSLWRGNGSSVLRYYPSVALNFSLKDLYRSILRNSSSQENHIFSGALANFMAGSAAGCTALIVVYPLDIAHTRLAADIGKPESRQFRGIHHFLSTIHKKDGVRGIYRGLPASLHGVIIHRGLYFGGFDTVKEIFSEDTKPELALWKRWGLAQAVTTSAGLASYPLDTVRRRIMMQSGMEHPMYRSTLDCWKKIYRSEGLASFYRGALSNMFRSTGSAAILVFYDEVKRFLNWGGI

SEQ ID NO: 15186 - protein, 354 aa, Arabidopsis thaliana
MWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSVGLPLRPGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 15187 - protein, 135 aa, Arabidopsis thaliana
MTMFRSISMVMLLVALVTFISMVSSAASSPEADFVKKTISSHKIVIFSKSYCPYCNKAKSVFRELDQVPYVVELDEREDGWSIQTALGEIVGRRTVPQVFINGKHLGGSDDTVDAYESGELAKLLGVSGNKEAEL

SEQ ID NO: 15188 - protein, 326 aa, Arabidopsis thaliana
MDLDSMDCTSTMDVTDDEEIHQDRHSYASVSKHHHTNNNTTNVNAAASGLLPTTTSVHELLECPVCTNSMYPPIHQCHNGHTLCSTCKARVHNRCPTCRQELGDIRCLALEKVAESLELPCKHMSLGCPEIFPYYSKLKHETVCNFRPYSCPYAGSECSVTGDIPFLVAHLRDDHKVDMHSGCTFNHRYVKSNPREVENATWMLTVFHCFGQYFCLHFEAFQLGMAPFYMAFLRFMGDETEARNYNYSLEVGGYGRKLIWEGTPRSVRDSHRKVRDSHDGLIIQRNMALFFSGGDRKELKLRVTGRIWKEQQQSGEGGGACIPNLS

SEQ ID NO: 15189 - protein, 546 aa, Arabidopsis thaliana
MKMASRKTTSLLNHLLLLGALTLLSSLVIVKGESPYKFYTWTVTYGIISPLGVPQQVILINGQFPGPKLEVVTNDNIILNLINKLDQPFLLTWNGIKQRKNSWQDGVLGTNCPIQPNSNFTYKFQTKDQIGTFNYFPSTAFHKAAGGFGAINVYARPGIPIPYPLPTADFTLLVGDWFKTNHKTLQQRLDSGGVLPFPDGMLINGQTQSTFSGDQGKTYMLRISNVGLSSTFNFRIQGHTMKVVEVEGSHVIQTDYDSLDIHVGQSLAVLVTLNQSPKDYYIVASTRFIRSKLSVMGLLRYSNSRVPASGDPPALPPGELVWSMRQARTFRWNLTANAARPNPQGSFHYGMISPTKTFVFSNSAPLINGKQRYAVNGVSYVKSETPLKLADHFGISGVFSTNAIQSVPSNSPPTVATSIVQTSHHDFLEIVFQNNEKSMQSWHLDGYDFWVVGFGSGQWTPTKRSLHNLVDALTRHTTQVYPESWTTILVSLDNQGMWNMRSAIWERQYSGQQFYLKVWNSVQSLANEYNPPDNLQLCGKAVGRHV

SEQ ID NO: 15190 - protein, 312 aa, Arabidopsis thaliana
MPPAGELRHQSPSKEKLSSVTQFDEAEAAAAAISAAAADAEAAGLWTQIKAEARRDAEAEPALASYLYSTILSHSSLERSISFHLGNKLCSSTLLSTLLYDLFLNTFSSDPSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 15191 - protein, 413 aa, Arabidopsis thaliana
MTLANDFGYSTAMSSSYSALHTSVEHRYHKLPNSFWVSSGQELMNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 15192 - protein, 114 aa, Arabidopsis thaliana
  unsure (1)..(114): unsure at all Xaa locations
MEGDVLSGFGDRHNMDGKLLQSFQKSFVDVQDILDQNRLLINEINQXHESKQPDNLGRNVGLIKELNNNIRRVASLYGDLSHSFARSVDASSEGESSGTLKSDGKANQKRFRSG

SEQ ID NO: 15193 - protein, 217 aa, Hordeum vulgare subsp. vulgare
MGGAAGIKLFGKVITRQPTRQGTDGGGGGVPSKAQQAPSMSSSSSSSGRGSVEQLEEAARARAAAAEARLPCPRCRSEDTKFCYFNNYNVNQPRHFCRACHRYWTAGGAIRNVPVGSGRRKNRPVLHGASTVISADNPLAGSASQGMVNGLGFHPDYGWSQVVPSSAYLGHGEIEQCLWLVNQYQPKVRSTGTPTNPSSLRSTNTKKNNSSTCNFLP

SEQ ID NO: 15194 - protein, 270 aa, Hordeum vulgare subsp. vulgare
LKKPDKILPCPRCSSMDTKFCYYNNYNINQPRHFCKNCQRYWTAGGAMRNVPVGAGRRKSKSISAASHFLQRIRAALPGDPLCTPVNTNGTVLSFGSDASTLDVVSEQMKHMKELSSVTRTENTDAPSVGSCAEGWAKGEESSQMNSRERVAADRSPNFAQHPCMNGAAMWPFSCAPSPAYFTPNVAIPFYPAAAAAYWGCMVPGAWNTPWQPQPQPQSQCQSSSPPSAASPVSTMSSCFQSRKHPRDGDEERDTKGNGKVWVPKTIEST

SEQ ID NO: 15195 - protein, 250 aa, Bacillus sp. A24
MTVKKLYFVPAGRCMLDHSSVNSTLTPGELLDLPVWCYLLETEEGPILVDTGMPESAVNNEGLFNGTFVEGQILPKMTEEDRIVNILKRVGYEPEDLLYIISSHLHFDHAGGNGAFINTPIIVQRAEYEAAQHSEEYLKECILPNLNYKIIEGDYEVVSGVQLLHTPGHTPGHQSLLIETEKSGSVLLTIDASYTKENFEEEVPFAGFDPELALSSIKRLKEVVIKEKPIVFFGHDIEQEKGCKVFPEYI

SEQ ID NO: 15196 - protein, 277 aa, Eimeria tenella
MIEDIKTLREEHVYRAKLAEQAERYDEMAEAMKNLVENCLDQNNSPPGAKGDELTVEERNLLSVAYKNAVGARRASWRIISSVEQKEANRNHMANKALAASYRQKVENELNKICQEILTLLTDKLLPRTTDSESRVFYFKMKGDYYRYISEFSNEEGKKASAEQAEESYKRATDTAEAELPSTHPIRLGLALNYSVFYYEILNQPQKACEMAKLAFDDAITEFDSVSEDSYKDSTLIMQLLRDNLTLWTSDLQTQEQQQQPVGEGAEAPKVEATEQQ

SEQ ID NO: 15197 - protein, 439 aa, Mastigamoeba balamuthi [sequence omitted]

SEQ ID NO: 15198 - protein, 108 aa, Mastigamoeba balamuthi
MTGRGKGGKVLSLGGKGGKGAKRHRKVLRDNIQGITKPAIRRLARRGGVKRISGLIYEETRGVLKVFLENVIRDSVTYTEHARRKTVTAMDVVYALKRQGRTLYGFGG

SEQ ID NO: 15199 - protein, 314 aa, Eimeria tenella
MGKEPAAKRREYFPRLLQLVLEHPRVLVVSADHVGSKQLAGIRVALRGQATVLMGKNTKIRTALRQQLQQQPQLQALLPLVRLNVGFIFCRADPAAVRAVVQQHKVPAPAKQGVTAPTDVFIPAGPTGMDPGSTGFFQALGISTKIVKGQIEIQQAVQLIRRGERVSASAATLLHKLSVKPFTYGLKVEHVYDNGSVYSASVLDITDEQILEAFAAGAANVAAVSRAVGLPSAAAAPHSILEAFRNCAALCLDTPFCFPQMQRLKEMVENPAAFAAAAAPAAAAPAAAPAAAAKAPEPEEEEEEDGDMGFSLFD

SEQ ID NO: 15200 - protein, 523 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGHGKNRRQSMLF

SEQ ID NO: 15201 - protein, 601 aa, Arabidopsis thaliana
MGLCTSKPNSSNSDQTPARNSPLPASESVKPSSSSVNGEDQCVTTTNNEGKKSPFFPFYSPSPAHYFFSKKTPARSPATNSTNSTPKRFFKRPFPPPSPAKHIRAVLARRHGSVKPNSSAIPEGSEAEGGGVGLDKSFGFSKSFASKYELGDEVGRGHFGYTCAAKFKKGDNKGQQVAVKVIPKAKMTTAIAIEDVRREVKILRALSGHNNLPHFYDAYEDHDNVYIVMELCEGGELLDRILSRGGKYTEEDAKTVMIQILNVVAFCHLQGVVHRDLKPENFLFTSKEDTSQLKAIDFGLSDYVRPDERLNDIVGSAYYVAPEVLHRSYSTEADIWSVGVIVYILLCGSRPFWARTESGIFRAVLKADPSFDDPPWPLLSSEARDFVKRLLNKDPRKRLTAAQALSHPWIKDSNDAKVPMDILVFKLMRAYLRSSSLRKAALRALSKTLTVDELFYLREQFALLEPSKNGTISLENIKSALMKMATDAMKDSRIPEFLGQLSALQYRRMDFEEFCAAALSVHQLEALDRWEQHARCAYELFEKEGNRPIMIDELASELGLGPSVPVHAVLHDWLRHTDGKLSFLGFVKLQHGVSSRTIKAH

SEQ ID NO: 15202 - protein, 502 aa, Pseudomonas fluorescens
MTRSLTMNSSLPAIDGLRLPHQMLIGGQWVNAQSDKTLNVYNPATGDTLTDVPDGDVEDVNAAVESAAATLQSDAWRRMPPSARERILLRLADLLEAHGDELARLETLNNGKLLIYSKMMEVGASAQWLRYMAGWATKLTGSTLDLSLPLPPDVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 15203 - protein, 589 aa, Glycine max
MEPAKTIHNNVKYSPIFLAIFVLILASALSSANAKIHEHEFVVEATPVKRLCKTHNSITVNGQYPGPTLEINNGDTLVVKVTNKARYNVTIHWHGVRQMRTGWADGPEFVTSVPDCPGGSYTYRFTVQGQEGTLWWHAHSSWLRATVYGALIIRPREGEPYPFPKPKRETPILLGEWWDANPIDVVRQATRTGGAPNVSDAYTINGQPGDLYKCSSKDTTIVPIHAGETNLLRVINAALNQPLFFTVANHKLTVVGADASYLKPFTTKVLILGPGQTTDVLITGDQPPSRYYMAARAYQSAQNAAFDNTTTTAILEYKSPNHHNKHSHHRAKGVKNKTKPIMPPLPAYNDTNAVTSFSKSFRSPRKVEVPTEIDQSLFFTVGLGIKKCPKNFGPKRCQGPINGTRFTASMNNVSFVLPNNVSILQAHHLGIPGVFTTDFPGKPPVKFDYTGNVSRSLWQPVPGTKAHKLEFGSRVQIVLQDTSIVTPENHPIHLHGYDFYIVAEGFGNFDPKKDTAKFNLVDPPLRNTVAVPVNGWAVIRFVADNPGAWLLHCHLDVHIGWGLATVLLVENGVGKLQSIEPPPVDLPLC

SEQ ID NO: 15204 - protein, 361 aa, Streptococcus pneumoniae
MKSENQKNNILHISRTMDIGGAERIVYQLSSDLKDEFDSVHVASTGGLWESKLLSKGVQHHKILDVDSKNPLTMVKILSSFYRIIKNNDITIVHTHHRMAAFYIRLLKIINPKLIHVYTAHNVFKNKLPLYKFSLKKAYCVAVGKAVNDNLKHDVGISDSTVIYNGVVFEKTDKLVDEIVNYNGIKLGCIARLSEQKGLTYLIDAMSLVKHRDITLFIVGDGELRDELENKVKQLNLQKSVIFLGYRKDVVECINSFDYLVSSSLYEGLALNVIEAFMNGKTMVASDIPGINEVVNNKNGILVPVKDDVALARAIEKLATDKKLREKLAYQAKKDYETKFNYSLFLDNYRRLYRKLTGESK

SEQ ID NO: 15205 - protein, 175 aa, Arabidopsis thaliana
  unsure (1)..(175): unsure at all Xaa locations
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGYSSRGXGGGSYGGGRREGGGGYGGGEGGGYGGSGGGGGW

SEQ ID NO: 15206 - protein, 262 aa, Arabidopsis thaliana
MSSLGSSKSLRDDMEVTTADVFSEVNAAAVTENLDRNELVLADGVVSAEERNIEPDNRGKRKIESESPPEDDVCPICFGSFTVPCRGNCGHWYCGNCILQYWNYAAISRPCKCPMCVRHITKLSPEPSLQERQEQEVKEVLDKVRRYNRLFVGGLTGFVQKVHELPFLVKRMVWHMMDTDVNNLYFHEVRIFAMFMSTLYTAAEFNFIPTGGFRIVTVFDYAAIAMILILRLVGIYRRRRLAQQVRHLAAAAIEPELEQREL

SEQ ID NO: 15207 - protein, 253 aa, Arabidopsis thaliana
MAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEN

SEQ ID NO: 15208 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKCLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLSGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 15209 - protein, 384 aa, Arabidopsis thaliana
MFSSWLRQDVKKILKRKDSDAGERGKALEDLRASLFNRFRSPETPKRQQQQQHRICGPTVALTFNFVVAISIIFMNKWVLKNIGFEFPVFLTFIHYIVAYLLMALLKSFSLLPASPPSTKSSLLPLYTLGIVMSLSTGLANVSLKYNSVGFYQMAKIAVTPSIVFAEFLWYRKRVSFMKVVSLTVVSVGVAVATVTDLQFSLFGACVAFAWIIPSATNKILWSNMQQRENWTALALMWKTTPITLLFLVSMIPFLDPPGALSFNWSLTNTSAILVSALLGFFLQWSGALALGATSAITHVVLGQFKTCVLLLGNYYIFGSNSGFISVGGAFVAIMGTSLYTYLNTRGQSLKTSSSSSALSEKKSRFSDLKDDDKNLEPYGSEAV

SEQ ID NO: 15210 - protein, 329 aa, Arabidopsis thaliana
MAVLSKPVAVPKSGFSLIPVIDMSDPESKHALVKACEDFGFFKVINHGVSAELVSVLEHETVDFFSLPKSEKTQVAGYPLGYGNSKIGRNGDVGWVEYLLMNANLDSGSGPLFPSLLKSPGTFRNALEEYTTSVRKMTCDVLEKITDGLGIKPRNTLSKLVSDQNTDSILRLNHYPPCPLSNKKTNGGKNVIGFGEHTDPQIISVLRSNNTSGLQINLNDGSWISVPPDHTSFFFNVGDSLQVMTNGRFKSVRHRVLANCKKSRVSMIYFAGPSLTQRIAPLTCLIDNEDERLYEEFTWSEYKNSTYNSRLSDNRLQQFERKTIKNLLN

SEQ ID NO: 15211 - protein, 379 aa, Arabidopsis thaliana
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVKAMLGADAGAVTQEEENPVELWSLDEINFMLEGDF

SEQ ID NO: 15212 - protein, 367 aa, Arabidopsis thaliana
MGKKKKRATEKVWCYYCDREFDDEKILVQHQKAKHFKCHVCHKKLSTASGMVIHVLQVHKENVTKVPNAKDGRDSTDIEIYGMQGIPPHVLTAHYGEEEDEPPAKVAKVEIPSAPLGGVVPRPYGMVYPPQQVPGAVPARPMYYPGPPMRHPAPVWQMPPPRPQQWYPQNPALSVPPAAHLGYRPQPLFPVQNMGMTPTPTSAPAIQPSPVTGVTPPGIPTSSPAMPVPQPLFPVVNNSIPSQAPPFSAPLPVGGAQQPSHADALGSANAYPPNNSIPGGTNAHSYASGPNTSGPSIGPPPVIANKAPSNQPNEVYLVWDDEAMSMEERRMSLPKYKVHDETSQMNSINAAIDRRISESRLAGRMAF

SEQ ID NO: 15213 - protein, 264 aa, Arabidopsis thaliana
MDKRLWSLQGMTALVTGAASRIGYAIVEELAGFGAKIHICDISKTLLNQSLSEWENKGFQVSGSVCDVTSHPEREKLMQTVSSIFDGKLNILVNNVGVLRGKPTTEYVADDFTFHISTNLEAAYHFCQLSHPLLKASGYGSIVFLSSVAGVVSLIDCGSIYGLTKGALNQLARNLACEWAKDGIRANAVAPNVVKTAQSQSFLEDVSKKEGLLSRTPLGRVGEPNEVSSLVVFLCLPAASYITGQTICVDGGLTVNGFSYQPHA

SEQ ID NO: 15214 - protein, 360 aa, Arabidopsis thaliana
MGSNEEGNPTNNSDKPSQAAAPDQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 15215 - protein, 485 aa, Arabidopsis thaliana
  unsure (1)..(485): unsure at all Xaa locations
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQXDYVSIPIEGPYKPPHYRY

SEQ ID NO: 15216 - protein, 507 aa, Arabidopsis thaliana
MDVSNETVERTDLRTPLVDPADTEVKPLPEVGLESVLTESSLSYRRRVYLGAGIELKVLFRLALPAILIYLVNSGMGISARVFAGHVGSQELAAASIGNSCFNLVYGLMLGMGSAVETLCGQAYGAHRYEMLGIYLQRATIVLALVGLPMTLLYTFSYPILILLGEPKTVSYMGSKYIAGLIPQIFAYAVNFTAQKFLQAQSVVAPSAFISAAALILQILLTWITVYVMDMGFMGIAYVLTISWWVIVGSQCFYIAVSPKFRHTWTGLSWRSLQGLWSFFKLSAGSAVMICLEMWYSQILVLLAGLLENPARSLDSLSICMSISALSFMVSVGFNAAVSVRTSNELGAGNPKSAWFSTWTATFVSFVISVTEALAVIWFRDYVSYIFTEDADVAKAVSDLCPFLAITIILNGIQPVLSGVAVGCGWQTYVAYVNVGCYYVVGIPVGCILGFTFDFQAKGIWTGMIGGTLMQTLILLYVTYRTDWDKEVEKARKRLDLWDDKKEPLQN

SEQ ID NO: 15217 - protein, 227 aa, Arabidopsis thaliana
MVNGESSTSTSYSDNNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 15218 - protein, 294 aa, Arabidopsis thaliana
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 15219 - protein, 185 aa, Arabidopsis thaliana
MNAPPENEVCSICHGHFNAPCQSNCSHWFCGNCIMLVWRHGSTLRPCKCPLCRRPISLLVPSEETVRSRNDATVSEVLHDVETYNRVFGGQSSGLIQRMQDLPFLLRRLLREMMDPQRTLPLVIRARVYIALILSAIYIISPIDIIPEGVLGVIGLLDDLLIALICFLHVAALYRSVLYSRHGGS

SEQ ID NO: 15220 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEQPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 15221 - protein, 176 aa, Arabidopsis thaliana
MGYPVGYTELLLPRIFLHLLSLLGLIRTLIDTGFRILGLPDFLESDPVLSSSSWLEPPYMSTAAHHHQESSFFFPVAARLAGEILPVIRFSELTRPGFGSGSDCCAVCLHEFENEDEIRRLTNCQHIFHRSCLDRWMMGYNQMTCPLCRTPFISDELQVAFNQRVWSESELLAESN

SEQ ID NO: 15222 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLQHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 15223 - protein, 309 aa, Arabidopsis thaliana
MEITLNSGFKMPIIGLGVWRMEKEELRDLIIDAIKIGYRHLDCAANYKNEAEVGEALTEAFTTGLVKREDLFITTKLWSSDHGHVIEACKDSLKKLQLDYLNLLLVHIPIATKHTGIGTTDSALGDDGVLDIDTTISLETTWHDMEKLVSMGLVRSIGLSNYDVFLTRDCLAYSKIKPAVNQIETHPYFQRDSLVKFCQKHNICVTAHTPLGGATANAEWFGTVSCLDDPVLKDVAEKYKQTVAQIVLRWGIQRKTVVIPKTSKPERLEENFQVFDFQLSKEDMEVIKSMKRNYRTHQTAKFWGIELYA

SEQ ID NO: 15224 - protein, 320 aa, Arabidopsis thaliana
MVKKRLAVLVGCNYPNTRNELHGCINDVLAMKETILSRFGFKQDDIEVLTDEPESKVKPTGANIKAALRRMVDKAQAGSGDILFFHYSGHGTRIPSVKSAHPFKQDEAIVPCDFNLITDVDFRELVNQLPKGTSFTMISDSCHSGGLIDKEKEQIGPSSVSSNISPAIETTNKTITSRALPFKAVLDHLSSLTGITTSDIGTHLLELFGRDAGLKFRLPAMDLMDLLETMTAREKHVDSGILMSGCQADETSADVGVGNGKAYGAFSNAIQRVLNENEGAMKNKQLVMMARDVLERLGFHQHPCLYCSDQNADATFLSQP

SEQ ID NO: 15225 - protein, 569 aa, Arabidopsis thaliana
MAMEVGEMSQPEATASLLSLASATQQPYVSELLSFTLDRLHKEPELLRVDAERIQRQMQEVAVGNYRAFITAADALLAIRQEVSSIDKHLESLIGEVPKLTSGCTEFIDSAENILEKRKMNQALLANHSTLLDLLEIPQLMDTCVRNGNFDEALDLEAFVSKLATLHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFSDDTSGSEENYDGGLLFSSAMHQITSHLKTLKIMLPKITEGGSLSNILDQCMYCAMGLGGVGLDFRGLLPPLFEEAVLNLFSKNMSTAVENFQLVLDSHRWVPLPSVGFPSSGINEDSKDDVTPPSYLMEHPPLAVFINGVSSALNELRPCAPLSLKNVVAHELIKGLQAVSDSLLRYNTTRMLRLSESNLFLSLCRAFVEVVFPHCATCFGRCYPGGATIVMDAKSAYEGLGRILAASSSQEPSNKSPKVISTDTKDASENGVASQPEEKQAENPNAKEEDNSPIPLQTPEITPES

SEQ ID NO: 15226 - protein, 101 aa, Arabidopsis thaliana
MSQQPPAVGVPPSHAYPAEGPPKDAYPPPGQPYPQQGYPPPQGYPQQGYPPQGYPPQGYPEQGYPQQGYPPQQQQQQKHSPGMLEGCIAALCCCCVLDACF

SEQ ID NO: 15227 - protein, 320 aa, Arabidopsis thaliana
MVKATKAEKKIAYDTKLCQLIDEYTQILVVAADNVGSTQLQNIRKGLLGDSVVLMGKNTMMKRSVRIHSENTGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATEYTFPQAEKVKEYLKDPSKFAVASVAAVSADAGGGAPAAAKVEEKEESDEEDYGGDFGLFDEE

SEQ ID NO: 15228 - protein, 271 aa, Arabidopsis thaliana
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 15229 - protein, 240 aa, Arabidopsis thaliana
MDARKRGRPEAAASHNSNGGFKRSKQEMESISTGLGSKSKPCTKFFSTSGCPFGDNCHFLHYVPGGYNAAAQMKNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 15230 - protein, 166 aa, Arabidopsis thaliana
MASADEKVVEEKASVISSLLDKAKGFFAEKLADIPTPEATVDDVDFKGVTRDGVDYHAKVSVKNPYSQSIPICQISYILKSATRTIASGTIPDPGSLVGSGTTVLDVPVKVAYSIAVSLMKDMCTDWDIDYQLDIGLTFDIPVVGDITIPVSTQGEIKLPSLRDFF

SEQ ID NO: 15231 - protein, 202 aa, Arabidopsis thaliana
MAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEHLEKKKAEYVEQMKNKIAQIHKEAEEKRAMIEAKRGEEILKAEELAAKYRATGTAPKKLFGCM

SEQ ID NO: 15232 - protein, 353 aa, Penicillium marneffei
MGCGMSTEDKEGKARNEEIENQLKRDKMMQRNEIKMLLLGAGESGKSTILKQMKLINEGGYSRDERESFKEIIYSNTVQSMRVILEAMESLELPLEDPRAEYHVQTIFMQPSQIEGDSLPPEVGGAIQALWHDAGVQECFRRSREYQLNDSAKYYFDSIERIAQPDYLPSDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGADYAAACDYILNRFVSLNQAEQKQIYTHFTCATDTNQIRFVMAAVNDIIIQENLRLCGLI

SEQ ID NO: 15233 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 15234 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIEVVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPNDDEDEEDEENLSKVNSQLQLSGNSGQAKRVSA

SEQ ID NO: 15235 - protein, 309 aa, Arabidopsis thaliana
MDYVRTQVEAVFDDSEQDGSTISESGSCDSSSDRSFADELGLMELLEGDKAHDLIFRNCKSGLGDQCQILSVLRNGFRNVGSRAKLKTFQVFQEAVQMKHGGHGGAKVKYGWCSVSKHELKTIFEYGFSEPLRNDGSFGRGLYLSPDNSPLDCLKDSASESEDGMRFLLLCRVLLGKSEIVPQGSTRSCPSSPEFDSGVDDLVSTKKYIVWSTHMNTHVLPEFLVCIKALFNLTRSPKRLRSPWMAFPVLIKTLSKFLPPSQILVIQKHYKDQQNRRITRSELIQRVRSITGDKLLVHIIKACGHKVQH

SEQ ID NO: 15236 - protein, 261 aa, Arabidopsis thaliana
MWNLASKSIREGFISKGEEAATKPRRATLDRSGDGRKTTKEEKLECPICWESFNVVENVPYVLWCGHTICKYCLLGLQRAIVIKSSALPFQLPFFVACPWCNILSLRLVCNGTIRFPSKNFYLLWMVESMNGSRSEAPSDNKRVASGQRDLRNRCDGMSNTALGDEGLLDNRSWWNGVTRGFFRTGRLHDSVRKSMALVAHLLAKFPLVVIFLLMALYAIPVSAAVLGVYFFVTFALAVPSFLVLYFAFPSLNWLIREIAT

SEQ ID NO: 15237 - protein, 271 aa, Arabidopsis thaliana
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYERTHNHTGPHASVSRTVKLDLVQGGLEPVEEKKERGTIQEVLVQQMASSLTKDPKFTAALATAISGRLIEHSRT

SEQ ID NO: 15238 - protein, 243 aa, Arabidopsis thaliana
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSSALLNFPLRVNSGEPDPVRITSKRSSSSSSSSSSSTSSSENGKLKRRRKAENLTSEVVQVKCEVGDETRVDELLVS

SEQ ID NO: 15239 - protein, 179 aa, Arabidopsis thaliana
MVAATVNLANMTWTSLNSNPAISFSMLSGIRNLGMLPFRRCLKPTVIGIASWPPLRCSSVKAMSSSSSSSGSTLEETVKTTVAENPVVVYSKTWCSYSSQVKSFFKSLQVEPLVVELDQLGSEGSQLQNVLEKITGQYTVPNVFIGGKHIGGCSDTLQLHNKGELEAILAEANGKNGQT

SEQ ID NO: 15240 - protein, 393 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 15241 - protein, 338 aa, Arabidopsis thaliana
MSPEEELQTNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAAAPRAMEKSKMRA

SEQ ID NO: 15242 - protein, 301 aa, Arabidopsis thaliana
  unsure (1)..(301): unsure at all Xaa locations
MVFVKSTKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEELYKKVHAAIRAXPNXRKTVKPAPKQHKRYNLKKLTYEERKNKLIERVKALNGAGGDDDDEDDEZ

SEQ ID NO: 15243 - protein, 373 aa, Arabidopsis thaliana
MSESAKPYFAMVCLQFGYAGMNLVTKVVLDRGMSHYVLVAYRNAFATAAIAPFALLSERKVRPKMTFPIFMQIFVLALLGPLIDQNLYYACLKLTSPTFAGAVTNIVPALTFIISIICRMEKVEMRKVRFQAKVVGTLVIVVGAMLMILFKIPLITFLRSHLTGHALSPAGEDYLKATVFLLIASFSWASFFVLQAATLKRYSSHLSLSTMVCFMGTLQSTALTFVMEPNLSAWNIGFDMNLLASAYAGIMSSSIAYYVQGMMTKQKSVIFVTAFNPLVVIIGSIIGFLILNQTLNLGGVLGMAILVVGVCTVLWGKEGDIDEEENIEEKFVEIVKCCNRCDIKVLSMMPRIDEEVDVEMQSAGTAKVAVGFS

SEQ ID NO: 15244 - protein, 309 aa, Arabidopsis thaliana
MEITLNSGFKMPIVGLGVWRMEKEGIRDLILNAIKIGYRHLDCAADYRNETEVGDALTEAFKTGLVKREDLFITTKLWNSDHGHVIEACKDSLKKLQLDYLDLFLVHFPVATKHTGVGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPVLKDVAEKYKETVAQVVLRWGIQRKTVVIPKTSKPARLEENFQVFDFELSKEDMEVIKSMERKYHANQPAKFWNIDLYA

SEQ ID NO: 15245 - protein, 344 aa, Arabidopsis thaliana
  unsure (1)..(344): unsure at all Xaa locations
MKSLSFFFTILLSLSTLFTISNARKFNVGGSGAWVTNPPENYESWSGKNRFLVHDTLYFSYAKGADSVLEVNKADYDACNTKNPIKRVDDGDSEISLDRYGPFYFISGNEDNCKKGQKLNVVVISARIPSTAQSPHAAAPGSSTPGSMTPPGGAHSPKSSSPVSPTTSPPGSTTPPGGAHSPKSSSAVSPATSPPGSMAPKSGSPVSPTTXPPAPPKSTSPVSPSSAPMTSPPAPMAPKSSSTIPPSSAPMTSPPGSMAPKSSSPVSNSPTVSPSLAPGGSTSSSPSDSPSGSAMGPSGDGPSAAGDISTPAGAPGQKKSSANGMTVMSITTVLSLVLTIFLSA

SEQ ID NO: 15246 - protein, 228 aa, Arabidopsis thaliana
MGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 15247 - protein, 305 aa, Arabidopsis thaliana
  unsure (1)..(305): unsure at all Xaa locations
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAXVLPXPIETSSSSDDPPXSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 15248 - protein, 282 aa, Arabidopsis thaliana
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 15249 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLNKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 15250 - protein, 333 aa, Arabidopsis thaliana
MSATTSKTDQKAALDIASWLFNVVTSVGIILVNKALMATYGFSFATTLTGLHFGTTTLLTTFLTWLGYIQPSQLPWPDLLKFVLFANFSIVGMNVSLMWNSVGFYQIAKLSMIPVSCLLEVMLDNVRYSRDTKLSILLVLAGVAVCTVTDVSVNLNGFLAAAIAVWSTALQQYYVHYLQRKYALGSFNLLAHTAPVQAASLLLVGPFLDYWLTNQRVDAYNFSFVSLFFLILSCSIAVGTNLSQFICIGRFTAVSFQVLGHMKTILVLVLGFTFFGKEGLNLQVVLGMLIAILGMIWYGNASSKPGGKERRSLSIPITKSQKLSETNESDEKV

SEQ ID NO: 15251 - protein, 431 aa, Arabidopsis thaliana
MGLSLRVRRRGGSVSKKEIIPVTSCSEEVEITIPSQFQCPISYELMKDPVIIASGITYDRENIEKWFESGYQTCPVTNTVLTSLEQIPNHTIRRMIQGWCGSSLGGGIERIPTPRVPVTSHQISEICERLSAATRRGDYAACMEMVTKMKRLGKESERNRKCVKENGAGLVLCVCFDAFSENANASLLLEETVSVLTWTLPIGSEGQSKLTTTSSFNRLVELLKNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 15252 - protein, 397 aa, Arabidopsis thaliana
MGLVDSLLGKDARKFLRKDSDAAEAGRALEELRSSLYNELKTSEGAKRQQQRFCGPVVAMSFNFVVAVGIILANKLVMGRVGFNFPIFLTLIHYTVAWILLAFFKSLSLLPMSPPSKTTPFSSLFSLGAVMAFASGLANTSLKHNSVGFYQMAKIAVTPTIVLAEFVLFKKTISSTKVMALAVVSLGVAIATVTDLEFNLFGALVAVAWIIPSAINKILWSNLQQQANWTALALMWKTTPFTVFFLLALMPWLDPPGVLLFKWDLTNSSAILISALLGFLLQWSGALALGATSATSHVVLGQFKTCVILLGGYVIFGSDPGFISICGAVAALGGMSVYTWLNLPGKSIDHMSNKQLPKQNVTVSKPKAEADDGGGETGVTVVSVDPLLSKTITANIV

SEQ ID NO: 15253 - protein, 291 aa, Arabidopsis thaliana
MGGAAAIVAKSAAAPIERVKLLLQNQGEMIKTGHLIRPYTGLGNCFTRIYREEGVLSFWRGNQANVIRYFPTQASNFAFKGYFKNLLGCSKEKDGYLKWFAGNVASGSAAGATTSLFLYHLDYARTRLGTDAKECSVNGKRQFKGMIDVYRKTLSSDGIKGLYRGFGVSIVGITLYRGMYFGMYDTIKPIVLVGSLEGNFLASFLLGWSITTSAGVIAYPFDTLRRRMMLTSGQPVKYRNTIHALREILKSEGFYALYRGVTANMLLGVAGAGVLAGYDQLHQIAYKHWVQ

SEQ ID NO: 15254 - protein, 347 aa, Arabidopsis thaliana
MGSFVKEETSSLMTDFLEKCGGYEVVDGGFATELQRHGADINDPIWSAKCLITSPHLVTKVHLDYLESGANIIITASYQATIQGFVAKGLSVGEAENLLRRSVEITYEAREIFYNRWTKGSWDFAYAGKASRRPILVAASVGSYGAYLADGSEYSGIYGDSVSKETLKDFHRRRVQILAKSGADLIAFETIPNKLEAEAYADLLEEEDIDIPAWFSFTSKDGVSVPRGDSVVECAKVADSCKNVVAIGINCTAPRYIHALIISLRQMTRKPIVVYPNSGEVYDGLNKKWIKSEGESEEDFVSYVSKWRDAGASLFGGCCRTTPNTIRAIAKVLSDEPSAASKPKFGQ

SEQ ID NO: 15255 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWNKQDPRYMATIIMDSAKVVVLDIRFPALPVVELQRHQASVNAIAWAPHSSCHICTAGDDSQALILDISSMGQHVEGGLDPILAYTAGAEIEQLQWSSSQPDWVAIAFSTKLQILRV

SEQ ID NO: 15256 - protein, 323 aa, Arabidopsis thaliana
MVKATKAEKKIAYDTKLCQLIDEYTQILVVAADNVGSTQLQNIRKGLRGDSVVLMGKNTMMKRSVRIHSENSGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATNYTFPQAEKVKEFLKDPSKFVVAAAAVSADAGGGSAQAGAAAKVEEKKEESDEEDYEGGFGLFDEE

SEQ ID NO: 15257 - protein, 333 aa, Arabidopsis thaliana
MSKARVYTDVNVVRPKEYWDYKSLVVQWGHQDDYEVVRKVGRGKYSEVFEGKNVNTNERCVIKILKPVKKKKIKREIKILQNLCGGPNIVKLYDIIRDEHSKTPSLVFEFVNSVDFKVLYPTLTDYDIRYYIYELLKALDFCHSQGIMHRDVKPHNVMIDHQLRKLRLIDWGLAEFYHPGKEYNVRVASRYFKGPELLVDLQDYDYSLDMWSLGCMFAGMIFRKEPFFYGHDNHDQLVKIAKVLGTNELDHYLNKYQLDLDPQLEALVGRHVPKPWSKFINADNQHLVSPEAIDFLDKLLQYDHQDRLTAREAMDHPYFAQVKAAESSRLRTQ

SEQ ID NO: 15258 - protein, 269 aa, Arabidopsis thaliana
MEGCPRNREIGPKLLDLIPQGRKWYQEDKNNTDQEKKLELRLGPPGGDEEDHSAIKKKNTEIRNIKKETEHKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 15259 - protein, 238 aa, Arabidopsis thaliana
MNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 15260 - protein, 426 aa, Arabidopsis thaliana
METPGASHDSFRGSPRRNSILSASNIIQAPISTLLEYSGLFRSRPSPSHEAETLVSDDSSGLSNGEVAIRIIGNTEQDAETDTNALREPGHSELLGSSATQVDPMGGASEGASQAAPGDPAAGDAASRDSPYQRYDIQQAARWIEQILPFSLLLLVVFIRQHLQGFFVAIWIAAVMFKSNDILKKQTALKGERHISALIGISVAFTAHVVGVYWWFRKDDLLYPLIMLPPKSIPPFWHAIFIIVVNDTLVRQASMIFKCFLLMYYKNSRGRNYRKQGQLLTLVEYFMLLYRSLLPTPVWYRFFLNKDYGSLFSSLMTGLYLTFKLTSVVEKVQSFFTALKALSRKEVHYGSYATTEQVNAAGDLCAICQEKMHTPILLRCKHMFCEDCVSEWFERERTCPLCRALVKPADLKSFGDGSTSLFFQIF

SEQ ID NO: 15261 - protein, 379 aa, Arabidopsis thaliana
MVLPWRSRGGVAKRRNQLISGDISVVETKIPVQLRSPSRIERIQSPRVLLTPRDAVEISRRLENAAARKEYAECLEIVSKIKNLGRGGDTNKKCLVQNGSVLALSSCFERFAAARDGHMRLLEEILFVLSSWLPLNRSEGFNKMGSTASLNCLVRFLNGKDAKTRQNAAFCIREVIAVDKRYVYALTDVEGACEGLVKIIRDSVSTSSTKASLMVIYRAISSNDKITEKFVKLGLVELITEMMVNNAENSVCERSLVVLNATCDNEQGKEDVLRNALIVPLLVKKILRVSDLATQCSVSILWKLWKNKKDGECDDRLLVEALQVGAFEKLLVLLQVGCEDKTKEKASELLRNLNRCRNEIEKTNCVDSSMHLKNVKKSF

SEQ ID NO: 15262 - protein, 326 aa, Arabidopsis thaliana
MAEGLVLKGTMCAHTDMVTAIATPVDNSDVIVTSSRDKSIILWKLTKEDKSYGVAQRRMTGHSHFVQDVVLSSDGQFALSGSWDGELRLWDLATGESTRRFVGHTKDVLSVAFSTDNRQIVSASRDRTIKLWNTLGECKYTISEADGHKEWVSCVRFSPNTLVPTIVSASWDKTVKVWNLQNCKLRNTLAGHSGYLNTVAVSPDGSLCASGGKDGVILLWDLAEGKKLYSLEAGSIIHSLCFSPNRYWLCAATENSIRIWDLESKSVVEDLKVDLKAEAEKTDGSTGIGNKTKVIYCTSLNWSADGNTLFSGYTHGVIRVWGIGRY

SEQ ID NO: 15263 - protein, 363 aa, Arabidopsis thaliana
MVLVQIGYAGMNITSKMAMEAGMKPLILVAYRQIFATIATFPVAFFLERKTRPKITLRILVQVFFCSITGATGNQVLYFVGLQNSSPTIACALTNLLPAVTFLLAAIFRQETVGIKKASGQTKVIGTLVCVIGAMVLSFYHGHTIGIGESKIHWAYAENITKHGSSSGHSNFFLGPFLIMAAAVSWAAWFIIQTKMSETFAAPYTSTLLMCLMGSIQCGAIALISDHTISDWSLSSPLRFISALYAGVVASALAFCLMSWAMQRKGPLYVSVFSPLLLVVVAIFSWALLEEKLYTGTFMGSALVVIGLYGVLWGKDREVSEKEEEREKVKQQNHKVKSESNEDIESRLPVASSGNGSTRSTSP

SEQ ID NO: 15264 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 15265 - protein, 381 aa, Arabidopsis thaliana
MELKNVKDAFDRVTKKQKLCYSKTHEVVEKMSQEIDKALKTIQEDNHESVVADLKKTFEEIAPINLLEASQKEINGVLTKYPKALDKTLNPDISTAYRNVKFDTHTVHQILAQFFYRQGMYGVGDCFISETGEVKPESSVTKAFMEMNMILEAMKERDLGPALKWVASNSDKLKEAKSDLELKLHSLHFLEIAKDKTSEEAINYARKHFATYSADSCCFPEIQKLMCSLLWNRNLNKSPYSEFLSPVLWTNAAKELTRQYCILLGESPESPLSVTVAAGSQVLPTFLKYLNVLPEKRKEWQTMEQLLVPVELSEEYRFYSVFVCPVSKEHSSEDNPPMRLACGHVLCKQSINRMSRNGSRSFKCPYCPTDIDASQCKQLYF

SEQ ID NO: 15266 - protein, 300 aa, Arabidopsis thaliana
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTSLSSHRRKGLGVFGGKQRTSSLPSPKTDIDEVNFQTRSQIDTEIARMKSMNVHEAAAVAAQAVAEAEAAMAEAEEAAKEAEAAEAEAEVAQAFAEEASKTLKGRNICKMMIRA

SEQ ID NO: 15267 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRTASGGGGVVVVTALSPTGSDVSEQSQSSGSVLPVSSSCHVFKPTARAGGVVIESSSSEEEEKDPMTCLSLSLPWVNESTTPVELFPVKREEEEEKEREISGLGGDFMTVVQEMIKTEVRSYMADLQLGNGGGAGGGASSCMVQGTNGRNVGFREFIGLGRIE

SEQ ID NO: 15268 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTLVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 15269 - protein, 377 aa, Arabidopsis thaliana
MHKLRPYLLMIFLQFGAAGTYIVIMATLNQGQNRYVVIVYRNLVAALVLAPFALIFERKVRPKMTLSVLWKIMALGFLEPVLDQGFGYLGMNMTSATYTSAIMNILPSVTFIIAWILRMEKVNIAEVRSKAKIIGTLVGLGGALVMTLYKGPLIPLPWSNPNMDQQNGHTNSSQDHNNWVVGTLLILLGCVAWSGFYVLQSITIKTYPADLSLSALICLAGAVQSFAVALVVERHPSGWAVGWDARLFAPLYTGIVSSGITYYVQGMVMKTRGPVFVTAFNPLCMILVALLASFILHEQIHFGCVIGGAVIAAGLYMVVWGKGKDYEVSGLDILEKNSLQELPITTKSEDDNKLVSSISDNSNVTIPGGAHSNTSGI

SEQ ID NO: 15270 - protein, 298 aa, Arabidopsis thaliana
MGKEVMVSDYGDDDGEDAGGGDEYRIPEWEIGLPNGDDLTPLSQSLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGKMVTYPSVGGGDVNDK

SEQ ID NO: 15271 - protein, 379 aa, Arabidopsis thaliana
  unsure (1)..(379): unsure at all Xaa locations
MDGSKHPSVFQKLHGQSYLINRLSPSVQARGYCVSGAYVNGGLQSLLQPTSHGVGSSLIPHGSFPVLAHAPSEKTGTGFLIYFLMGGVSAAVSKTAAAPIERVKLLIQNQDEMIKAGRLSEPYKGISDCFARTVKDEGMLALWRGNTANVIRYFPTQALNFAFKDYFKRLFNFKKEKDGYWKWFAGNLASGGAAGASSLLFVYSLDYARTRLANDAKAAKKGGQRQFNGMVDVYKKTIASDGIVGLYRGFNISCVGIVVYRGLYFGLYDSLKPVVLVDGLQDSFLASFLLGWGITIGAGLASYPIDTVRRXMMMTSGEAVKYKSSLQAFSQIVKNEGAKSLFKGAGANILRAVAGAGVLAGYDKLQLIVLGKKYGSGGG

SEQ ID NO: 15272 - protein, 471 aa, Arabidopsis thaliana
MAKLAIFTTLMAILVMTSQGRIPTEGGEKEAEADRITSLPGQPNVTFEQFSGYVTVDKLSGRSLFYWLTEASDLPLSKPLVIWLNGGPGCSSVAYGASEEIGPFRISKGGSGLYLNKFAWNSISNLLFLEAPAGVGFSYTNRSSDLFNTGDRRTAKDSLQFLIQWLHRFPRYNHREIYITGESYAGHYVPQLAKEIMNYNKRSKNPLNLKGIMVGNAVTDNHYDNLGTVSYWWSHAMISDRTYHQLISTCDFSRQKESDECETLYSYAMEQEFGNIDQYNIYAPPCNKSSDGGGSYNGSSGRRSMRLPHLPHSVLRKISGYDPCTERYAEIYYNRPDVQKALHANTTKIPYKWTACSEVLNRNWNDTDSTVLPIYREMIAGGIRVWVFSGDVDSVVPVTATRYSLARLSLSTKLPWYPWYVKKQVGGWTEVYEGLTFVTVRGAGHEVPLFKPRAAFELFKYFLRGKPLPKA

SEQ ID NO: 15273 - protein, 358 aa, Arabidopsis thaliana
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGEAEKSANRKRKNQYRGIRQRPWGKWAAEIRDPREGARIWLGTFKTAEEAARAYDAAARRIRGSKAKVNFPEENLKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 15274 - protein, 157 aa, Arabidopsis thaliana
  unsure (1)..(157): unsure at all Xaa locations
MNTIVVAQLQRQFQDYIVSLYQQGFLDNQFSELRKLQDEGTPDFVAEVVSLFFDDCSKLINTMSISLERPDNVDFKQVDSGVHQLKGSSSSVGARRVKNVCISFKECCDVQNREGCLRCLQQVDYEYKMLXTKLQDLFNLEKQILQAGGTIPQVDIN

SEQ ID NO: 15275 - protein, 628 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNRGMIRETSSTLFEELGFHYVGPVDGHNIDDLVSILETLKSTKTIGPVLIHVVTEKGRGYPYAERADDKYHVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 15276 - protein, 302 aa, Arabidopsis thaliana
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGSSASTPVAANRRSSLTVPVTTVDMIESKKVTSPTSRIDFPQVQKLLVEQMASSLTKDPNFTAALAAAVTGKLYQQNHTEK

SEQ ID NO: 15277 - protein, 267 aa, Arabidopsis thaliana
MEGYSRNGEISPKLLDLMIPQERRNSFHDEKNSVFKTEEKKLELKLGPPGEEDDDESIIRHMKKEPKDKSILSLAGKHFSPSSTKTTSHKRTAPGPVVGWPPVRSFRKNLASGSSSKLGNDSTTSNGVTLKNQKCDDAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 15278 - protein, 367 aa, Arabidopsis thaliana
MARKYFQREVLPVTALVIMECANVGLNTLFKAATLKGMSFHVFIVYSYGLAALLLLPSLFCSFRSRTLPPMNFSILYKIVLLGIIGCCSNIMGYTGINYSSPTLASAISNLTPAFTFLLAVVFRMDSVSFKRTSSVAKMLGTVVSIGGAFIVTLYNGPVVIAKSPPSVSLRSQSTNPNWILGAGFLAVEYFCVPLWYIVQTQIMREYPAEFTVICFYSIGVIFWTALVTLFTEGNDLGAWKIKPNIALVSIVCSGLFGSCINNTIHTWALRIKGPLFVAMFKPLSIAIAVAMGVIFLRDSLYIGSLIGATVITIGFYTVMWGKAKEVALVEDDNKANHEEANEADLDSPSGSQEAPLLESYKNDEHV

SEQ ID NO: 15279 - protein, 270 aa, Arabidopsis thaliana
MWGFASNVIGSMGLKKSPKDSAQASSQCSDDEVSNISRDEEGLECPICWESFNIVENVPYVLWCGHTLCQNCVFGLQSAVLRLSSQDIRIPFFVSCPWCQLLSFRIVYKGNLKFPRKNFFLLWMVESLNGDRTSHGDRTSHGSLVTDNQQSAPTLRCSMSLGNHISNNNLVARPLLRNQSTDLLPHHDHSNQPSRQLFSFHKSLDFFISFTSKFPFVIIFLLIVFFAIPGSLIILALYFLLTILFAVPAGLVLYFAYPILERLVNEITSS

SEQ ID NO: 15280 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 15281 - protein, 532 aa, Mus musculus
MERTEESAPGPGGADAASERRGLRCLLLPGFLEELRALLVLAGPAFLAQLMMFLISFISSVFCGHLGKLELDAVTLAIAVINVTGISVGHGLSSACDTLISQTYGSQNLKHVGVILQRGTLILLLCCFPCWALFINTEQILLLFRQDPDVSRLTQTYVMIFIPALPAAFLYTLQVKYLLNQGIVLPQIMTGIAANLVNALANYVFLYHLHLGVMGSALANTISQFALAIFLFLYILWRRLHQATWGGWSWECLQDWASFLRLAIPSMLMLCIEWWAYEVGSFLSGILGMVELGAQSITYELAIIVYMIPSGFSVAANVRVGNALGAGNIDQAKKSSAISLIVTELFAVTFCVLLLGCKDLVGYIFTTDRDIVALVAQVIPIYAVSHLFEGLACTCGGILRGTGNQKVGAIVNAIGYYVIGLPIGIALMFAAKLGVIGLWSGIIICTTCQTTCFLAFIARLNWKRACQQAQVHANLKVNVALNSAVSHEPAHPVCPESHGEIMMTDLEKKRRDSVGPADEPATSFAYPSKGQQ

SEQ ID NO: 15282 - protein, 281 aa, Arabidopsis thaliana
  unsure (1)..(281): unsure at all Xaa locations
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWXKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 15283 - protein, 335 aa, Arabidopsis thaliana
MAPVSKADKKAAVDAAAWMFNVVTSVGIIIVNKALMATYGYSFATTLTGLHFATTTLMTLVLRCLGYIQPSHLPFTELLRFILFANFSIVGMNVSLMWNSVGFYQIAKLSMIPVSCLLEMVFDKIRYSRDTKLSIGLVLVGVGVCTVTDVSVNTKRFVAAFVAVWSTALQQYYVHYLQRKYSLNSFNLLGHTAPAQAATLLVIGPFLDYWLTEKRVDMYDYNLVSVLFITLSCTIAIGTNLSQFICIGRFTAVSFQVLGHMKTILVLIMGFFFFGREGLNLHVVVGMIIAVLGMIWYGNASSKPGGKERRNYSLPTTRQQKLGAASDSDDNEDKA

SEQ ID NO: 15284 - protein, 430 aa, Homo sapiens
PRVRSASLCSSTAPHSRVTLTPPSQLSGAAMAWRRREAGVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANFSLALPDDDGSDESSPPSASPAESEPQCDPSFKGDAGENTALLEAGRSDSRHGGPIS

SEQ ID NO: 15285 - protein, 471 aa, Arabidopsis thaliana
  unsure (1)..(471): unsure at all Xaa locations
MAFSLLSPIPTSASLFFTLSAITASNNASSSSLSRLYSLYHPKGTLRTRTATSFFGASGNLRIVSMAENRQLVCRIGGGAXAELDDMDEGEIQRIGNEDEDDDEFIQVHANNSSAASPERWDVLGLGQAMVDFSGVVDDEFLKKLGLKKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 15286 - protein, 284 aa, Homo sapiens
LLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 15287 - protein, 450 aa, Nicotiana sylvestris
MPGLMACRTEFGPSQPFKGAKITGSLHMTIQTAVLIETLTALGAEVRWCSCNIFSTQDHAAAAIARDSRAVFAWKGETLQEYWWCTERALDWGPGGGPDLIVDDGGDATLLIHEGVKAEEEYAKSGKLPDPSSTDNAEFQLVLTIIRDGLKTDPLKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLEDVVSDVDIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWKEKSTGKYEKKVYVLPKHLDEKVAALHLGKLGARLTKLSKDQADYISVPVEGPYKPPHYRY

SEQ ID NO: 15288 - protein, 308 aa, Mastigocladus laminosus
MEPVLFQGRLLGIVELHYCSHTPHDLQAGELDLVKAIATQIGAALIQAEAYANLEDLNQQLEALDRTRSNLIAITGHELRTPLSTIQVCLESLANEPDMPLELRQVMLNTALADSERMRKLVQDFLTLSNLESGRVEWHPESLSLQECVDLALSRIRTRVATDPLPQIKTLISPNLPLVKADGDWLVEVIAKLVDNACKFTPPQGQITITANPNSDRMVEVTIADTGRGIEPNRLEIVFDRFYQEEGALRRTAGGTGLGLAICRQIVNGWGGQIWATSNGKNQGSEFHFTIPIIEGSQEQTRTKVSKR

SEQ ID NO: 15289 - protein, 241 aa, Cicer arietinum
ILCHKSLESALSNYLAVKLSSVSVPSTTLVDLFVKVLESDKQIMDAVKYDLKVVNERDPACISHVHCFLNFKGFLACQAHRIAHDLWLKGRKVLAVMIQNRVSEVFGVDIHPGAKIGSGILLDHATGIVVGETAVIGNDVSILHGVTLGGTGKACGDRHPKIGDGVLIGAGTCILGNIKIGDGAKIGAGSVVIKDVPPRTTVVGNPAKLVGGKNNPVKLDKIPSHTMDHIAHISEFYDYCV

SEQ ID NO: 15290 - protein, 201 aa, Cicer arietinum
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 15291 - protein, 369 aa, Euplotes aediculatus
MDFIGLQKDEDSFANEKSETTTNMARRQLWSEDQDDAIRKLVAKHGTKKWAIIAKYLEEEYGVIGRSGKQIRERWNNHLNPDINKGPITLDEGIKIFDAHRRFGNKWAEITTMLPGRTDNTVKNYFYATVRRHLRKLNKCLRAPKFCEAFNIEPKQVKVNFLIDALELGNLNFFEISAIENKELIVLSKKKTGNYNKKMTSEEKELLPTLDGKGKPIDKNLKLLKELLTLVNCDLEKQHLGDEDDEESSEEIKSFSIKNETAKDEVISEPKISTNTNKRFKKLEIETFEEEKEEEKKEEKEDTESDGVNFHEIPEIPPPKQLDFSNKQDRIKIYENIYQKRREQKRLGRCSQYFQIIENLFSVIQSLKK

SEQ ID NO: 15292 - protein, 528 aa, basidiomycete C30
MSKFQSLAAFIALSLSTGRLAAAAIGPKADLTISNANISPDGFTRAAVVANNQFPGPLITGNKGDNFQINVIDNLSNDTMLTSTTIHWHGFFQKGTNWADGPAFVNQCPISEGNSFLYDFSAADQAGTFWYHSHLSTQYCDGLRGVMVVYDPNDPHQSLYDVDDESTVITLSDWYHTAARLGPRFPLGADTVLINGLGRFATGDPDAELAVITVTKGKRYRFRLANISCDPNFTFSIQGHTMNVIEVDSVNVTPYEVDSIQTFAGQRYSFVLTADQDVDNYWMWAIPNVGTINTDGGVNSAILRYDGAAEIEPEAASPSVNNQLVESNVVPLTDVAAPGNPTVGGVDYALNLDFSFDGTNFAINGESYTSPSVPVLLQILSGAQTAPDLLPNGSVYVLPSNATVELSFPMTATNAPGAPHPFHLHGHTFYVVRSAGQTDYNYVNPPQRDTVSVGAAGDNVTIRFRTDNPGPWFLHCHIDFHLEAGFAVVFAEDTPNVASVNKPSAAWEDLCPTYNSVYPNGDSGDARR

SEQ ID NO: 15293 - protein, 204 aa, Arabidopsis thaliana
MELKNTIFLVILLSITILQSSSATPNRSESDQFIVSSCQTTQYPSLCVHTLSAYATKIRHNNDQDLAQTALIISLARAKSVTIFVAKLTKETPRFKRREYLAIKDCIEVLGNSVDRLAQSVKELARAGHAVASEDFMWKMSNVQTWVSAALTDETTCLDGFSERAMGGKVKRLIRYKVVHVAQVTSNALALVNQFAEKRSVKFP

SEQ ID NO: 15294 - protein, 168 aa, Arabidopsis thaliana
MATATYPPPPPYYRLYKDYSENPNSAPEPPPPIEGTYVCFGGNYTTEDVLPSLEEQGVPQLYPKDSNLDYKKELRSLNRELQLHILELADVLVDRPSQYAKRIGEISSIFKNLHHLLNSLRPHQARATLIHIMELQIQQRKQAVEDIKRRREEAQRLLKDAYLTLDGQ

SEQ ID NO: 15295 - protein, 503 aa, Arabidopsis thaliana
MSTIEDGFPADKLFAQGYSYTYDDVIFLPHFIDFSTDAVSLSTRLSRRVPLSIPCVSSPMDTVSESHMAAAMASLGGIGIVHYNCDIAAQASIIRQAKSLKHPIASDAGVKLPEYEITSVDAFGPSSFVFVEQTGTMTTPKLLGYVTKSQWKRMNYEQREMKIYDYMKSCDSSDYCVPWDIDFEKLEFVLEDKQKGFVVLERDGETVNVVTKDDIQRVKGYPKSGPGTVGPDGEWMVGAAIGTRESDKERLEHLVNAGVNAVVLDSSQGNSIYQLEMIKYVKKTYPELDVIGGNVVTMYQAQNLIQVGVDGLRVGMGSGSICTTQEVCAVGRGQATAVYKVCSIAARSGIPVIADGGISNSGHIVKALVLGASTVMMGSFLAGSTEAPGGYEYTNGKRIKKYRGMGSLEAMTKGSDQRYLGDKTKLKIAQGVVGAVADKGSVLKLIPYTMHAVKQGFQDLGASSLQSAHGLLRSNILRLEARTGAAQVEGGVHGLVSYEKKSF

SEQ ID NO: 15296 - protein, 335 aa, Arabidopsis thaliana
MKFCKKYEEYMQGQKEKKNLPGVGFKKLKKILKRCRRNHVPSRISFTDAINHNCSRECPVCDGTFFPELLKEMEDVVGWFNEHAQKLLELHLASGFTKCLTWLRGNSRKKDHHGLIQEGKDLVNYALINAVAIRKILKKYDKIHESRQGQAFKTQVQKMRIEILQSPWLCELMAFHINLKESKKESGATITSPPPPVHALFDGCALTFDDGKPLLSCELSDSVKVDIDLTCSICLDTVFDPISLTCGHIYCYMCACSAASVNVVDGLKTAEATEKCPLCREDGVYKGAVHLYELNILLKRSCRDYWEERRKTERAERLQQAKEYWDYQCRSFTGI

SEQ ID NO: 15297 - protein, 125 aa, Arabidopsis thaliana
MGSMFSGNRMSKEEMEVVVNKAKEIVSAYPVVVFSKTYCGYCQRVKQLLTQLGATFKVLELDEMSDGGEIQSALSEWTGQTTVPNVFIKGKHIGGCDRVMETNKQGKLVPLLTEAGAIADNSSQL

SEQ ID NO: 15298 - protein, 202 aa, Arabidopsis thaliana
MAKQYLFLILSISYLLSLELTAATAASQTGASKKAINFIQSSCKTTTYPALCVHSLSVYANDIQTSPKRLAETAIAVTLSRAQSTKLFVSRLTRMKGLKKREVEAIKDCVEEMNDTVDRLTRSVQELKLCGSAKDQDQFAYHMSNAQTWTSAALTDENTCSDGFSGRVMDGRIKNSVRARIMNVGHETSNALSLINAFAKTY

SEQ ID NO: 15299 - protein, 245 aa, Arabidopsis thaliana
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDESEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 15300 - protein, 298 aa, Arabidopsis thaliana
MLTTPTRFVALRIPFRSSNKIPISIAPSPKVFPRKPVIRVPASLRFVATMSTPAAAVDATVTVTDAGRGSITHVIFDMDGLLLDTEKFYTEVQEKILARYNKTFDWSLKAKMMGRKAIEAARLFVDESGISDSLSAEDFIVERESMLQDLFPTSDLMPGASRLLRHLHGKGIPICIATGTHTRHFDLKTQRHRELFSLMHHVVRGDDPEVKEGKPAPDGFLAASRRFEDGPVDPRKVLVFEDAPSGVQAAKNAGMNVIMVPDPRLDKSYCNVADQVLASLLDFKPEEWGLPSFQDSHN

SEQ ID NO: 15301 - protein, 545 aa, Arabidopsis thaliana
  unsure (1)..(545): unsure at all Xaa locations
MRHVFVEVLVLISLVILELSYAFAPISSYQWVVSYSQRFILGGNKQVIVINDMFPGPILNATANDIIVVNIFNNLPEPFLMTWNGLQLRKNSWQDGVRGTNCPILPGTNWTYRFQVKDQIGSYFYFPTLLLQKAAGGYGAIRIYPPELVPVPFPKPDEEYDILIGDWFYLDHTVMRASLDAGHSLPNPDGILFNGRGPEETFFAFEPGKTYRLRISNVGLKTCLNFRXQDHDMXLVETEGTYVQKRVYSSLDIHVGQSYSILVTAKTDPVGIYRSYYIFATARFTDSYLGGIALIRYPGSPLDPVGQGPLAPALQDFGSSVEQALSIRMDLNVGAARSNPQGSYHYGRINVTRTIILHNDVMLSSGKLRYTINGVSFVYPETPLKLVDHFQLNDTIIPGMFPVYPSNKTPTLGTSVVDIHYKDFIHIVFQNPLFGLESYHIDGYNFFVVGYGFGAWSESKKAGYNLVDAVSRSTVQVYPYSWTAILIAMDNQGMWNVRSQKAEQWYLGQELYMRVKGEGEEDPSTIPVRDENPIPGNVIRCGKVR

SEQ ID NO: 15302 - protein, 309 aa, Arabidopsis thaliana
MEEEYESRRLRRCEELDTDILVRIFQKFSVFELTSGLAHVCRGWRAACCDPILWKTVDLSNMRSSFIKIPLEPYVYVERRSDEALTRILKLSMNLSGGSTRTLIFHFNLFLSDDQLTYTAERCPGLRRVVLPAWNRIKKTGICKAIRIWKDLESLTMPSIANPPYLLTEIAKNCKNFKELKIMGPFEVFFANTLITCLPNIKTLSIRCSAIKREALMKILDGLPSLEVLNISHSHLVEYSGWQPQQKVIVRELDKTIMEKTARLKKFLTCMDHKTCVMCQRTENDEGIVRWYKYEEGDWKVDEVSSLHL

SEQ ID NO: 15303 - protein, 203 aa, Arabidopsis thaliana
MARNLKSMMLCGFGLLCFLMIVDRAYAREFTVGGATGWTVPSGSQVYSQWAEQSRFQIGDSLLFVYQSNQDSVLQVTRDAYDSCNTDSPTAKFADGKTSVTLNHSGPYYFISGNKDNCKKNEKLVVIVMADRSGNKNTASSPPSPAPAPSGESAPSPPVSGTFEMTPAPTPTTSEDTPNSGASSLSFVAALLGAALASTLFLH

SEQ ID NO: 15304 - protein, 384 aa, Arabidopsis thaliana
MFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 15305 - protein, 214 aa, Arabidopsis thaliana
MFLRSLNLCTILLFLAISSQVSQSLHFELQSGRTKCISEDIKSNSMTVGKYTVVNPNEAHPSPQSHKISIRVTSSYGNTYHHAEDVESGQFAFTAVESGDYMACYTAVDQKPEVTLSIDFDWRTGVQSKSWSSVAKKSQVEVMEFDVKRLIETVNSIHEEMFYLREREEEMQNLNRATNSKMAWLSFLSLFVCLGVAGMQFVHLKTFFEKKKVI

SEQ ID NO: 15306 - protein, 442 aa, Homo sapiens
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDYLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 15307 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFYIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 15308 - protein, 1191 aa, Homo sapiens
TRPSSGAVGPRQGSVGPRPAPGRAMAGAQPGVHALQLEPPTVVETLRRGSKFIKWDEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 15309 - protein, 489 aa, Homo sapiens
MPLRDETLREVWASDSGHEEESLSPEAPRRPKQRPAPAQRLRKKRTEAPESPCPTGSKPRKPGEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 15310 - protein, 249 aa, Physcomitrella patens
MVVPSLPAFGGQNAMLRRNIDNNTDTLISLLQGSCSPRVSMQQVPRSSESLENMMGACGQKLPYFSSFDGPSVEEQEDVDEGIDEFAHHVEKKRRLSLEQVRSLERNFEVENKLEPERKMQLAKELGLQPRQVAVWFQNRRARWKTKQLERDYETLKKAYDRLKADFEAVTLDTSALKAEVSRLKGISNDDVKPAEFVQGKCDTTSHPASPAQSERSDIVSSRNRTTPTIHVDPVAPEEAGAHLTIELG

SEQ ID NO: 15311 - protein, 359 aa, Magnaporthe grisea
MDSQRSNEVSPEAMQARIQQARREAETLKDRIKRKKDELADTTLRTVAQQAHEPIPKNQLMKAKRTLKGHLAKIYAMHWSTDRRHLVSASQDGKLIIWDAYTTNKVHAIPLRSSWVMTCAYAPSGNYVACGGLDNICSIYNLNQNRDGPTRVARELSGHAGYLSCCRFINDRSILTSSGDMTCMKWDIETGTKVIEFADHLGDVMSISLDPTNQNTFISGACDSFAKLWDIRAGKAVQTFAGHESDINAIQFFPDGHSFVTGSDDATCRLFDIRADRELNVYGSESILCGITSVATSVSGRLLFAGYDDFECKVWDITRGDKVGSLVGHENRVSCLGVSNDGMSLCTGSWDSLLKIWAY

SEQ ID NO: 15312 - protein, 393 aa, Drosophila melanogaster
MVNGDLRIQYYDEELNIRKVIEQADLEHLDQALNICDLSSLERKLRLWHKLMPRIEPHYAVKCNDDPVVVKFLADLGTGFDCASKNELKLVLGLGVSPERIIFAHPCRPASHLRYAKEQQVVNGTVDNEYEIYKLRKHYPDSNLIVRFKSEAKKALCPLGDKYGCDAEADAAALMLLAKALGLKVTGTSFHVGSGCSEVEAYDRAIEKAENIFKVGEMIGHKMELLDVGGGFPGIDDEMFEEIAQSVNTSVELRFPDKRIRIISEPGRFFVEAAYTLICKVHAKREVRSKDGKLDTMMYYLNDGIFGAFAGMFYYPEEVAPELYLDEAESLPKLKSVIWGPSCDAMDKISDLLLPNLNPGDLLGFRNMGAYTMPIASPFNGFDVPETRFFKAK

SEQ ID NO: 15313 - protein, 657 aa, Aspergillus fumigatus
MVRSQGSRSLNADEQTYHGRRMSSSPLAETAIARDLENYADNEDSINNTEDEEHSEASTVRAINSQPGTTPHSLVGSYQRPSFFTTVSHSTVVPHRGEPECLSWRERDQAIEEERRLLADNHVIPDKIRAGDQNGRRRRFSGLLSRSLRSGDSLESSSGVERRERTEAVAVPTETTSLLEAGNGGSGYSLRDAEAIDRKWEEAVVAGLIHTTWKREALVISRYAAPLTVTFLLQYSLTVASIFSVGHLGKKELGAVSLASMTANITGYAVYQGLATSLDTLCSQAYGSGKKKLVGLQMQKMVFFLWTITIPIALIWFFADMILLRIVPEKEVAKLAGLYLKVVALGAPGYACFESGKRYMQAQGLFSASLFVLLICAPFNAFMNWFLVWKVGLGFVGAPISVAITDWLMPFFLFLYVYFVAGSECWNGLTNRAFRNWGPMIQLALPGLVMVEAECLAFEVLTLASSWLGTTPLAAQSILSTIASITFQIPFPVSISGSTRVANLIGATLVDAAKTSAKVTMGGAVIVGLLNMIVLSSLRHYIPLLFTSDEEVIKLVAGVLPLCAAFQLFDALAANCNGIMRGIGRQEIGGYVQLFSYYAIAMPISFGTTFGLNWGLFGLWSGVAIALCLVSIIEMIFLTRADWNRAVTDALRRNAMA

SEQ ID NO: 15314 - protein, 237 aa, Zea mays subsp. mays
MATKILSLLALLALFVSATNAFIIPQCSLAPSAIIPQFLPPVTSMGFEHLAVQAYRLQQALTESVLQQPIDQLAVVNPVAYLQQQLLASNPLALANVAAYQQQQLQQFLPALSQLAMVNPAAYLQQQQLLSSSPLAVVNAPTYLQQQLLQQIVPALTQLAVANPAAYLQQLLPFNQLTVSNSAAYLQQRQPLLNPLAVANPLVAAFLQQQQLLPYNQFSLINPALSWQQPIVGGAIF

SEQ ID NO: 15315 - protein, 798 aa, Oryza sativa (japonica cultivar-group)
MASKLSFKRMDSIAETMPDALRQSRYQMKRCFQRYVSKGKRLLKNQQLMEELEKSLDDKVEKEKLVEGFLGYIICSTQEAVVLPPFVAFAVRMNPGIWEYVKVHSDDLSVEGITPSEYLKFKETLYDEKWAKDDNSLEVDFGALDLSTPHLTLPSSIGNGLQFVSKFMSSKLGGKPESMKPLLDYLLTLNYRGEKLMINDTIDTVSKLQTALLLAEVFVSGLPKYTPYLKFEQRFQEWGLERGWGDTAERCKETLNCLSEVLQAPDPTNMEKFFSRVPSIFNIVIFSIHGYFGQEKVLGLPDTGGQVVYILDQVRAMEEELLQRIKQQGLHVTPKILVLTRLIPDAKGTKCNVELEPVENTKYSHILRVPFKTEDGKDLRQWVSRFDIYPYLERYAQDSCAKILDILEGKPDLIIGNYTDGNLVASLLSNKLCVTQGTIAHALEKTKYEDSDVKWREMDQKYHFSCQFTADMISMNTSDFIITSTYQEIAGSKEKPGQYEHHYAFTMPGLCRYATGINVFDPKFNIAAPGADQSIYFPFTQKQKRLTDLHPQIDELLYSKDDTDEHIGYLADRNKPIIFSMARLDKVKNITGLVEWYGQNKKLRDLVNLVVVAGLLDASQSKDREEIEEINKMHNLMDRYQLKGQIRWIKAQTDRVRNGELYRCIADTKGAFVQPALYEAFGLTVIEAMNCGLPTFATNQGGPAEIIIDGVSGFHVNPINDREAGIKIADFFQKCKEDPSYWNKVSTAGLQRICEWQRLWQEQGINRLGKPQQAWRLKAADSDAKDLNQVSRAEASSF

SEQ ID NO: 15316 - protein, 152 aa, Musa acuminata
MAAIASVKARRIFDSRGNPTVEVDVCLTDGTCARAAVPSGASTGVYEALELRDGGSDYLGKGVLKAVANVNTIIGPALIGKDPTEQVEIDNFMVQHLDGTSNEWGWCKQKLGANAILAVSLAVCKAGASVKKIPLYQHIANIAGNKNLVLPV

SEQ ID NO: 15317 - protein, 568 aa, Toxoplasma gondii
MATEEMREKSLKREAESLWDIPPESYASKACSCMGTAAQLVMVAVLGSFQFGFNLSALNTSKAFIILDFGWCKDENGGHYSDCDTGLVYGSLINTAVFLGACVGCLLGGRLTDFGRRASLIFTHCVCTLGCILSAAAEGFPTLLIARLVVGVAVGMFTVCVPMYLSEVTPDDRRGYFGTFHQLFITLGIFFGTLLGLAFGNAPAGDEVYEVSTFQQAWWRVMLGLPAVVSLLAIWLLWFVFPFETPQYMVEKKQRAKATALLREIYGRDNVDVEIQRIVTSRYQQKIQRAQQLTVWKAIVHPTYRSVILLACLLSIMQQFTGINVLVANSNNLYSSLKLPQDAVTGLTVGFTALNVFLTVITIPLVDRLGRRTLLLFSEAVMFVAMGIAFVANLVDQSNTAVQWVTVACVYVFIVGFAVGYGPVLWIYIHEIFPPEIKQGAASLASALNWVATVAIVLPSDFLLKQGFSVFVGICTVALAIIFVVTFIFVKETKGLSIEESPYFKGKSRALGSPSAFRMELNSSPSVPLTRGEGAAASAEKGMGLTDAAAMNGGRGVSDDLTKGTEVV

SEQ ID NO: 15318 - protein, 492 aa, Prunus persica
IRSTLDRHTILKTTLVELGRTLGLQECALWMPSRTGMNLQLSHTLNYQIQVGSTVPINLPIINEVFTSSRAIRIPYTCPLARIRPLVGRYVPPEVIALRVPLLNLSNFQINDWPDLSAKSYAIMVLILPTDSTRKWRDHELELVDVVADQVAVALSHAAILEESMRARDQLMEQNVALDLARREAEMAIHARNDFLAVMNHEMRTPMHAIIALSSLLLETELISEQRVMIETVLRSSNLLETLINDVLDLSRLEDGSLELDIRKFNLHGVFREVINLIQPITSVKKLSMSLILSPDLPLCAVGDENRLMQTILNVAGNAVKFTKEGYISIVASVAKPESSRDWRPPEFYPASTDGHFYLRVQVKDSGCGILPQDIPHLFTKFSQPRSGSNRINDGAGLGLAICRRFINTMGGHIWIESEGIDKGSIVAFIVKLGICDNPCDTTAAHQMAPQALPQPQPQPNYGSGDRIAHRPTVSFRDGGYTSSNPRYQRSI

SEQ ID NO: 15319 - protein, 355 aa, Trichoderma atroviride
MSRSTAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 15320 - protein, 355 aa, Trichoderma atroviride
MGGCMSSNNDEVEQKKRSQAIDKELDEDSKRLRKECKILLLGSGESGKSTIVKQMKIIHLKGYSEEELYNYRPTVFKNLVECAKAVITAMQQFSIELAQDDNRAHADFLIDYQAESGPQAHIDPKVGLAVQAIWSDPAKEQLMEHQTEFYLMDSAEYFFQEAMRIVAPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLSNFFPDYTGGTDVNKAAKYLLWRFNQVNRAHLNLYPHLTQATDTSNIRLVFAAVKETILNNALKDSGIL

SEQ ID NO: 15321 - protein, 369 aa, Oryza sativa (japonica cultivar-group)
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 15322 - protein, 448 aa, Oryza sativa (japonica cultivar-group)
MSFRSIVRDVRDGFGSLSRRSFEVTLASLYGLTGHHKGKTQSSLDELDDSPAIIPESRWASLPPELLREVIRRLEADESTWPSRRNVVCFAAVCRTWREMCKETVLSPEFCGKLTFPVSIKQPGPRDGMIQCYIKRNRSKSTYHLYLCLSNVVTAEGGKFVLAAKRHRKTTCTEYTISMVSGNISRSSRTNIGKLRSNFLGTKFIIYDTQPPYNGAVVPHVGRTSKRFNSTKVSPKVPSVTYNIAQVSYELNVLGTRGPRRMRCMMHSIPASSVEPGGIVPGQPEQIVPRALEDSFRSTTSFSQSFRSTTSFSKSIMDPSMDFSSARFSDISGSIMGGDDNGEIKERPLVLRNKPPRWHEQLQCWCLNFRGRVTIASVKNFQLVAAPSPPPAGAPTPSQPGPADPEKVILQFGKVARDMFTMDYRYPLSAFQAFAICLSSFDTKLACE

SEQ ID NO: 15323 - protein, 826 aa, Trypanosoma brucei
MIKMSPLLLKAAVVTACLCSLAVATTVEEQTAPKPIENATTYQQELGGRGKVDSPTAPGDAVSITSGIKVMSVTTATAIIFLASAFGFSFAMYWWYVASDIKITPGKGNIMRNAHLTDEVMRNVYVISKRVSDGANAFLFAEYRYMGIFMLGFGALLYFLLGVAMSSPQGEGKDGRPPVAVEAPWVNAAFSLYAFVIGAFTSVLAGWIGMRIAVYTNSRTAVMATVGSGGSDNDVLANGSQSRGYALAFQTAFRGGITMGFALTSIGLFALFCTVKLMQTYFGDSAERLPELFECVAAFGLGGSSVACFGRVGGGIYTKAADVGADLVGKVEKNIPEDDARNPGVIADCIGDNVGDIAGMGSDLFGSFGEATCAALVIAASSAELSADFTCMMYPLLITAGGIFVCIGTALLAATNSGVKWAEDIEPTLKHQLLVSTIGATVVLVFITAYSLPDAFTVGAVETTKWRAMVCVLCGLWSGLLIGYSTEYFTSNSYRPVQEIAESCETGAATNIIYGLSLGYISVLPPILAMAFTIYLSHHCAGLYGYALAALGILSTMSIALTIDAYGPISDNAGGIAEMAHMGHEIREITDALDAAGNTTAAIGKGFAIGSAAFVALALYGAYVSRVGISTVNLLDARVMAGLLLGAMLPYWFSALTMKSVGVAAMDMVNEIRRQFQDPAVAAGTKEPDYESCVNIATGAALQQMVAPACLVMLAPIVTGILFGRYTLAGLLPGALVSGVQVAISASNTGGAWDNAKKYIEKGGLRDKSKGKGSPQHAAAVIGDTVGDPLKDTSGPALNILVKLMAIISVVFAPVVQSKLGGLLVK

SEQ ID NO: 15324 - protein, 325 aa, Hordeum vulgare subsp. vulgare
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 15325 - protein, 119 aa, Hordeum vulgare subsp. vulgare
YPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 15326 - protein, 376 aa, Hordeum vulgare subsp. vulgare
MMELRKYWGVGGRRCGGCEGAAPAAVHCRDCAGYLCTGCDARPAHARAGHERVWVCEVCEVSPAAVTCKADAAVLCAACDADIHHANPLAERHVRVPIAPIGSPEAAAVAAEAMMLCGAGDGDARADPDEVHDQLHHHGHGGMLNLNVEAGKEGGKMDYLFSDLVDPYLAVDFTRFAHADSVVPNGVATAAVPAVVDLDFACGIGAKPPPSYSSSYTANGSGAHSGSSSEVGVVPEAIHGGAGSFELDFTRPKPQAYMPAYTPAPPSHGVGMQQASAVDMGYLTVPERPVAVTGEGRVARLMRYREKRKNRRFEKTIRYASRKAYAESRPRVKGRFAKRADQDADGDGDDLDAEAHAVPSSTSYLLDFGYGVVPSF

SEQ ID NO: 15327 - protein, 357 aa, Hordeum vulgare subsp. vulgare
AAPAAVHCRDCAGYLCTGCDARPAHARAGHERVWVCEVCEVSPAAVTCKADAAVLCAACDADIHHANPLAERHVRVPIAPIGSPEAAAVAAEAMMLCGAGDGDAGRADPDEAHDQLHHHGHGGMLNLNVEAGKEGGKMDYLFSDLVDPYLAVDFTRFAHADSVVPNGVATAAVPAVVDLDFACGIGAKPPPSYSSSYTANGSGAHSGSSSEVGVVPEAIHGGAGSFELDFTRPKPQAYMPAYTPAPPSHGVGMQQASAVDMGYLTVPERPVAVTGEGRVARLMRYREKRKNRRFEKTIRYASRKAYAESRPRVKGRFAKRADQDADGDGDDLDAEAHAVPSSTSYLLDFGYGVVPSF

SEQ ID NO: 15328 - protein, 76 aa, Hordeum vulgare subsp. vulgare
REAKLMRYKEKRKRRRYEKQIRYASRKAYAEMRPRVKGRFAKVPDGGEGAAPSPPQQPTQAAGYEPSRLDLGWFRS

SEQ ID NO: 15329 - protein, 244 aa, Hordeum vulgare subsp. vulgare
GTRSFGGSVDGEKQDAVVNLNDALEAGPDGKENVKLDFLFADMMDPFFGSELPRFPHADSVVPSGGAVELDFGGVAAAAAVVSNPSYSSYTAASIGGSGSSSEVGLVPDAICGRGGGIIELDFAQSKAAYLPYTPTPSHSTVSSVDVGPVPERSESAVAAATPAMGEGREARLMRYREKRKNRRFEKTIRYASRKAYAESRPRVKGRFAKRADDADADAVAAGTITAPRPCVLDFSGYGVVPTF

SEQ ID NO: 15330 - protein, 247 aa, Hordeum vulgare subsp. vulgare
MESEGSTSANGGAACAVCGGSAALYCPADAAALCVPCDAAVHSANPLASRHERVPLAAAVAVAATSGVYDGLFAADDDGAASWPTPVQGSPNSGSSGFSNGSGVEVSLFDLLSDVDLVATGAGGSVSSDGGVAPLWLQPGLASAAWNSSWWRSEAVVVPSRPDGAARVMRYREKRKNRKFHKTIRYASRKAYAEARPRLKGRFVKRPAAAATDDGNTSAAEAAKFWLSFSDNSVGFHVASHGVVPSF

SEQ ID NO: 15331 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 15332 - protein, 520 aa, Suaeda maritima subsp. salsa
MAALEELKKKLTPLFDAEKGFSAGTTLECGDSDMLSDSGTINLLSRSYGVYNFNEQGLQKCTSSPVDENSPSEKTYRISSREMRVFGAIGSGASSIVQRAIHIPTHRIIALKKINIFEKEKRQQLLTEIRTLCEAPCSEGLVEFYGAFYIPDSGQISIALEYMDGGSLADVIQVQKCIPESVLSAIVRKLLHGLNYLHGVRHLVHRDIKPANLLMDLKGEPKITDFGISAGLENSMAMCATFIGTVTYMSPERIRNESYSYPADIWSLGLALFECGTGEFPYIANDGPVNLMLQILDDPSPSPSKEKFSSEFCSFVDVCLQKDPEARPTAEQLLSHPFITKYKDSQVDLATFVQSIFDPVQRLKDLADMLTIHYYLLFDGPDEEEWQQAKSLYNEGSVFSFSGKQYAGTNDIFSVLSDVRRKLAGKWPPEKLIHVVEKLQCKAHGQGGIAIRVSGSFIAGNQFIICGDGMQVEGLPNFRDLNVDIASKRMGTFKEQFIIEPGDAIGCYNISNQELYIMSQ

SEQ ID NO: 15333 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIETVVAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 15334 - protein, 267 aa, Escherichia coli
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIAAYAAKHNATPAQVILAWAMGEGYSVIPSSTKRKNLESNLKAQNLQLDAEDKKAIAALDCNDRLVSPEGLAPEWD

SEQ ID NO: 15335 - protein, 330 aa, Escherichia coli
MSQNTLKVHDLNEDAEFDENGVEVFDEKALVELEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 15336 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTFDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSRSGINPQDIPKLFTKFAQTQSLATRNSGGSGLGLAICKRFVNLMEGHIWIESEGPGKGCTAIFIVKLGFAERSNESKLPFVTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 15337 - protein, 111 aa, Penaeus monodon
GDARAGVVDDSQKSYQEAFDIAKAEMQPTHPIRLGLALNFSVFFYEILNSPDKACQLAKQAFDDAIAELDMLNEDSYKDSTLIMQLLRDNLTLWTSDTQGEGDEANEGDQN

SEQ ID NO: 15338 - protein, 111 aa, Penaeus monodon
GDARAGLVDDSQKSYQEAFDIAKAEMQPTHPIRLGLALNFSVFFYEILNSPDKACQLAKQAFDDAIAELDTLNEDSYKDSTLIMQLLRDNLTLWTSDTQGEGDEANEGDQN

SEQ ID NO: 15339 - protein, 444 aa, Haemonchus contortus
EHVNAPCTAESKSAEKGSKSTTSSSSTKKSLKSPAISSTKPVLSSPRVPSTMNNGAQQASSGAATAQSSRHSSTAQPPHSSGRSHHSGTGSSQHASHLRPSGGMGSSSRSGGRRPPDDPHVGKYKLLKTIGKGNFAKVKLAKHTITGQEVAIKIIDKTALNPSSLQKLFREVKIMKQLDHPNIVKLYQVMENEQTLYLVLEYASGGEVFDYLVAHGRMKEKEARVKFRQIVSAVQYLHSKNIIHRDLKAENLLLDADMNIKIADFGFSNQFTLGNKLDTFCGSPPYAAPELFQGKKYDGPEVDVWSLGVILYTLVSGSLPFDGQNLKELRERVLRGKYRIPFYMSTDCENLLKKFLVLNPARRGTLETIMKDRWMNIGYEDEGELKPYVEPPKDQIDEARIEKLIQLGFNKGSILDALEKEKFEDIHATYLLLGERKCEPSKYA

SEQ ID NO: 15340 - protein, 966 aa, Haemonchus contortus
GNFAKVKLAKHTITGQEVAIKIIDKTALNPSSLQKLFREVKIMKQLDHPNIVKLYQVMENEQTLYLVLEYASGGEVFDYLVAHGRMKEKEARVKFRQIVSAVQYLHSKNIIHRDLKAENLLLDADMNIKIADFGFSNQFTLGNKLDTFCGSPPYAAPELFQGKKYDGPEVDVWSLGVILYTLVSGSLPFDGQNLKELRERVLRGKYRIPFYMSTDCENLLKKFLVLNPARRGTLETIMKDRWMNIGYEDEGELKPYVEPPKDQIDEARIEKLIQLGFNKGSILDALEKEKFEDIHATYLLLGERKCEPSKYARTSSAQTATVAGTSVNSTPLPKQSSRRSSQNDAAGGSSQQPPPQPPSSSSARAQVQLRQQPTSRHTAMSMVPASYQSGEGHRDYLASFTRGGTSSTVTSGSRKSSDPKGRVPINLGVRAAGQRADGSSSARTAHPTSGISATYQVPTSASLVGKLPTTGNGSGASSGVPSLKTPAAIAQIPLPLQKSGSQISHTPTEPVIKEDEDESSESSTGATNGVATITHLPLIGGAPLAQSPLPPAEEGAGEAKPSVSVTPEREHKPSLIHQSPSMPPTMLKAMGELTVRGSPSATGERDSPKMTKSATGNPLIATPPPSAGLPPVSTPSQTYAPSSTYQSSVVPEQRGSTATATATVATAATAGVSATAFPRNTRNRQTFHGKTDYNKVNGEDEESEGEQAPAGQSMGNGQKGGFFLSKLTKLTRRSSTASPAGVTALGSNVASVATRRPLHHSISMAGASPDSATHRHRSSDYSPSVVTGGHHYDSGSGLPPPYSAVRRGPPEAGITSAAGGQPPSRAGTVGSSGGAPIAGALTQIREGHAVAPSGNTTPQSMREDEIKPRSLRFTWSMKTTSSLAPDEMMREIRKVLDANNCDYEQRERYLILCVHGDPNADSLVQWEMEVCKLPRLSLNGVRFKRISGTSIGFKNIASKIAQELNL

SEQ ID NO: 15341 - protein, 834 aa, Haemonchus contortus
MAMIANLARVKKTVLVPNGSSQHASHLRPSGGMGSSSRSGGRRPPDDPHVGKYKLLKTIGKGNFAKVKLAKHTITGQEVAIKIIDKTALNPSSLQKLFREVKIMKQLDHPNIVKLYQVMENEQTLYLVLEYASGGEVFDYLVAHGRMKEKEARVKFRQIVSAVQYLHSKNIIHRDLKAENLLLDADMNIKIADFGFSNQFTLGNKLDTFCGSPPYAAPELFQGKKYDGPEVDVWSLGVILYTLVSGSLPFDGQNLKELRERVLRGKYRIPFYMSTDCENLLKKFLVLNPARRGTLETIMKDRWMNIGYEDEGELKPYVEPPKDQIDEARIEKLIQLGFNKGSILDALEKEKFEDIHATYLLLGERKCEMDAGDLALAQQAVTHSTHNVSSGVGSHPVGSSATATATSTHSPSKYARTSSAQTATVAGTSVNSTPLPKQSSRRSSQNDAAGGSSQQPPPQPPSSSSARAQVQLRQQPTSRHTAMSMVPASYQSGEGHRDYLASFTRGGTSSTVTSGSRKSSDPKGRVPINLGVRAAGQRADGSSSARTAHPTSGISATYQVPTSASLVGKLPTTGNGSGASSGVPSLKTPAAIAQIPLPLQKSGSQISHTPTEPVIKEDEDESSESSTGATNGVATITHLPLIGGAPLAQSPLPPAEEGAGEAKPSVSVTPEREHKPSLIHQSPSMPPTMLKAMGELTVRGSPSATGERDSPKMTKSATGNPLIATPPPSAGLPPVSTPSQTYAPSSTYQSSVVPEQRGSTATATATVATAATAGVSATAFPRNTRNRQTFHGKTDYNKVNGEDEESEGEQAPAGQSMGNGQKGGFFLSKLTKLT

SEQ ID NO: 15342 - protein, 1066 aa, Haemonchus contortus
VNAPCTAESKSAEKGSKSTTSSSSTKKSLKSPAISSTKPVLSSPRVPSTMNNGAQQASSGAATAQSSRHSSTAQPPHSSGRSHHSGTGSSQHASHLRPSGGMGSSSRSGGRRPPDDPHVGKYKLLKTIGKGNFAKVKLAKHTITGQEVAIKIIDKTALNPSSLQKLFREVKIMKQLDHPNIVKLYQVMENEQTLYLVLEYASGGEVFDYLVAHGRMKEKEARVKFRQIVSAVQYLHSKNIIHRDLKAENLLLDADMNIKIADFGFSNQFTLGNKLDTFCGSPPYAAPELFQGKKYDGPEVDVWSLGVILYTLVSGSLPFDGQNLKELRERVLRGKYRIPFYMSTDCENLLKKFLVLNPARRGTLETIMKDRWMNIGYEDEGELKPYVEPPKDQIDEARIEKLIQLGFNKGSILDALEKEKFEDIHATYLLLGERKCEMDAGDLALAQQAVTHSTHNVSSGVGSHPVGSSATATATSTHSPSKYARTSSAQTATVAGTSVNSTPLPKQSSRRSSQNDAAGGSSQQPPPQPPSSSSARAQVQLRQQPTSRHTAMSMVPASYQSGTGEGHRDYLASFTRGGTSSTVTSGSRKSSDPKGRVPINLGVRAAGQRADGSSSARTAHPTSGISATYQVPTSASLVGKLPTTGNGSGASSGVPSLKTPAAIAQIPLPLQKSGSQISHTPTEPVIKEDEDESSESSTGATNGVATITHLPLIGGAPLAQSPLPPAEEGAGEAKPSVSVTPEREHKPSLIHQSPSMPPTMLKAMGELTVRGSPSATGERDSPKMTKSATGNPLIATPPPSAGLPPVSTPSQTYAPSSTYQSSVMPEQRGSTATATATVATAATAGVSATAFPRNTRNRQTFHGKTDYNKVNGEDEESEGEQAPAGQSMGNGQKGGFFLSKLTKLTRRGPPEAGITSAAGGQPPSRAGTVGSSGGAPIAGALTQIREGHAVAPSGNTTPQSMREDEIKPRSLRFTWSMKTTSSLAPDEMMREIRKVLDANNCDYEQRERYLILCVHGDPNADSLVQWEMEVCKLPRLSLNGVRFKRISGTSIGFKNIASKIAQELNL

SEQ ID NO: 15343 - protein, 942 aa, Haemonchus contortus
NAPCTAESKSAEKGSKSTTSSSSTKKSLKSPAISSTKPVLSSPRVPSTMNNGAQQASSGAATAQSSRHSSTAQPPHSSGRSHHSGTGSSQHASHLRPSGGMGSSSRSGGRRPPDDPHVGKYKLLKTIGKGNFAKVKLAKHTITGQEVAIKIIDKTALNPSSLQKLFREVKIMKQLDHPNIVKLYQVMENEQTLYLVLEYASGGEVFDYLVAHGRMKEKEARVKFRQIVSAVQYLHSKNIIHRDLKAENLLLDADMNIKIADFGFSNQFTLGNKLDTFCGSPPYAAPELFQGKKYDGPEVDVWSLGVILYTLVSGSLPFDGQNLKELRERVLRGKYRIPFYMSTDCENLLKKFLVLNPARRGTLETIMKDRWMNIGYEDEGELKPYVEPPKDQIDEARIEKLIQLGFNKGSILDALEKEKFEDIHATYLLLGERKCEMDAGDLALAQQAVTHSTHNVSSGVGSHPVGSSATATATSTHSPSKYARTSSAQTATVAGTSVNSTPLPKQSSRRSSQNDAAGGSSQQPPPQPPSSSSARAQVQLRQQPTSRHTAMSMVPASYQSGTGEGHRDYLASFTRGGTSSTVTSGSRKSSDPKGRVPINLGVRAAGQRADGSSSARTAHPTSGISATYQVPTSASLVGKLPTTGNGSGASSGVPSLKTPAAIAQIPLPLQKSGSQISHTPTEPVIKEDEDESSESSTGATNGVATITHLPLIGGAPLAQSPLPPAEEGAGEAKPSVSVTPEREHKPSLIHQSPSMPPTMLKAMGELTVRGSPSATGERDSPKMTKSATGNPLIATPPPSAGLPPVSTPSQTYAPSSTYQSSVVPEQRGSTATATATVATAATAGVSATAFPRNTRNRQTFHGKTDYNKVNGEDEESEGEQAPAGQSMGNGQKGGFFLSKLTKLTRRSSTASPAGVTALGSNVASVATRRPLHHSISMAGASP

SEQ ID NO: 15344 - protein, 516 aa, Cryptococcus neoformans var. neoformans
MFQKVSDKFHRKQQSTTLPGKTQQVPNPTSPVLAKANSQAQQAYSLPQDHSPMEGIQRDSPPIQQPMATEKAPIVGSSASTSLPTLSVQDGTLPLTPGAQGMQTGTIDGHRQLQSPVSRSSSAGEDKMREKARDAQEQAAQSQANLHHATQQARVAAINAAATQAALETAAQLPATARVPVSGGGVEQGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTNFGFAKYVPDITWTLCGTPDYLAPEVVQSKGYNKSVDWYALGVLIFEMLAGYPPFFTEDGNPMKLYEKIIAGKVRYPTYFDALAKELLKNLLIGDLTKRYGNLRAGSSDIFAHGWFAEVDWDKLYRREIPAPYVPKIDGEGDASQFDRYQEADVSAYGKVGNGPYDHFFTEF

SEQ ID NO: 15345 - protein, 383 aa, Hordeum vulgare subsp. vulgare
MNCVSNGTVYEEAVGREGRWARLCDGCCTVPSVVYCRADSAYLCASCDAQIHAANRVASRHERVLLSEAYKHAPVMLDCHADAAALCAAYEAQVHYANLLTVMHQRMPVVSHPAVAIPPVSLFAEAEATAPVLGRKEEDTSWLLLSKDSDNHNRSGNNSSTSSSSQYFGEVDQYFDLVGYNSYYDSHMSNQEQYVMQEQQHLQQMQKEYAEQQMQKEYVENEGSECIVPSQSTIVRRPHQSGYAPLVGAEQAASATAGASAYTDSVNNSISFSMEAGIVPDNTVQSSILRPAGAIGLFSSPSLQTPLHFSSKEREARVLRYKEKKKSRKFEKTTRYATRKAYAEARPRIKGRFAKRSDAEMEVDQTFSTAALSDSSYSTVPWF

SEQ ID NO: 15346 - protein, 368 aa, Hordeum vulgare subsp. vulgare
MNCNFNSDLLEKEAGRTSFPWARPCDGCHAAPSAVYCCADAAYLCSSCDTQVHSANRVASRHERVRVCETCESTPAVLACHADAAALCTACDAQVHSANPIAQRHQRVPVLPLPAVAIPAASGFAEAEASVTAHGDKEGGEEVDSWLLRRNSDDNNCANKIDRYFNLVGYNMYYDNITCDPRPQEQYRMQEQQHVQNRYREKEGCECVVPPQVVMASEQQGSNYGTIGAGQAASVTAMASTYTASISNDISFSSMEVGIVPDNTRPNISNRNILTSSEAIELSGHSLQMPVHFSSMDREARVLRYKEKKQARKFQKTIRYATRKAYAEARPRIKGRFAKRSDIEHEENHMLSPPALPDTSSYNTVPWF

SEQ ID NO: 15347 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGEKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 15348 - protein, 217 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGEKEASSKDYHGHGMESNEGSHDHDFVVPGEPVAQLHERQGFTAEMAYDAQNSNHGFQCHRHRTTAAPSRM

SEQ ID NO: 15349 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGQKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 15350 - protein, 323 aa, Hordeum vulgare subsp. vulgare
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 15351 - protein, 224 aa, Cycas edentata
MGRGKIEIKRIENTTNRQVTFCKRRNGLLKKAYELSVLCDAEVALIVFSSRGRLYEFANNSVKRTIERYKKTCADNTQGGAISESNSQYWQQEAGKLRQQIDILQNANRHLMGDALTSLSVKELKQLEIRLERGLSRVRSKKNEMLLEEIEIMQRREHILLAENQFLRTKIAEYESNQNTNVLIPGPEFDALPAFDSRNFLHANLIEAAAHHYTQQDQAALQLG

SEQ ID NO: 15352 - protein, 166 aa, Trypanosoma cruzi
MSQQMQYYAPQQQLQQAPAQMNPEPDLLRNLMVNYIPTTVDEVQLRQLFERYGPIESVKIVADRETRQSRGYGFVKFQSGSSAQQAIAGLNGFNILNKRLKVALAASGHQRNRNGVSTGFGAYGGYGGYGGYGAYPSAANPYAQQQMMTMQHPYMMTQSVPSVPRQ

SEQ ID NO: 15353 - protein, 726 aa, Capra hircus
MEGERKNNNKRWYFTREQLENSPSRRFGLDPDKELSNRQQAANLLQDMGQRLNVSQLTINTAIVYMHRFYMIQSFTQFHRNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIWNWRAWQADRKTKADDRGADENSSEQTILNMISQSSSDTTIAGLMSMSASSATSAVPSLPATEDSKSNLSNEEMLSSERWLPSHPPFKVEPAQGYRKSENLALGADHSLQQDGSNAFVSQKQNSKSVPSAKVSLKEYRAKHAEELAAQKRQLENMEANVKSQYAYAAQNLLSHHDSHSSVILKMPIEGSENPERPFLEKTDKTALKMRIPMTGGDKAASTKPEEIKMRIKVHTAADKHTSVDDSVTKNREHKEKHKTHPSNHHHHHNHHSHKHSHSQLPAGTGNKRLGDPKYSSQTSTLAHKPYSLSGSFSSSSSSRKRPLPEETGGAVYDHSTKTGKSAKSSSIDFSFPPLPTMAQLPGHSSDTSGLHFSQPSCKTRVPHMKLDKSSTGANSHNTPQTTDYQDTVNMLNSLLNAQGVQPTQPPAFEYVHSYGEYMNPRAGGMSSRSGNTDKPRPPPLPSEPPPPLPPLPK

SEQ ID NO: 15354 - protein, 491 aa, Candida glabrata
MKPELKNPDLIKGLGYINGEWVKDSNEFFEVDDPSTGEIIAKLPEHDIAVVDRAVDAAYDAFQKYKNTLPRQRATWLRNLFNLMTENAEDLAKIITWENGKSLPDSRAEIKYAASYYEWYAEEAPRIYGATIQPSIPNNRVITKRQPVGVCGIICPWNFPSAMITRKVGAALAAGCTVVVKPDSHTPLSALAMTVLVEKAGFPKGVFNVVLSQHNTPKLGKRLCEHPKVKKVTFTGSTRIGKTLMEQASSTLKKCSFELGGNAPFIVFDDADLDLAVDQAIASKFRGMGQTCVCTNRFYVQDTIADEFAEKLVTKVKQFKIGDGMKEGVTHGCLTNAKQADKVDEHKKDAIEKGAKVLLEGGRMPDLGKNFYAPVVLKNVPQSAMVAKEETFGPLCPIFTFKTVEEVLGYANDTELGLASYVFTKNVNTLFTVSEALEAGMVSCNTGLFSDSSVPFGGVKESGFGREGSLYGIDDYTTVKSIIIGNLPDSL

SEQ ID NO: 15355 - protein, 165 aa, Brassica oleracea
FTPISTITDGTSFYGLDIVGISVGGQKLAIPQTVFSTPGALIDSGTVISRLPPKAYAALRGAFKAKMSQYKNTSAVSILDTCFDLTGFKTVTIPTVSFYFNGGAVVELGSKGVLYAFKMSQVCLAFAGNSDDNNAAIFGNVQQQTLEVVYDGAAGRVGFAPNGCS

SEQ ID NO: 15356 - protein, 251 aa, Oryza sativa (japonica cultivar-group)
MLHDFAITEHYAIFPESQLVMCPMNMALRGGSLIGLDSAMVQRIGVLPRYAEDESEMRWFKLMPGRKLMERRLYWCQPTTYLSHMLGNMELMQVQVDMIHINLRTGTVLRTALSLESLEFGVIHQGYVGRYNRYGYFGVSAPLPRFSGIRKLDFAMVGADDCTVARRDFGPGCFVGEPFFVPSNDNGDGNEDNGYVVCYTHKEDTGESQFVVMDAMSPELEIVAAVQLPARVPYGFHGRFITQAELLSQQK

SEQ ID NO: 15357 - protein, 234 aa, Hordeum vulgare subsp. vulgare
MATIYDIGLGAGFNILMATIFLLIFAFLRLQPINDRIFFPKWYLKGMRDSPSSAGAAVTKYVNLNVRSYLKFLSWMPAALKMPEEELIEHAGLDSVVYLRIYLTGLKIFVPITILAFAVLVPVNWTNDTLEGLKVVHSDIDKLSISNIPYGSKRFIAHLVMAYVFTFWTCYVLKNEYERVATMRLRFLASEKRRPDQFTVLVRNIPPDPDESVSELVEHFFLVNHPDHYLKHQV

SEQ ID NO: 15358 - protein, 285 aa, Buchnera aphidicola str. Sg (Schizaphis graminum)
MTNKVQILSVTALGNLDAYIRIANLWPMLSIKEEKLLTKRLRYHDDLDAAKTLILSHLRFVIHISRNYSGYGLLQADLIQEGNIGLMKAVRRFNPDIGVRLVSFAVHWIKSEIHEYVLRNWRIVKVATTKSQRKLFFNLRKNKKRLGWFNQEEIEIVARELGVSSEDVREMESRMSAQDITFNPFPEEDLKDGKINGNMFYLQDKTSNFANGLEQDNWNKHTTSKLSNALLRLDERSRNIIRARWLDKKEKNTLQKIANNYGISAERVRQLEKNAMKKLKIAIEN

SEQ ID NO: 15359 - protein, 617 aa, Buchnera aphidicola str. Sg (Schizaphis graminum)
MEHNPKSQLKLLVTHGKEQGYLTYAEVNDHLPEEIIDSEQIDDIIQMINDMGIQVVEEAPDADDLILNEINTDTDEDAVEAATQVLSSVESELGRTTDPVRMYMREMGTVELLTREGEIDIAKRIEEGINQVQSSVSEYPEAITYLLEQYDRIKTGQIRLSDIITGFVDPNAEEIFSHSTSAIHIGSEILDNITNDSNENEDENEDENEDEDENSIDPELANEKFRELRKQYTNTSNTIKNKNRNHQDSLLEIYNLSEIFKQFRLVPKQFDHLVNNMRNMMNRVRKQERKIMKLCIEECKIPKKIFLKIFSGKETDQNWFKKEQSSNQSWSKKLEEIKEKVFSSMKKLKQIEKETGLTIEQVKDINKRMSIGEAKAKRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEIGREPTPEELSEKMLIPEDKIRKVLKIAKEPISMETPIGDDDDSHLGDFIEDTTLELPLDSATSESLRSATHDVLSGLTAREAKVLRMRFGIDMNTDHTLEEVGKQFDVTRERIRQIEAKALRKLRHPSRSEVLRSFLDD

SEQ ID NO: 15360 - protein, 570 aa, Buchnera aphidicola str. Sg (Schizaphis graminum)
MISGILASPGIAFGNVLLLKKEEIVINRQNISTENIKTEINKFFNGRKKSVKQLTEIKIATGEKFGKKKEGIFEGHIMLLEDEELEKEIINLITEKKISAAEATKFIIEGQAKALEKIKDEYLKNRAIDVRDIGSRLLKNILNISIVDLNNIKNQVILISKDLTPSETAQINLKYILGFITDLGGPTSHTSIMARSLEIPAIVGTVNITKKVKNNDFIILDSLNNEIIINPSDQIINEKKQVERKYFFKKENLKKLRNLYATTTDGHNIKIGSNIGNIQDIYSAKKNGAECIGLYRTEFLFMGRNALPTENEQFQAYKEIAESMENKPVIIRTMDIGGDKDLPYMNLPKEENPFLGWRAIRISMDRKEILHAQLRAILRASAFGKIYILFPMIISVEEIRTLKIEVHKLQIQLKKEHLVFDENIKIGIMIETPASAIIADHLIKEVDFFSIGTNDLTQYTLAVDRGNDLISHLYNPISPSVIQLIKQVIDISHLHGKWTGMCGELAGDERVTTLLLGMGLDEFSMSSTSIPKIKEIIRKTSFSKSQELAKKVLKAATTKEILDLLNKFII

SEQ ID NO: 15361 - protein, 349 aa, Buchnera aphidicola str. Sg (Schizaphis graminum)
MRIEEDIKLGFKDVLIRPKRSTLKSRSEVNLIRCFSFKYSTMKWFGIPLIAANMDTIGTFRMAEALSKFNILTAVHKYYSFDEWKNFISVSSKEILEHVIVSIGTSNLDFFKIKKIFSLSSELKYICIDVANGYSEHFVSFLKKIRSFFPDKIICAGNVVTGEMVEELILSGADIVKVGIGPGSVCTTRLKTGIGYPQLSAIIECADAAHGLNGQIISDGGCTVSGDIAKAFGGGADFVMLGGMFAGHTECLGEIIQEKSKKFMLFYGMSSTSAMKRYTGKIPGYRASEGKIVKIPFRGNVDVTVRDILGGLRSSCTYVGAQKLKELTKRTTFIRVSEQENCIFNNFKN

SEQ ID NO: 15362 - protein, 398 aa, Buchnera aphidicola str. Sg (Schizaphis graminum)
MKKITVLGSTGSIGISTLSIVKNNPSLFKVIVLVANKNSSMMLEQCEYFSPDWAIMKNKKSAHILKKRLKDKKIKTQVLSGNKAICQLAALKESDLVISAIVGMAGLLPTLSAINAGKTILLANKESLIVCGIIFMKALSSNKAKIFPIDSEHNAIFQVLPKFVQKNLGKVNLKKNGVKSIILTASGGPFYNFKRENLSFVTPLEACSHPNWSMGRKISIDSATMINKGFEYAEARLLFNASSSEIDILIHPQSIIHSMVEYIDGTILAQLSVPDMKVAISYAMSWPNRISSGAKFLNFNKLSNLSFFKPDFIQFPCLKLAIDAFSQGQAAMTVLNAVNEVTVSAFLDSKISFNKISEINTDILMSSSFSEPVSVEEVLEIDKKTRIKSQKKISSLIF

SEQ ID NO: 15363 - protein, 244 aa, Buchnera aphidicola str. Sg (Schizaphis graminum)
MKIEKKTALVTGANQGLGKEIAIKLSQKGIQVIGTSTTVDGVKTINKYLKKNGFGFILDLKDTDSILEKMKEICQKKYSIDILINNAGITSDNLLVYMSNKEWENVIKINLTSVFYMSKSVIRSMIKKRYGRIVTIGSVIGYLGNRGQINYSASKSGLIGFHKSLALEVAQKGITVNIVSPGFIKTNLTKNLNVFQYKKHLSKIPMKRIGTAEEIANAVIFLSSEKASYITGQTIHVNGGMYMT

SEQ ID NO: 15364 - protein, 434 aa, Buchnera aphidicola str. Sg (Schizaphis graminum)
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 15365 - protein, 415 aa, Buchnera aphidicola str. Sg (Schizaphis graminum)
MPELLNKTKTNLNFENIKILIKKFQSPFWVYDSNIIHKKINLLKEFDIVRFAQKACSNIHILRLMKQKNIKVDAVSLGEIERALVAGFKPNSNEIIFTADLFDEETLSKVIDFKIPVNAGSIDMLEQLGKLSPGHHVWLRINPGFGHGHSKKTNTGGENSKHGIWNPRLAIPIIKKYKLKLIGLHMHIGSGVNYKHLKKVGQAMIEKAMEINEKILFISAGGGLPIPYTFNEKPIDTKKYFIIWDEARKKISRFLNTPIQLEIEPGRFLVAESGILISQVRAIKKMGDKNFVLIDAGFNDLMRPTMYGSYHHVSVVTKDDRNIHETETIDTIIGGPLCESGDIFTQKEGGNITTRKLPILKIGDYLIFHDVGAYGASMSSNYNTRPLIQEILLENNTFRTIRRRQKINELLNLEK

SEQ ID NO: 15366 - protein, 585 aa, Buchnera aphidicola str. Sg (Schizaphis graminum)
MNFDITRYPILSFAHSVRRLRLLSIEQLPQLCTELRKYLLDVVSITQGHFASGLGVIEITVALHYVYDTPFDNLLWDVGHQSYPHKILTGRAEKIGSIRKKNGLHPFPFREESKYDILSVGHSSTSISAGLGLSIAAGKEGKNRKTICVVGDGSMTAGMAFEAMNHAGIIQSDLLVVLNDNQMSISKNIGALNKHLKFLRDIKKSSKIFNFSIFESLNFKYLGPFDGHNIFKLIEIFKKTKDYRKTCLLHLITKKGKGYLPAELDPIKWHTISQSFSSSSKILTYSDVFGSWLCEIAEFDKKIMAITPAMCEGSGMLKFSRLFPNQYFDVAIAEQHAVTFAAGLAIAGYKPVVSIYSTFLQRAYDQIIHDVALQKLPVLFAIDRGGIVGHDGPTHQGIFDLSYLRCIPGIVIMTPSNENECRQMLYTGYMYKEGPSVVRYPKGKGIGMSLSPMKLIPLGKSLIKRVGEKIAILNFGALLQNAYLAAEKLNATLIDMRFVKPLDTNMILKLSLKYNFLVTIEEGVIAGGAGSAVNEFIMMRKILLPVLNIGLPDMFIAHGSQEEIKHDYQLDPEGIQNKILAWLSY

SEQ ID NO: 15367 - protein, 382 aa, Chlorobium tepidum TLS
MKSLSILGSTGSIGLSTLDVVRRHPERFSIAALAEGHDVEMLLKQIDEFRPSLVSVRDEASRERLKGMLGDHKPEILCGLEGAAEVAAVDGADMVVSAIVGAAGLVPTVRAIEAGKDIALANKETLVVAGQLVSDLVKKHDVKLLPVDSEHSAIFQSLVGHRTEDIERIILTASGGPFRKTPAEELKNVGPEQALKHPQWSMGAKITIDSATLMNKGLEVIEAHWLFDMPAEKIGVVVHPQSIIHSMVEYIDGCVIAQLGVPDMRAPIAYALAWPERCETGIGKLDLTKVATLTFEEPDMERFPALRLAFDALKAGQTYPAVLNAANEIAVAAFLDKKIGFTDIAGTVDKTMQAHEAWTPITLEEYLQADKWARETARQLIG

SEQ ID NO: 15368 - protein, 90 aa, Chlorobium tepidum TLS
MNIYIGNLPYSVTDEDLRDKFSEFGQVHSANIITDKFSGRSKGFGFVDMPNESEAREAIDAMNDKDFKGRTIKVNEARPREQRPPRREQY

SEQ ID NO: 15369 - protein, 113 aa, Chlorobium tepidum TLS
MKLITAIIQPDRLDHVREALIQADITRITVSRVSGHGRQEDIEYYRGQKIAPNLLPKVRLDIAVNDQFVNVTVDTIVAAARHESGEIGDGKIFITPLEECVRIRTNERGGSAI

SEQ ID NO: 15370 - protein, 437 aa, Chlorobium tepidum TLS [sequence omitted]

SEQ ID NO: 15371 - protein, 599 aa, Chlorobium tepidum TLS
MVYRKAPKHSGDAPDSSANPADRPASTGKERRYQGIGSAKGFAIGETYEFVRETIEHETADLSPENIEGEIERFMTALHRSEKELKKIERVTTRKIGRLYSDLFQAQIMLLKDPVLTGNITRRIRQELKPAHIVIEQEFGKLLEHFLNSDDVIFRERAADLHDLKERIIRNLHIRKLHSWVPEGSIVVSHHLSPADIILLSRSNIKGFATDTGGKTSHVSLICKSLNIPIVVGLGNFSQKAVSGERIILDGNEGLVITNPLDETVDTYLKKREEESKREADDSIMAHRHAFTRCGVRISVYSNIDFKEEIEHLDSMGAEGVGLFRTENLFLDDLKPPKEAAQQEYYRKMGEMLAPKPLVIRLFDIGGDKLIYSPVKEPNPNLGWRGVRILIDVPEILDAQLQAVIRANIHGNIDVLIPMISSVEEIMHIKQAVEEHYKHIRSLTTEPLDKPGIGAMIEVPAAVELIDEITQIVDFVSIGTNDLTQYTLAVDRNNLIVQDLFEKFHPAVIRQLHRVISTAQKNHCRVSLCGDMGSDPLATPYLIGCGLREFSIVSSDIPALKAMVGKYTVEECEALAAECLKLSSASAIKAHLEAFVKAH

SEQ ID NO: 15372 - protein, 406 aa, Chlorobium tepidum TLS
MLTGRNILLGISGGIAAYKTPQLVRLLKKSGAGVQVLATASALKFVSELSLATVSNHPVLTGIFPSHEAREDEYTRHIALGEWADAFVIAPATANTLARLATGLCDDMLSLCFLTLRPGKPVLIVPAMDGHMYDSPSVQRNLATLRAQGCRLMEPESGSLASGQCGLGRMPEPETIFEALTGMLAAPEASALCGKSVVVTAGPTREKIDGVRFLSNYSSGKMGFAIAANAARRGARVHLVTGPVNLPTPSGVERIDVESAVEMLEAAQPLFGECDLFIGAAAVADYRPEAPVEGKIKKNEAEMEIRLVRNPDILAEFATNRKLGQLAVGFALETAGGIDYARKKLADKKLDLVAFNVYDGRTSGFEVDTNALTLLARDGGVTELPLLPKEEAAARLLDAVESLLPR

SEQ ID NO: 15373 - protein, 370 aa, Chlorobium tepidum TLS
MNILFINSIGRNKFGGGEKWMVNAAKGLTDRGHNVVLASKRNSRLLDYAAGSGVRTEVMEIRGDFSPLATLKIAAWMKRHQTDILICNLNKDVRVAGLAARLVGRPVVLARHGMLLCSKKWKHKLSLTRLTDGIVTNSRTIREAYAGYGWFSENFVKVIYNGLTIPAEVTAFDFASRYPGKKIIYSAGRLSKQKGFEYLIDAAAMLKRKRDDLLFAISGEGKLEIELKNRVAALGLKGSFVFLGFTPDIYPFLKGCDLFVLASLFEGMPNVVMEAMAMQKPVIATDVNGARELMGASPESLVCDTGLIIPPKNPAAIAEAIEQIIDNPALLEAYGKAGHQRVETHFTVPIMIDNLEKHLQSKLAEKAGRC

SEQ ID NO: 15374 - protein, 644 aa, Chlorobium tepidum TLS
MADLVSAPAMISQAYPLLSSIHSPADLKKLSLHELELVAAECRKKVIELVSQNGGHFGSSLGVVELTVALHYVYQSPTDRIIWDVGHQAYVHKILTGRLAQMETNRRYHGLAGFPKRSESPHDAFGTGHASTSISAAAGLAAARDLAGRKEKVVAIIGDGSLTGGMAFEAMNHLGDTKSDVLVILNDNQMAISPSTGGLKNYLVNLTLNKTYNRLRKFVWDSLSLLHNEIGETAKTAVHRIEDGIKAAFTPGAYFEALGFRYFGPIDGHNMEQLIKALREMRQLHHPKLLHVITTKGKGFKPAEENQPKWHASVGGFDIETGKNVKAPGKPAKPKYQEVFGEALVELALKDPTITAITAAMPSGTSLDLFQQAIPSRCFDVGIAEQHAVTFAAGLACGGFKPVFAVYSTFLQRAYDQLIHDVALQNLHVVFAIDRAGLVGEDGPTHHGAFDLSYLNVVPNLTIMAPGDEQELRNMLYTALYDIKGPVAIRYPRGSGSGATLHKEFTPVPVGRGRILRDGKSVALLGIGTMSNRALETAALLEAAGLDPLVCDMRFLKPLDTEIIDMAASRCTHIVTIEENSIIGGFGSNVVNYLHHAHPGIKCISFGLPDAFVTHGSMDELYREVGLDAESLSGKILEFYKDKP

SEQ ID NO: 15375 - protein, 333 aa, Chlorobium tepidum TLS
MNKLTTIESHFLQLQKRYPEINSEVTDLLNDVAFAAKLVRREVVRAGLADILGLAGSTNVQGEEVKKLDLFANERLINAIGQHGRFAIMGSEENEEIIKPPKFESGEYVLLFDPLDGSSNIDVNVSVGTIFSIYRLKSGEPSQASLEDCLQKGADQIAAGYVIYGSSVMMVYTTGHGVHGFTYDQTVGEFLLSHENITTPEHGKYYSVNEGSWQEFNDGTKRFLDYLKEEDKATGRPYSTRYIGSFVADFHRNLLTGGVFVYPATKKHKNGKLRLMYEANPMAFICEQAGGRATDGYRRILDIEPKELHQRTPLYIGSKNDVLIAEEFEQGKR

SEQ ID NO: 15376 - protein, 152 aa, Chlorobium tepidum TLS
MSDLNHCMELAFREAIKAYESKEVPVGAVVLDPNGLIIGRGYNQVETLSDATAHAEMIALTSAMATIGSKYLEGCTLAVTLEPCPMCAGAIVLSKISRVVFGAWDPKMGAAGTVLNITACNALNHQPEVYGGIMERKAESLLQDFFRGLRGR

SEQ ID NO: 15377 - protein, 117 aa, Chlorobium tepidum TLS
MKKIEAIIRTSQYEAVKKALHEIDIDFFTWWDVTGQGNDKKHRTEIYRGTVRDTSYISRRYLSIVVRDVNLQKTVDCLIKNARTGEVGDGKIFVSDIEQSYRIRTGESGDESLYNKD

SEQ ID NO: 15378 - protein, 387 aa, Chlorobium tepidum TLS
MFCKVMKIGISCHHTYGGSGAVATELGKALAMKGHTVHFFSQAAPFRLGLYSRNIYCHEIEAMNYPLFETPYHSLALASKIAEVAFYEKLDVVHAHYAIPHAISAMLARQMLEEKCPAAECFRIVTTLHGTDITIVGADRSMSDAVRLAINKSDGVTAVSGYLRDETIRMFTPRKKIEVIHNFVDTAVFKRLPGRRDLLGLDGGKVVIHISNFRPVKRIMDVLAVFESIRREIPATLLLVGDGPDRSEAETWVRNYGIGDRVRFLGKLDDIVPLLSIADLMLMPSNVESFGLAALEAMACGVPVVVTDAGGFPEFVRQGVDGFRHPHGDIEGMSRSALSILRDDEVWQRFSGAAANQAGRFKTALKVKEYEAFYRRLIDEARERKAQ

SEQ ID NO: 15379 - protein, 148 aa, Chlorobium tepidum TLS
MNRDHEFMALALEQARKSYDEGGVPVGAVMVENGKVLAAGHNQRVQQGDPIAHGEMDCIRKAGRCARYDTVTLYTTLSPCMMCAGAIVQFGIGRVVVGEDRNFKGNAGFLREHGVEVSLLDDEGCRSLMDAFIAERPDLWDEDIAGNG

SEQ ID NO: 15380 - protein, 399 aa, Chlorobium tepidum TLS
MFLSRPLVRIASAADRFLHGETEVKIPVKHDDEIGRLARAFNYLSEEIVRLTRKEEWLREVLSSIREAIIVTNASGEIVLANPAASRLFMIEAARKRSIPVTNIEDAAMRELFERVQKRQSGIYNEELTAMTSKGKRTLKVTAVPVMRRGALFDGTVLVINDVTRLRNLERTRRDFVSSVSHELRTPLASIKGYTETLLEGAMNDPENATAFLNIIHQEAEQLTALVNDVLDLSRIESGKIAYSFEPVDVKPQLEKTAALFEPAAARKGVRIELNAPEGLPAVLADRSYFDIVVRNLIDNAIKYVDAESGRVRVSAYATGDSVSIEVADNGIGIPQADLDRIFERFYRVDKARSRELGGTGLGLSIVKHIVLAHKGKVEVRSRINRGTTFTVTLPVAGA

SEQ ID NO: 15381 - protein, 471 aa, Chlorobium tepidum TLS
MTTEAAVLDYKVADISLAEWGRKEIEIAEKEMPGLMATRKKYEGKKPLAGARIAGSLHMTIQTAVLIETLVELGADVRWASCNIFSTQDHAAAAIAAAGVPVFAWKGETLDEYWWCTRQILEFEGGLGPNLIVDDGGDATLMIHFGYKIENDPSMLDKTPGNAEEKALLQQLKAVFAEDNQRWHKVAAGMKGVSEETTTGVHRLYQMMEKGELLFPAINVNDSVTKSKFDNLYGCRESLADGIKRATDVMIAGKVVVVLGYGDVGKGCAHSMRSYGARVIVTEIDPICALQAAMEGFEVTTMEEAVKEGNIFVTATGNKDVITLDHIKQMRDEAIVCNIGHFDNEIQVDALNNFKGATRINIKPQVDKYVFENGNCIYLLAEGRLVNLGCATGHPSFVMSNSFTNQTLAQIELWQNDYKVGVYRLPKKLDEEVARLHLGQIGAKLTTLTKEQADYIGVPVEGPYKPEHYRY

SEQ ID NO: 15382 - protein, 327 aa, Chlorobium tepidum TLS
MGEKITIEQTAKYTSRGNKATRTGFGEALLEAGRENPSVVALCADLTGSLNMHLFRKEFPERFIQTGIAEANMISMAAGLATIGKIPVASSFAVFATGRVFDQIRQSVCYSNLNVKICASHAGLTLGEDGATHQILEDIGLMRSLPRMTVVVPCDYSETKRATKAIIEHEGPVYLRFGRPNVPDFTADEDGFEIGKSIELHPGKDVTVIACGIMVWKALEAARILEKEGVSVRVINMHTIKPIDTLAIVRAANDTGAIVTAEEHQMYTGLGEAVANVCARNIPVPIEMVAVEDTFGESGKPDDLLRKYKLTTEDILEKIYLVLRRKD

SEQ ID NO: 15383 - protein, 750 aa, Chlorobium tepidum TLS
MYGLVVCLFGMIFGLIQYQGINKLPVHAAMKEISDLIYETCKTYLITQGKFIIILWALVAAIIVAYFGGLNHLAPDKVVFILACSLLGIAGSYTVAWFGMRINTFANSRTAFASLGGKPFPTYAIPLRAGMSIGMLLISIELFAMLCILLFIPVDYAGPCFIGFAIGESLGASVLRIAGGIFTKIADIGSDLMKIVFKIKEDDARNPGVIADCTGDNAGDSVGPTADGFETYGVTGVALISFILLAIKDPSIQVSLLVWIFAMRLVMIVASAVSYWVNDALAKMKYGNADEMNFEKPLITLVWLTSIVSIVLTYIASYMLIAQLGDGTMWWKLASIITCGTIAGALIPELVDRFTSTECAFVRNVVQCSKEGGAALNILSGLVAGNFSAYWMGLAIIVLMGAAFGFSTLGLDVMMLAPSVFAFGLVAFGFLSMGPVTIAVDSYGPVTDNAQSVYELSLIETLPNISNSIESEFGFKPDFENAKRYLEANDGAGNTFKATAKPVLIGTAVVGSTTMIFSIIMILTGGLADTGAIAKLSILWPPFLLGLLMGGAVIYWFTGASMNAVTTGAYYAVAFIKKNIKLDGVTKASTEDSKKVVEICTRFAQKGMINLFLTIFFSTLAFACLESYLFIGYLISIALFGLYQAIFMANAGGAWDNAKKVVETELHAKGTELHDASVVGDTVGDPFKDTSSVALNPIIKFTTLFGLLAIELAIKLPTTISVSLAVVFFLLSLVFVHRSFFSMRIAVDKD

SEQ ID NO: 15384 - protein, 113 aa, Chlorobium tepidum TLS
MKYIVAMIQPHKLPDVKKSLAAAGIRKMTVTNALGCGAQGGYTEMYRGIPSEVNLLKKVKLEIAVNEEFADATVKAIIKGAKTGEIGDGKIFIFDLPECIRIRTEEKGHAAIG

SEQ ID NO: 15385 - protein, 494 aa, Chlorobium tepidum TLS
MDKILYDALTFDDVLLVPAYSNVLPKETVVKSRLTRQIEVNIPLVSAAMDTVTEAELAIALARAGGIGIIHKNLSIDEQARQVAKVKRFESGIIRNPIHLFEDATIQDAIDLMIRHSISGIPVVEHPTPEGCLLLKGIVTNRDLRMTASSDEKITTIMTTNLVTAKEGIDLLTAEDILMRNKIEKLLIIDDNGYLKGLITFKDIQKRKQCPDACKDSQGRLRAGAAVGIRANTMSRVDALVAAGVDVVAVDTAHGHSQAVLDMVATIKQKYPELQVIAGNVATPEAVRDLVKAGADAVKVGIGPGSICTTRIVAGVGMPQLTAIMKCAEEAKKTDIPLIADGGIKYSGDIAKALAAGADSVMMGSVFAGTDESPGETILYEGRRFKAYRGMGSLGAMSEPEGSSDRYFQDVSAETKKYVPEGIEGRIPAKGKLDEVVYQLIGGLKSAMGYCGVRTITELKENTRFVRITSAGLRESHPHDVMITKEAPNYSTSA

SEQ ID NO: 15386 - protein, 416 aa, Chlorobium tepidum TLS
MLDSHFFSFSDGILCCESVALDELARQFGTPLFVTSRQSLVSQYRSFEEAFASLPHFTCYSVKANFNLAVIRTLAEEGCGCDVNSGGELYRALTAGVPANKIIMAGVGKSEAEIKYGLTSGVMMIKAESISELKAINSVAEHLGKVAQVGVRINPNVTAETHPYITTGDSKEKFGIDEAGLGEVFELFKTLPNLELHGLDMHIGSQIFDPEYYVAATQKLLEVLESARHLGFDIKWLDLGGGFPVTYDPQKPAPPITKFAEKLIPMLQDKGVTVIFEPGRFIAANASVIVTKILYRKKNQIGKEFFIVDAGMTELIRPALYQSHHEVLSVKQHDRSVVADVVGPICESSDFFARHRTIDDAPEGELLAVLSSGAYGAVMSSNYNGRLRPAEVMVDGDEVTLTRRRETYEQLVQNEL

SEQ ID NO: 15387 - protein, 273 aa, Chlorobium tepidum TLS
MSVQDIWSLIREEACLECEREPEIRLFLEQHILRYEEFAPALAMLLSVKLGSKHFPPPVLEGIFEDFYRQSPESVRCAACDMEATRERDPAAVNYFEIMLFLKGYQALQSYRLAHWLWQNDRKSLAYFLQNRMSEVFAVDIHPAAKIGKGILLDHATSLVIGETAVVEDNVSLLHEVTLGGTGKDSGDRHPKVGKSVMIGAGAKILGNIKIGEGAKVGAGSVVLDDVPPHYTVAGVPAHIVGRTEVPEPSLDMNQRLIFPEKQKPKGEQHSCL

SEQ ID NO: 15388 - protein, 116 aa, Chlorobium tepidum TLS
MLMIRTIVRPEKVHDVMQGLLDAGYPAVTKISVVGRGKQRGLRVGDVVYDELPKEMLFLVVPDADKDFVIRAIMDNAKTGDGKFGDGKIFVSAVEEVYTISSGMKESETLLEAKEA

SEQ ID NO: 15389 - protein, 125 aa, Chlorobium tepidum TLS
MKEIISVIRINKVNETKKALIDAGIPAFTATGRVMGRGKGQVHYDILQGAEAGHPEAIAQLGNAPRLVAKRILTVVVPDDLAQTAIDTIIKTNQTGKPGDGKIFVTPILDTIRVRTGEEGDEALK

SEQ ID NO: 15390 - protein, 457 aa, Chlorobium tepidum TLS
MIVTINPATGEQLAEYPVMIAGQIDSVLRQADADFRRWRSTSFGERRTCMKRLAELLREQAEKHGRIITLEMGKPFSQAVAEVNKCAWVCDYFADHAEEFLQPEQSEIDGAKGIVAFEPLGVILGVMPWNFPYWQVLRFAAPILMAGNGIVVKHAPNVTGCAIAIEKLFRDAGFPEHLYRAVHIDLDEVDRLTGFMIDHPVIKAVSVTGSTGAGQAVAAKAGKALKRSVLELGGSDPYIVLEDADLAQAVDACVAGRLLNAGQSCIAAKRFIVRKEIIGEFTKKIVQRMQTAVMGDPFAKSTEVGPIAREDLRDLVHSQVQRSVEAGAELLWGGHVPNAPGWYYPPTVLSGVKPGMPAYSEEIFGPVATIIEVADDDEAVAIANDSEFGLGSAVFSQDVERALGIARRLEAGSCFINTMVKSDPRLPFGGVKQSGYGRELSHHGIREFVNIKTFYLP

SEQ ID NO: 15391 - protein, 915 aa, Chlorobium tepidum TLS
MPNSHANEESAAAKKYIYSFAGGAAEGDASMKNLLGGKGANLAEMANIGLPVPPGFTLSTEVCAYYYDHQKTYPANLFETEIPAALKKVEDYLGKKFGDPENPLLVSVRSGARASMPGMMDTILNLGLNDKTVEGLARKSGNPRFAWDCYRRFVSMYGDVVLDLKPADKKQIDPFEEILEQKKQELGIHLDTELGVDDLKDLVGKYKKAILEKTGKTFPENPEEQLRGAISAVFNSWNNERAIVYRKLNHIPGWWGTACNVQAMVFGNMGEDCGTGVAFTRDAATGDNIFYGEFLMNAQGEDVVAGTRTPLKIEQLAQEKPAIYNQLEEIRSILEKHYRDMMDIEFTIENDKLFMLQCRVGKRTGLAAIKIAVDMYNEGLIDEKEVLRRIEPEQLNQLLRPVFDLKEKKAAIDSGRLLATGLNAGPGAATGRVYFNADDAMEANARGEKVILVRIETSPEDIKGMNAAEGILTERGGMTSHAALVARQMGKVCVAGCGTLRIDYKAGEMRVAGKDIVIKEGEYISIDGTTGEVIAGEVKTKNSEILEVLIDKTLDPADAPTFRIYNQLMQWADKYRKLNIRTNADQPDQAEIAITFGAEGIGLCRTEHMFFGGDRIDAMREMILADDIAGRKVALDKLLPYQRDDFYGLFKAMGSRPVTVRLLDPPLHEFLPHTDAEIDDLAGKIGKTSAEIKARIESLHEFNPMLGLRGCRLGILHPEIIVMQVRAIIEAACRIKQEGQEIVPEIMVPLVSTVKELEITSEVIHKTARSVISEQGVGVKYLVGTMIEVPRAAITSDQIAQAADFFSYGTNDLTQMGLGMSRDDSGQFLPIYQQQEIFARNPFESIDIDGVGRLVSISAKEGRSVKPDLKLGICGEHGGDPATVEFCHKTGLNYVSCSPFRVPIARLAAARAALL

SEQ ID NO: 15392 - protein, 290 aa, Chlorobium tepidum TLS
MLKSWQLLKSFHCRSNSFINQEREVFMAKYKLDVNIANVNEVYDGAGGILWEMLMGEQIHVGAEAETDVLARKAGVTAETHLLDVCSALGGPARYLAKNYGCRVTGLDATQRMHAEAIRRTIEAGLSGKIDYVLGNALDMPFPASSFDVVWGQDAWCYITDKQRLIGECARVLKPGGVLAFTDWLEAGPMTDEELTALNTFMVFPYMETLDGYAMLAEQAGLTVIEKEDLTPDFAAHVQGYLDMVQNQYRQAIVDNYGQEMYDAVEQGIMLWRDASAAGKVGRGRLVARK

SEQ ID NO: 15393 - protein, 1228 aa, Chlorobium tepidum TLS
MNDNLYSLIEQRILVLDGAMGTMIQRHGLDEQDYRGERFASHDHPLKGNNDLLVITRPDIIRSIHCDFLDAGADIIETCTFNANPISQSDYQLQDLTRELNVAAAKIARSAADEFTAKTPDKPRFVAGSIGPTNKTLSLSPDVNNPGFRAVTFQEMVDNYTAQLEGLHEGGVDLLLVETVFDTLNCKAALYAIEEYAVKTGWQVPVMVSGTVVDASGRTLSGQTTEAFWISISHMPSLLSVGLNCALGSKQMRPFIEALSNIAESYVSVYPNAGLPNEFGEYDDSPEYMAAQIAGFAESGFVNIVGGCCGTTPTHIRAIAEAVKTLPPRKRPANKHVLRLSGLEPLVVDETTGFINVGERTNVTGSRKFARLIKEANYDEALSIARQQVENGAQVIDVNLDEGMLDSEKVIVEFLNLIASEPEIAKVPVMIDSSKWSVIENGLRCTQGKSIVNSISLKEGEELFKERARKIMQYGAAAVVMAFDEQGQADSLHRRIEICSRAYKILTEEVGFPPEDIIFDPNVLTVATGIDEHNNYALDFIESVRWIKQNLPHAKVSGGISNVSFSFRGNEPVREAMHTAFLYHAIHAGLDMGIVNAAQLGIYEEIDPELLVYVEDVLLNRRDDATERLVAFAETIRDGGEKAEAKNAEWRNAPVEERLKHALVKGIVDYIDEDTEEARQLYPSPLEVIEGPLMNGMNHVGDLFAEGKMFLPQVVKSARVMKRSVAALIPYIEEEKSKNCDTSAKAKVLLATVKGDVHDIGKNIVSVVLACNNFDVIDIGVMMPCDKILEALAEHKPDVLGLSGLITPSLEEMAHVAKEMERLGMNIPLIIGGATTSKVHTAVKLAPCYPSGAVVHVLDASRSVPVVSNLCNPAQRDSYIAALKDEQEAMRKSHAERMAAKKYVSLDAARDNRLTIDWEAETIDKPAQTGVTVLEDVTVGALRPYIDWAPFFWSWELHGVYPQILEDEKVGEEATKLFNDATALLDRIDSEKLLGIKGVAGIFPANSIGDDIFVYADDERSIIRTVLHTLRQQGEKHGEANLALADFVAPRESGVNDWIGCFTVTAGLGIQNLLDEFTAENDDYHRIMTQALADRLAEAFAEMLHEKVRRELWGYAPGEILGNEELIAEKYRGIRPAPGYPACPDHTEKAIIFDLLNAEAATGVTLTETFAMNPAASVCGLYFANPASKYFVLGKIGKDQVEDYANRKGLEVAEAEKWLAPSLNYDPA

SEQ ID NO: 15394 - protein, 427 aa, Chlorobium tepidum TLS [sequence omitted]

SEQ ID NO: 15395 - protein, 245 aa, Chlorobium tepidum TLS
MFTGKTAVVTGAARGIGQSIALDLAAKGADLVIGDIKAEWLTETEEALKQLGAKVSCKELDVTSTDACQKVFDEVAKENGRIDILVNNAGITRDGLLMRMSEEDWDAVLTVNLKGVFNCTKAVTRTMMKQRSGSIINIASIIGLMGNAGQANYAASKGGVIAFTKSIARELASRNVRANAIAPGFISSKMTDALSEEVRQKMLEAIPLGVFGTPQHVADAVAFLASDQSAYITGQVLSVNGGMYM

SEQ ID NO: 15396 - protein, 333 aa, Drosophila melanogaster
MDCCLSDQACEERRISREIDKFLKAEKKKARRELKLLVLGFLDKERKQFTKNVFQNIFMAIQSMISAMDTLRIPYGQQEHSKLADLVKSIDYKTVTRLEAPYLNAIKTLWKDAGIKECYNRRREYQLTDSTEYFLNDIARIERSDYQATDQDILHVRAPTTNIVEYPFNLDGFLIRLVDVAGQRTERRKWIHCFSNVTSIMFLVAMSEFDLSLAESENDNRMKESKALFHNIISFSWFQHSSVILFLNKEDLFKKKILSTHLADYFPEYNGPKKDAKAAREFILYMFTSVNPDPYKCIYPHFTVATNTENIKFVFTAVKDTILELHLSETNLL

SEQ ID NO: 15397 - protein, 150 aa, Narcissus pseudonarcissus
KGRWEKPGHSPLFGYDFWYQPRHKTMISSSWGAPAAFTKGFNLQHVSDGLYGRHLNVYSWPDGELKQTMDLGNTGLLPLEIRFLHDPSKDTGFVGCALTSNMVRFFKTSDGSWSHEIAISVKPLKVKNWILPEMPGLITDFLISLDDRFL

SEQ ID NO: 15398 - protein, 296 aa, Oryza sativa
  unsure (1)..(296): unsure at all Xaa locations
MYDELASKGNVEYIAGGATQNSIRVAQWMLQTPGATSYMGCIGKDKFGEEMKKNAQAAGVTAHYYEDEAAPTGTCAVCVVGGERSLVANLSXANCYKSEHLKKPENWALVEKAKYIYIAGFFLTVSPDSIQLVAEHAAANNKVFLTNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 15399 - protein, 333 aa, Nicotiana tabacum
MSKARVYTDINVLRPREYWDYESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYRLELDPQLEAMVGRHSRKPWSKFINADNQHLVSPEAIDFLDKLLRYDHQSRLTAKEAMAHTYFLQVRAAETSRMRTQ

SEQ ID NO: 15400 - protein, 333 aa, Nicotiana tabacum
MSKARVYTDINVLRPREYWDYESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRNLRLIDWGLAEFYHPGKEYNVRVASRYFKGPELLVDLQDYDYSLDMWSLGCMFAGMIFRKEPFFYGHDNQDQLVKIAKVLGTDELNAYLHKYRLELDPQLEAMVGRHSRKPWSKFINADNQHLVSPEAIDFLDKLLRYDHQSRLTAKEAMAHTYFLQVRAAETSRMRTQ

SEQ ID NO: 15401 - protein, 312 aa, Nicotiana tabacum
ESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQSRLTAKEAMAHPYFLQVRAAETSRMRTQ

SEQ ID NO: 15402 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVVGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 15403 - protein, 81 aa, Boltenia villosa
  unsure (1)..(81): unsure at all Xaa locations
YEILNSPDLACRLAKAAFDDAIAELDTLSEDSYKDSTLIMQLLXFNLTLWTSDLNPPEGEGEDVKGEQEILQDVEATDEAS

SEQ ID NO: 15404 - protein, 128 aa, Boltenia villosa
MAGGKAGKDSGKAKAKAISRSARAGLQFPVGRIHRHLKSRSTSHGRVGATAAVYSAAILEYLTAEVLELAGNASKDLKVKRITPRHLQLAIRGDEELDSLIKATIAGGGVIPHIHKSLIGKKGQQKAP

SEQ ID NO: 15405 - protein, 692 aa, Mus musculus
MKVFCGRANPTTGSLEWLEEDEHYDYHQEIARSSYADMLHDKDRNIKYYQGIRAAVSRVKDRGQKALVLDIGTGTGLLSMMAVTAGADFCYAIEVFKPMAEAAVKIVERNGFSDKIKVINKHSTEVTVGPDGDLPCRANILITELFDTELIGEGALPSYEHAHKHLVQEDCEAVPHRATVYAQLVESRRMWSWNKLFPVRVRTSLGEQVIVPPSELERCPGAPSVCDIQLNQVSPADFTVLSDVLPMFSVDFSKQVSSSAACHSRQFVPLASGQAQVVLSWWDIEMDPEGKIKCTMAPFWAQTDPQELQWRDHWMQCVYFLPQEEPVVQGSPRCLVAHHDDYCVWYSLQRTSPDENDSAYQVRPVCDCQAHLLWNRPRFGEINDQDRTDHYAQALRTVLLPGSVCLCVSDGSLLSMLAHHLGAEQVFTVESSVASYRLMKRIFKVNHLEDKISVINKRPELLTAADLEGKKVSLLLGEPFFTTSLLPWHNLYFWYVRTSVDQHLAPGAVVMPQAASLHAVIVEFRDLWRIRSPCGDCEGFDVHIMDDMIKHSLDFRESREAEPHPLWEYPCRSLSKPQEILTFDFQQPIPQQPMQSKGTMELTRPGKSHGAVLWMEYQLTPDSTISTGLINPAEDKGDCCWNPHCKQAVYFLSTTLDLRVPLNGPRSVSYVVEFHPLTGDITMEFRLADTLS

SEQ ID NO: 15406 - protein, 795 aa, Mus musculus
MSARTPLPTVNERDTENHTSVDGYTETHIPPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKCIVHRDLKAENLLLDADMNIKIADFGFSNEFTVGNKLDTFCGSPPYAAPELFQGKKYDGPEVDVWSLGVILYTLVSGSLPFDGQNLKELRERVLRGKYRVPFYMSTDCENLLKKLLVLNPIKRGSLEQIMKDRWMNVGHEEEELKPYSEPELDLNDAKRIDIMVTMGFARDEINDALVSQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDTARRLGSTTVGSKSEVTASPLVGPDRKKSTASPSNNVYSGGSMARRNTYVCERSTDRYAALQNGRDSSLTEMSASSMSSAGSTVASAGPSARPRHQKSMSTSGHPIKVTLPTIKDGSEAYRPGAAQRVPAASPSAHSISASTPDRTRFPRGSSSRSTFHGEQLRERRSAAYNGRPASPSHETGALAHARRGTSTGIISKITSKFVRRDPSEGEASGRTDTARGSSGEPKERDKEEGKEAKPRSLRFTWSMKTTSSMDPNDMLREIRKVLDANTCDYEQKERFLLFCVHGDARQDSLVQWEMEVCKLPRLSLNGVRFKRISGTSIAFKNIASKIANELKL

SEQ ID NO: 15407 - protein, 450 aa, Mus musculus
PRAGWLAGLLYPDTRPLELALLILGVGLLDFCGQVCFTPLEALLSDLFRDPDHCRQAFSVYAFMISLGGCLGYLLPAIDWDTSVLAPYLGTQEECLFGLLTLIFLICMAATLFVTEEAVLGPPEPAEGLLVSAVSRRCCPCHVGLAFRNLGTLFPRLQQLCCRMPRTLRRLFVAELCSWMALMTFTLFYTDFVGEGLYQGVPRAEPGTEARRHYDEGIRMGSLGLFLQCAISLVFSLVMDRLVQKFGTRSVYLASVMTFPVAAAATCLSHSVVVVTASAALTGFTFSALQILPYTLASLYHREKQVFLPKYRGDAGGSSGEDSQTTSFLPGPKPGALFPNGHVGSGSSGILAPPPALCGASACDVSMRVVVGEPPEARVVTGRGICLDLAILDSAFLLSQVAPSLFMGSIVQLSHSVTAYMVSAAGLGLVAIYFATQVVFDKNDLAKYSV

SEQ ID NO: 15408 - protein, 527 aa, Homo sapiens
MATTATCTRFTDDYQLFEELGKGAFSVVRRCVKKTPTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 15409 - protein, 443 aa, Drosophila melanogaster
LRQALAEAAQGDHSGGHDDNGASNYMGSNLEENVTCKALYSYKANKPDELSFPKHAIITNVQRDNSMWWIGDYGGMIKKHLPANYVKVIDSTTEDYNSLNEEGTDGRTDSIEIFGAVASLFESNDPGIIFKLQIQTPTMQNPFVIGFDNQETAYEWIKAIQEAALIASQLASERRKKERTARVAKEMSDLIIYFRSVPFREHSWIFQEMSSFPETKAEKQFFQQNTQLFLSYHRNQISRVYPKGQRLDSSNFNPMPFWNVGSQMIALNYQTGDKAMQLNQAKFRNNGQCGYILKPSFMKSDSFNPNNPLCDGLSEVKVSIRLIAARHLFRGGKSNNPQIVVELIGASFDTGVKYRTKVNENGFNPVWNESCEFNVRNPQFAILRFEVQDEDMFAETHFIAQACYPLTCIRQGYRSVILRNKFSEELELSSLLINIKIANVTAP

SEQ ID NO: 15410 - protein, 999 aa, Drosophila melanogaster
MSIRTEQDYDSATPALAQQMNLARRACWRIKSYSSESLFKTYASVITDTSANEIDAEAPPPPRDKTKTRIEPQIAPAKRNSSCTSSDWRGMFSKRTLLICALALILGSAQARPNTSAVGVAPRKVSQDIVDAVTQLNLGQSAPIDAVDVGLDPTPSARVPRPKPLKSGDENAKGDEGHKMERYPLSSVDFARVKTPFIIGIWILSASIAKIGFHMTPKLHLIFPESCLLIVVGVVIGVVLYFCTDVAVSPLTPNTFFFYMLPPIILDAGYFMPNRLFFDNLGTILLMAVVGTIFNIATIGGSLYACGKMGIYGESETPGLMDVFLFASLISAVDPVAVLAVFEEIHVNEILYIVVFGESLLNDAVTVVMYHMMESYNEIGLDKIIAQDIASGVGSFFVVALGGTAIGIIWGFLTGLVTRFTDHVRVIEPIFIFVMAYLAYLNAEIFHMSGILAITFCGITMKNYVESNISQKSHTTVKYALKMLSSSAETIIFMFLGVATVNNMHVWNTWFVVLTIAFCSVFRVIGVILLSALANRFRLHKLSRVDQFVMSYGGLRGAVAFALVLLVDENVVKQKNMFVTTTIAVIYFTVFLQGITIKPLVKILNVKRANKRKPTMNERIHERFMDHLMAGIEDIVGKTGNYNVRDKFKRFDNRFIRPLLIRDLKGAEPKIIETYSKLTMRDAMEVMRRNPSTIGQMTGTESMSALFRNYTNNYIGGRWAPPTIYTTCPSLTNLDNTCSRNLDMAELDYNPSKKDLTDARIHHLLAEELKPYRRHRRLSYSRHAVDDRDLSTQVNYKMQMNFRRMFNDRKHHKRSKRGASNKEAKENVKQNHVSFHDFQQNGTTKQLTNAEECQQNPNEINVVGPSDDWDDGLTFTAKSSLAEHPIPEEDRNLSRESDGERRVATPTATESQLPWKRQGDECTDAVQQNEFPAWASNKEYLAYNSPSATFLGGINKPKQPKSVIGLFRRESSSSKAGSVGVGSTGAMDSAASGSEKKKK

SEQ ID NO: 15411 - protein, 326 aa, Drosophila melanogaster
MGLTRVLVKDGGFGTQMTVHVGDSVDGDPLWSARFNATNPAAIISTHLDFLQNGADIILTNTYQSSVDGYMEYLELDEEQSIELIKNTVRLAHIAKERYLTECYQAQLSVQEGYPLIIASIGPFGAHLHDGSEYTGSYADFVPAKEITDWHRVRIEACLEAGVDALAIETIPCQMEAEALVEMLCDDYPDVKFWVAFQCKDENTLAHGETFADAANAIWDLLAERNAQDKCLAIGVNCVHPKFVTPLFKSLNGDREVGEQIPLVVYPNSGEVYDVVNGWQGREHCVPLANYVPEWGNWGPRSLGDAVALMRGIYATSGRPFATGTN

SEQ ID NO: 15412 - protein, 384 aa, Synechococcus sp.
MTQATELLDPALKPAETKAKRSSRKKATTAVVEPATTIAPTADVDAIDDEDSVGEDEDAAAKAKAKVRKTYTEDSIRLYLQEIGRIRLLRADEEIELARQIADLLALERIRDELLEQLDRLPSDAEWAAAVDSPLDEFRRRLFRGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIEADGETPEDEVAKNLLREDLEGVLSTLSPRERDVLRLRYGLDDGRMKTLEEIGQLFNVTRERIRQIEAKALRKLRHPNRNSILKEYIR

SEQ ID NO: 15413 - protein, 381 aa, Toxoplasma gondii
MRQCFIDEDFRLSLRFLATTSTVFFRRHCHTMAASGHPIPELGEFIIANKEKLRNTGQESEMNRLLTAIKLAAKVVNREINKAGLADILGAAGNQNVQGEEQQKLDVFANHKFIQALVNREVVCGICTEEDDDFIEVNRDAHFVMLMDPLDGSSNIDVNVSVGTIFSIYQRVSPLGSPPELRDFLQPGNAQIAAGYVLYGSSTMLVMTTGDGVNGFTLDPSLGTFFLSHRGMRFPEKARIYSVNEGNYKAFPDGVKKFLEECHDDKTGPFSLRYIGSLVSDFHRNLLQGGIYMYPPTKKDKKGKLRLLYEANPMAFLAEQAGGKATDGFDRIMDIQPSELHQRVPLMIGTARLVDRVDALMVEHSPECRLHANCLVGKNSS

SEQ ID NO: 15414 - protein, 549 aa, Malus x domestica
MWDLNDSPDQRPRGEESEGCSSQKTSADGDEEKRKRVGSVSNSSSSAVVIEEDGSDQEEDQDDGPTKLAKKQGGGGGKIFGFSVAHEESMDSDPPATVTRQFFPVELDYSSSSNLDVMGPAEGGGSIPPPPSTSSSFPRAHWVGVNFGQSDSGSPGNPPPAGEASHQPMKKSRRGPRSRNSQYRGVTFYRRTGRWESHIWDCGKQVYLGGFDTAHAAARAYDRAAIEFRGVEADINFSIEDYEEDLKQMRNLTKEEFVHVLRRQSTGFPRGSSKYRGVTLHKCGRWEARMGQFLGKTYVYLGLFDTEVDAARAYDKAAIKCNGKEAVTNFDPSIYDNELNSSESSGVIAADHNLDLSLGSTNSKKNNQALGNDHHSQNVAMEHQHSVSMQLDANWRSQGLRPKLNIQRDRSRDDIDAQRRDGYSESEAMQLLLRTNLQSQAPAEVHKYGQFNRRLTAGDIQMSHNFPPNFNSPNYHHIQFPSSSEGGGRIGSDLSLSTSDHQQQWQSATPTSNLFATAAASSGFPPQLRPLPTQNSWLQKNGFHTLARR

SEQ ID NO: 15415 - protein, 725 aa, Rhodopseudomonas palustris [sequence omitted]

SEQ ID NO: 15416 - protein, 577 aa, Homo sapiens
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 15417 - protein, 362 aa, Halocynthia roretzi
MSGMKAMSGVKVTVRGQVFDVGPRYVDLSYIGEGAYGMVVSATDNFTGHKVAIKKISPFEHQTYCQRTLREIKILLSFNHENIIAIQDIIRSSAMEMMKDVHIVQDLMETDLYKLLKTQKISNDHVCYFLYQILRGLKYIHSANVIHRDLKPSNLLLNTTCDLKVCDFGLARVSDPDHDHTGFLTEYVATRWYRAPEIMLNSKGYTKSIDIWSVGCILAEMLNNRPLFPGKHYLDQLNHILGVLGSPNNEDLSCIINEKARAYLLSLPLKPKVPWVGMYPNADKKALDLLDKMLTFNPNKRITVVEALAHPYLEQYYDPADEPVAEKPFTFEEELDDLPKEKLKQMIYDTTDPAKFPGPHPT

SEQ ID NO: 15418 - protein, 913 aa, Trypanosoma brucei
MVAKKWVYYFGGGNADGNKNMKELLGGKGANLAEMVNLGIPVPPGFTITTEACKTYQETETIPQEVADQVRENVSRVEKEMGAKFGDPANPLLFSVRSGAAASMPGMMDTVLNLGLNKVTVDAWVRRAPRLERFVYDSYRRFITMYADIVMQVGREDFEEALSRMKERRGTKFDTDLTASDLKELCDGYLELFELKTGCSFPQDPVMQLFAAIKAVFRSWGNPRATIYRRMNNITGLLGTAVNVQAMVFGNINDRSATGVAFSRSPSTGENFFFGEYLVNAQGEDVVAGIRTPQQINHSLSLRWAKAHGVGEEERRKRYPSMEEAMPENYRLLCDVRKRLENHYRDMQDLEFTVQDGRLWLLQCRNGKRTIHAAVRIAIDMVNEGLISREEAVLRIDPYQVDHLMHPNLEPGAEKANKPIGRGLAASPGAAVGQVVFDAESAKEWSGRGKKVIMVRLETSPEDLAGMDAACGILTARGGMTSHAAVVARGMGKCCVSGCGDMVIRGKSFKLNGSVFREGDYITIDGSKGLIYAGKLKLRSPDLKGSFQTILQWCQEMKRLGVRTNADTPADAAKARSFGAEGVGLCRTEHMFFEGSRINFIREMILADSASGRKAALDKLLPIQRADFVGILRAMRGLPVTIRLLDPPLHEFVPHDAAAQFELAQKLGMPAEKVRNRVNALHELNPMLGHRGCRLGITYPEIYNMQVRAIIEAAIAVSEEGSSVIPEIMVPLVGKKEELSLIREEVVKTAEAVITKSGKRVHYTVGTMIEVPRAAVTADSIAQKADFFSFGTNDLTQMGCGFSRDDAGPFLRHYGNLGIYAQDPFQSIDQEGIGELVRIAVTKGRRVKPMLKMGICGEHGGDPATIGFCHKVGLDYVSCSPFRVPVAIVAAAHASIKDRRAAMKARKGFAAKL

SEQ ID NO: 15419 - protein, 423 aa, Thermus thermophilus
MKKSKRKNAQAQEAQETEVLVQEEAEELPEFPEGEPDPDLEDPDLALEDDLLDLPEEGEGLDLEEEEEDLPIPKISTSDPVRQYLHEIGQVPLLTLEEEVELARKVEEGMEAIKKLSEITGLDPDLIREVVRAKILGSARVRHIPGLKETLDPKTVEEIDQKLKSLPKEHKRYLHIAREGEAARQHLIEANLRLVVSIAKKYTGRGLSFLDLIQEGNQGLIRAVEKFEYKRRFKFSTYATWWIRQAINRAIADQARTIRIPVHMVETINKLSRTARQLQQELGREPTYEEIAEAMGPGWDAKRVEETLKIAQEPVSLETPIGDEKDSFYGDFIPDEHLPSPVDAATQSLLSEELEKALSKLSEREAMVLKLRKGLIDGREHTLEEVGAFFGVTRERIRQIENKALRKLKYHESRTRKLRDFLD

SEQ ID NO: 15420 - protein, 183 aa, Mus musculus
MSMWTGPLSLHEVDEQPQHLLRVTYTEAEVEELGQVLTPTQVKHRPGSISWDGLDPGKLYTLILTDPDAPSRKKPVYREWHHFLVVNMKGNDISSGNVLSDYVGSGPPKGTGLHRYVWLVYQQDKPLRCDEPILTNRSGDHRGKFKTAAFRKKYHLGAPVAGTCYQAEWDSYVPKLYKQLSGK

SEQ ID NO: 15421 - protein, 499 aa, Trametes versicolor
GIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 15422 - protein, 363 aa, Toxoplasma gondii
MAVDSSNSATGPMRVFAIGNPILDLVAEVPSSFLDEFFLKRGDATLATPEQMRIYSTLDQFNPTSLPGGSALNSVRVVQKLLRKPGSAGYMGAIGDDPRGQVLKELCDKEGLATRFMVAPGQSTGTCAVLINEKERTLCTHLGACGSFRIPEDWTTFASGALIFYATAYTLTATPKNALEVAGYAHGIPNAIFTLNLSAPFCVELYKDAMQSLLLHTNILFGNEEEFAHLAKVHNLVAADKTALSTANKEHAVEVCTGALRLLTAGQNTGATKLVVMTRGHNPVIAAEQTADGTVVVHEVGVPVVAAEKIVDTNGAGDAFVGGFLYGLSQGKTVKQCIMCGNACAQDVIQHVGFSLSFTSLPC

SEQ ID NO: 15423 - protein, 530 aa, Drosophila sp.
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDQHRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKEDKKGTVDRSTTVVSKEPEDIRILCPAKTYQQNIGNSQCSSARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 15424 - protein, 345 aa, Oryza sativa (japonica cultivar-group)
MGRSPCCEKEGLKKGPWTPEEDQKLLAYIEQHGHGCWRSLPSKAGLQRCGKSCRLRWTNYLRPDIKRGKFSLQEEQTIIQLHALLGNRWSAIATHLPKRTDNEIKNYWNTHLKKRLAKMGIDPVTHKPRSDVAGAGGGGGGAAGGAAGAQHAKAAAHLSHTAQWESARLEAEARLAREAKLRALAASATPGAPHLPAPPASAAAAAAAHGLDSPTSTLSFSESAVLATVLEAHGAAAAAAARAAMQPMQAYDEACKDQHWGDVDAADVGFPGAGAGFTGLLLEGSLNQIPRPAGRDAEADGEFQETEEEKNYWNSILNLVNSSSAPMSTAVVVPASHAYSPAPDF

SEQ ID NO: 15425 - protein, 604 aa, Homo sapiens
IMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 15426 - protein, 519 aa, Homo sapiens
NAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTD

SEQ ID NO: 15427 - protein, 768 aa, Homo sapiens
RLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPQGQEAPGHQRDPSALTPRGRGGRGPPSTPLPCPPTVNL

SEQ ID NO: 15428 - protein, 349 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 15429 - protein, 737 aa, Homo sapiens
KMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKETKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 15430 - protein, 716 aa, Homo sapiens
EKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVKRGGHYSSAYSTAKSPVNGTPSSQLSTPKSTKSSSSSPTSPGSFRGLKQISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTVLDKEGQIFCSKHCQDSGRPGMEPISPVPPSVEEIPVPGEAVPAPTPPESPTPHCPPAAPGGERAGTWRRHRD

SEQ ID NO: 15431 - protein, 413 aa, Oryza sativa (japonica cultivar-group)
MRRCGSSSGGRFTGGGGQKGRWPGFEGKRAAPVVKWSHAEAMKKKPSGRGDAAVTGDGGGWMRRLEEEEAGLELDGSCWGSWSEAAATRASGTATGGAGKHVRFRPEAEAEAKRERPFDAGEWGGGGGGEVGGDGGEGRMYEWRWTEAVSPEILALILRGRVDADEVARGAARVCRAWREAAAAPDVWGDVDIEAWCRRVNCRPRADAAVRRLVALARGTLRQLSAYRVGDAALAYVAASGKLLNVLQIPMSEISDQAVKKYAEFLPALRVLDISNCLKISSSGIEALGRHCKLLVQLKRNMPPPDVPHGYNAVPNVVNDEALAIANTMPVLEHLELAYGLFSDTGLGAILTRCPRLQTLDILGCWNVRLEGDIELRCCALESFREPWEPMYSDCSSTGSDNDDDDEDNDSDN

SEQ ID NO: 15432 - protein, 323 aa, Oryza sativa (japonica cultivar-group)
MAVVVPEAVLRHGDARPMPAVGMGVAEYPSTPERTRDAVLAALEAGFRHFDTASLYRTEAPLGEAIAEATRRGLLASREEAFVTTKLWCTQCHPDLVLPSLRESLRNLQMEYVDLYLIHLPISVKPGPMVFPVKKEDVVPFDFGGVWRAMEECHRLGLAKAIGVSNFTTKHIDKLLAVATILPAVNQVEMNPTWQQRTVREYCDAKGIRVTAYSPLGGQNWGGSANYVMESSVLTEIARARGKSIAQVSLRWIYEQGVTPIAKSYRKERLKENLEIFDWELTDEDRLKISQIPQRKRVTAASLFSPDGEFTSVDLPDIEIVEE

SEQ ID NO: 15433 - protein, 333 aa, Oryza sativa (japonica cultivar-group)
MASPGSSGRCSRTPGFPAGPLGGGGRAVPAVGLGTASLRSVGEESFRGALLAALEVGYRHIDTASVYGSERVVGEAVAGAARRGVIACREEVFVTTKVWCTQCHPDLVLPSLRESLQNLQMEYVDMYLVHWPMSVKPTKPHYPMKREDIMPMDLRGVWQAMEECHQLGLAKMIGVSNFTTKKLQELLAFAKIPPAVNQVELNPVWQQKKLMEFCKAKGIHVTAYFPLGGRHSTSTVNPVLDSDVLKEIAAAKGKSVAQISLRWIYEQGASMVTTSTKRERLKENIDIFDWQLSDEDRLKISQIPQHKTVSVLSILCPDGVSSVELSEVDVVEV

SEQ ID NO: 15434 - protein, 333 aa, Oryza sativa (japonica cultivar-group)
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADADGEDEEMYSSAAAAVAALMAPGGSDADYGVDGVVPTF

SEQ ID NO: 15435 - protein, 469 aa, Oryza sativa (japonica cultivar-group)
MAESRIFGGLKPTKSRLLGPTIRGPPPNGAATHAPRRILFSFSPESQWLGQSSTRACLPPLRSPCLPAPSAASPAYPRLASSAASASAPARLRSRITLPGGRSPVPPMDPAASAAESSSLSSRDVAAMPDSPPRRAARHRRAQSEILLGAALPDDIAFDADLGVVGEVGGGGGDDYEEEEEDDEEEEMEGAGGSRMFEMFLEAGGKLETPEPAAPLPPPPARPRHQHSMSMDGSTSLASSAAGVAGRMGADAKKAISDAKLAELALVDPKRAKRILANRQSAARSKERKMRYIAELERKVQTLQTEATTLSAQLSMLQRDTTGLTSENSDLKIRVQTMEQQVRLQDALNDRLRDEIQQLKVATGQVNANCGKVGNFGLSSFGGANPQGYQRSHIQSLLAAQQLQQLQIHSQHQQQQMHLQQHHHLSTVQQQLLQEGLPLPGDLKMKGIVAASHAQNAGASESHALRSEP

SEQ ID NO: 15436 - protein, 515 aa, Oryza sativa (japonica cultivar-group)
MFSLLIQSVDFTDDAAAAAATAVAAGETSGTSHPLSPRSGDPLPTTTSASVTAPLELPGATSASPARNPKINYTRGILHLYRSSSSSSSTASYASAVAATPSSSSSGPAAPQLASDCLLPPWRGTRLLVLAVPTHVSPDDFVRFCGPYIEHASDIHVVRDDGVEDRYSVLVEFEDQKSADGFYLDLNGWRFSSSEVEVCHVLFIVAVQYTPSTKPAVTPPVGSTELPTCPVCIGGDQVCQFCQKQSKNPTCSVCQTSGNLWICIICGFVGCGRYEEGHAIRHWKETQHCYSLDLETQRVWDYVGDSYVHRLNHSKSDVKHSKFKSKCKYSGDKCANCSCNDEEDIGGAIFSSKAETIVDEYNRLLASQLETQREYYEARLSEAKKEKEQHISDAVDKAVNDKSKEIQQKIENAMLEKKKLADMNEKLTKNQDIWRRTLKEIEERERAQLKLKDDTIRDLEEQIKDFKFSIKLQKSIEKNKNADDLKGGLLVPLPMVPDSGTKGKRSSRTSKRRNQ

SEQ ID NO: 15437 - protein, 667 aa, Oryza sativa (japonica cultivar-group)
MQGQKNSVEQLADVFGFDHASSSGNPVMDQQGYWNNILGSVESHNLQGYQVNRSDGTIPYGNGVHQNGTFLGFWESGEASASGSSLHFGGSNEIKAEQRNIGGGLRIGERRLVAERNLSLDNVDIGLNINGNDLSGENSNVNGASQGSELHGGCSHTGSNGQASELRLHPYRTFILGADQPEPFNSLNGSENPLGDFSLMPEGIDQRPGSSLDGRRLACKRKNIEGVNGQCSAGASTSFSHRNDSIFHNIASSSHNPSPSTNLPSPNCLLVPSTLDEQLPRYGATTAGLSSSSYDPSGGNNNSGGSQRSFRPRTSLAQHIGPYGVWPSSSTIRHSNSWNHQPPPFQSSFDEPPEVIPVVSSLNFQYQHPMNVVPGIPQMSHRFTGPGASSSRTGNLENRIIGSEEFSARNVVATSFPDAVPPAALDMRHLIPEPSSWNVDGRATTIPGNVPSSSRANTNSMVNPPAGSPFIAHQNLHRRNPRNLSEEISRLSGALRGHQHPRLRSGFLLERQGDGVWGVPLSTRSREGRRLIEIRNALEMIHRGENVRFESIFYGGVDIHDRHRDMRLDIDNMSYEELLALEERIGNVSTGLSEEEVTKLLKQRKFSSWRLEASVEEEPCCICQEEYVDGDDLGTLDCGHDFHVGCVRQWLVVKNTCPICKNTALKS

SEQ ID NO: 15438 - protein, 219 aa, Oryza sativa (japonica cultivar-group)
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 15439 - protein, 417 aa, Oryza sativa (japonica cultivar-group)
MAIGHHHPRGAQAQRTRAPPRLVCFGPPLAPPAEALTLRLLILLLLLRQEQNQTCHEGFDNLGVRDEMIFSVSLFGSSHQSIHKLYRKCWSSNSHSTLNVLSLAKTVGQSMRMKRIRVKPHATDLKNRPQAHEDNVFYKLVYRLPENLSWLLASPEMARRPPSKKKLKKEEMVSSNQFGVILEWEGVVVEDDDPDLEPRVWYVLSLEEAKSFPPDAVLKEIEGMRTDQAILEVLHWSEDPQEVQRLAARKEVIYKTLRGRFYQLRPGVLDFLNTLVDFDIPIAITTPRPRLSLEEGIKAVGLQGYFDAIVAAEDFCRGKPEGEMFEVTAGQLGLEPDVCLVLGNSNSTIESAHTAGMRCVAVASRYPAYELQAANHVVRWLDQLSVADLQRIANGEILGLRGRRSDMDMDMEIVIEE

SEQ ID NO: 15440 - protein, 530 aa, Oryza sativa (japonica cultivar-group)
MAGEVAIDSGEKRLNELGYKQELRREMTLFKTLAISFSTMTLFTGITPLYGSSLRYTGPASLVWGWVVVSFFTWFVGFAMAEICSSFPTTGSLYFWAAHLAGPVWGPLASWCCAWLEAIGLIAGIGTQAFAGSQVLQSIILLCTGTNKGGGYLTPRWLFLLMYIGLTFIWAVLNTFALEVIAFLDLISMWWQVIGGTVIVIVLPLVAKTTQPASYVFTHFETAPEATGIRSSAYATILSLLVSQYSLYGYDAAAHLTEETKGADKNGPIAILSSIGIITVFGWAYILALTFSIQDFSYLFDPSNETAGTFVPAQILFDAFHGRYGSSAGAIALLFVIWGSFFFGGLSITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKV

SEQ ID NO: 15441 - protein, 716 aa, Oryza sativa (japonica cultivar-group)
MKQERRRKRQPGPPRLELVVAHPREEEMAGLDGGGDAEEGATHARGGGGAPPPWREQLTARGLVASLAVGAMYSVIVMKLNLTTGLVPTLNVSAALIAFVVLRGWTQALARLGFAARPFTRQENTVVQTCAVACYSIAVGGQDHPPLHPSSIRRLPSLMEIPTDWFFGSFCAGGFGSYLLGLNKRTYEMAGEDTEGNVPGSYKEPGIAWMTGFLLAVSFVGLLALVPLRKVMIIDYKLTYPSGTATAVLINGFHTPHGDAMAKQQVNGFTKYFAMSFFWSFFQWFYSGGDNCGFSQFPTFGLKAWQQTFFFDFSLTYVGAGMICSHLVNLSLLLGAILSWGVMWPLISDLKGDWYSADIPESSMKSLQGYKAFICVALILGDGLYNFVKIVALTIKNLFDSSKLKNAKKGEDMPVLDELHRNEVFTTDNIPSWLAFSGYLGLTFIAVIAIPMMFHEMKWYYVVIAYLLAPALGFCNAYGAGLTDINMAYNYGKIALFILAAWAGKDSGVVAGLVGCGLVKSLVSISADLMHDFKTGHLTLTSPRSMIIAQAIGTVMGCVISPLTFFLFYSAFDIGNPEGYWKAPYALVYRNMAILGVEGFSALPQHCLQLCYGFFGFAVAANLTRDLCPPKYGRWVPLPMAMGVPFLVGASFAIDMCIGSLIVFTWHIIDKSKAALMVPAVASGLICGDGLWIFPASLLALAKISPPMCMAFRSTN

SEQ ID NO: 15442 - protein, 412 aa, Oryza sativa (japonica cultivar-group)
MVSDENFEEQAARNGGIIKHGREILFQAFNWESHKHNWWSNLEEKVVDLAQSGFTSAWLPPPTQSLSPEGYLPQNLYCLDSCYGSLHDLQALLRKMKEHNVRAMADVVINHRVGTTQGSNGMYNRYDGIPVSWDEHAVTSCSGGKGNESTGDNFDGVPNIDHTQPFVRKDIIDWLIWLRESIGFQDFRFDFTKGYAAKFVKEYIEQSKPLFAVGEYWDSCEYSPPDYRLNYNQDKHRQRIINWMDSTGGLCAAFDFTTKGILQEAVKGELWRLRDPEGKPPGVMGWWPSRSVTFVENHDTGSTQGHWPFPSDHIMEGYAYILTHPGIPTVFYDHFYGKDDSFHGGIAKLMEIRKCQDIHSRSAVKILEASSDLYSAIVDDKLCMKIGDGSWCPSGPEWKLAASGDRYAVWHK

SEQ ID NO: 15443 - protein, 318 aa, Oryza sativa (japonica cultivar-group)
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 15444 - protein, 337 aa, Oryza sativa (japonica cultivar-group)
MAASDVHHGGATPAAAATAVPCVTLNSGHAMPVLGFGTGSSTPPADLAATIAHAVRLGYRHLDTAAVYGTEGAVGAAVAEAVRCGAVASRGELFVTTKLSMADAHPPRVVAALRESLSRLGLDYVDLFLIHWPVAIGKKDAAGELTWDDLSRGLVPFDMEGVWRGMEECHRLGLARSIGVSNFSAAKMSRLLALAAVPPAVNQVEMNVGWRQEKVREVCGEGGVVVAAYSPLGAHGAHWGSDAVMNSGVLHDVAAARCKTIAQVALRWLYEQGVCMVARSFNEGRMKQNMDIFDWELSDQDKAMIAGVPQRRACHGNYFVSPDGPYKSLHDLWDGEI

SEQ ID NO: 15445 - protein, 108 aa, Oryza sativa (japonica cultivar-group)
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEV

SEQ ID NO: 15446 - protein, 201 aa, Oryza sativa (japonica cultivar-group)
MSFTGTQDKCTACDKTVHFIDLLTADGVPYHKTCFKCSHCKGILSMCSYSSMDGVLYCKTHFEQLFKETGSFSKKFAPGCRSTDKELARAPSKICSAFSGTQDKCAACQKTVYPLEKLTLEGESYHKSCFKCSHGGCILTTSSYAALNGVLYCKIHFGQLFMEKGSYNHMKKKSESQEVLPEVVPEEQPAPPPPDENREDN

SEQ ID NO: 15447 - protein, 463 aa, Oryza sativa (japonica cultivar-group)
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAASSIQIPPPRPKRKPVHPYPRNLGSTASKNVPALKQLEKPQLQVQSLYDQDNGSPTSVLTVPQIRADTLGSESGGSPTSTIDIEERCPTPSIATAELAMELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVADSEALLKSQAPQEEADGEMTRLCL

SEQ ID NO: 15448 - protein, 763 aa, Oryza sativa (japonica cultivar-group)
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 15449 - protein, 256 aa, Oryza sativa (japonica cultivar-group)
MDGGYGSVTIVHDARSPEDVFQDFCGRRSGIVKALTIEVEKFYKQCDPEKENLCLYGLPNGTWAVTLPADEVPPELPEPALGINFARDGMQEKDWLSLIAVHSDSWLLSVAFYFGARFGFDKKARERLFMMTSSLPTVFEVVSGGVNTQSKTANGSSKNKSGSKPPKRPNSDSKPQKQVQAKYEEENGGRGNGGDEDQAETICGACGEAYANGEFWICCDICETWFHGKCVRITPAKAEHIKHYKCPGCSNKRTRE

SEQ ID NO: 15450 - protein, 752 aa, Homo sapiens [sequence omitted]

SEQ ID NO: 15451 - protein, 503 aa, Triticum aestivum
MVAPAAIPQRQLFIDGDWRAPALGRRLPVINPTTEVTIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 15452 - protein, 162 aa, Homo sapiens
MHLLPLDSSSTLTCTVPSACTKPPSRWRPTVDIFFVVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 15453 - protein, 351 aa, Homo sapiens
MLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 15454 - protein, 403 aa, Homo sapiens [sequence omitted]

SEQ ID NO: 15455 - protein, 717 aa, Homo sapiens [sequence omitted]

SEQ ID NO: 15456 - protein, 491 aa, Homo sapiens [sequence omitted]

SEQ ID NO: 15457 - protein, 323 aa, Homo sapiens [sequence omitted]

SEQ ID NO: 15458 - protein, 488 aa, Homo sapiens
MTVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 15459 - protein, 376 aa, Homo sapiens [sequence omitted]

SEQ ID NO: 15460 - protein, 252 aa, Homo sapiens
MYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 15461 - protein, 305 aa, Homo sapiens [sequence omitted]

SEQ ID NO: 15462 - protein, 107 aa, Euplotes aediculatus
MAGRGKGGKGGKGYGKVGAKRHTKKALRETILGVTKPAIRRLARRGGVKRISSLVYEETRAVLKGFLENVIRDSVTYTEHAKRKTVTALDVVYALKRQGKTLYGFGG

SEQ ID NO: 15463 - protein, 104 aa, Stylonychia mytilus
MAGRGKVGKGYGKVDAKRHTEKSLKETIMGITKPAIRRLARRGGVKRISSLIYEETRNVLRSFLENVIRDSVTYTEHAKRKTVTALDVVYALKRQGRTLYGFGG

SEQ ID NO: 15464 - protein, 335 aa, Capsicum annuum
AILQSTIGGAPPSTAAAAAENGDTTRKVVPLSKDALQDFMVSIITQKLQGEKKPFYVLDLGEVVSLMDQWNVALPNVRPFYAVKCNPEPSFLSMLAAMGSNFDCASRAEIEYVLSLGISPERIVFANPRKPESDIIFAEKVGVNLTTYDSEDEVYKIKKHHPRCELLLRIKPMNDGNARCPMGPKYGALPKEIEPLLRIAQASRLTVSGVSFHIGSGDADSNAYLGAIAAAKQVFKTAAKFGMSKVNVLDVGDGFTSGHQFTTAATAVKSALQQHFSNEPELTIIAEPGRFFAETAFTLATTIIGKRVRGDLREYWINDGLYGSMNCVLYDKGEF

SEQ ID NO: 15465 - protein, 339 aa, Sorghum bicolor
LNPAAILQSTNGGAPPSTAAAAAENGDTTRKVVPLSKDALQDFMVSIITQKFQGEKKPFYVLDLGEVVSLMDQWNVALPNVRPFYAVKCNPEPSFLSMLAAMGSNFDCASRAEIEYVLSLGISPERIVFANPCKPESDIIFAEKVGVNLTTYDLEDEVYKIKKHHPKCELLLRIKPMSDGNARCPMGSKFGAFPEEIEPVFRIAQASRLTVSGVSFHIDSGDADSNAYLGAIAAAKQVFETAAKFGMSKMNVLDIDGGFTSGHQFTTATTTVKSALQQHFSNEPELTIIAGPGRFFAETAYTLATTIIGKRVRGDLREYWINDGLYGSMNCVLYDNATS

SEQ ID NO: 15466 - protein, 411 aa, Homo sapiens
VLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 15467 - protein, 460 aa, Pyrococcus furiosus
MNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 15468 - protein, 252 aa, Prunus microcarpa
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEVLNFKLEKEDIELINTIDKKSRTTL

SEQ ID NO: 15469 - protein, 252 aa, Prunus lusitanica
AHYRSEADVGNALAEAFETGLVKREELFITSKASNHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINTIDKKSRTTL

SEQ ID NO: 15470 - protein, 252 aa, Prunus virginiana
AHYKSEADVGNALAEAFDTGLVKREELFITSKASNHGHVVEACRNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGSTANVKSFGSISPLEDPVLHGLAKKYKKSVAQIALRWNLDRNTPVIPKSSKIERLKENLEVLNFKLEKGDIELINTIDKKSRTTL

SEQ ID NO: 15471 - protein, 252 aa, Prunus emarginata
AHYKSEADVGNALAEAFETGLVKREELFITSKASNHGHVVEACKNSLKKLRLDYLDLYLVHYPLATKHSGVGTTASLLDENKVLDIDVTVSLETTWHTMEKTVYLGLVRSIGLSNYEFFLTRDCLSYAKIKPQVSQFETHPYFQRESLVRFCKKHGVTPMAHTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 15472 - protein, 252 aa, Prunus emarginata
AHYKSEADVGNAIAEAIQRGLVKREELFITSNASNHGHVVEACKNSLKKLRLDYLDLYLVHYPFATKHSGVGTTASLLDENKVLDIDVTVSLETTWHTMETTVYLGLVRSIGLSNYEFFLTRDCLSYAKIKPQVSQFETHPYFQRESLVRFCKKHGVTPMARTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 15473 - protein, 252 aa, Prunus emarginata
  unsure (1)..(252): unsure at all Xaa locations
AHYKSEADVGNALAEAFETGLVKREELFITSKARHHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKXKKSVAQIALRWNLDRNTPVIPKSSKIERLKENLEVLNFKLEKEDIELINTIDKKSRTTL

SEQ ID NO: 15474 - protein, 251 aa, Prunus emarginata
AHYKSEADVGNAIAEAIQRGLVKREELFITSKANHGHVVEACKNSLKKLRLDYLDLYLVHYPLATKHSRVSTTASLLDENKVLDIDVTVSLETTWHTMEKTVYLGLVRSIGLSNYEFFLTRDCLSYAKIKPQVSQFETHPYFQRESLVRFCKKHGVTPMAHTPSGGATANVKAFGSNSPLEDPVLLGLAKKYKKSVAQIALRWNIERDTAVIPKSSKVERLKENLEVLNFKLEKEDIELINTIDKKSRTTL

SEQ ID NO: 15475 - protein, 252 aa, Prunus emarginata
SSLQSEADVGNAIAEAIQSGLVKREELFITSKASNHGHVVEACKNSLKKLRLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVTPMAHTPLGGATANVKAFGSISPLEDPVLLGLAKKYKKGVAQIALRWNIERDTAVIPKSSKVERLKENLEVLNFKLEKEDIELINTIDKKSRTTL

SEQ ID NO: 15476 - protein, 252 aa, Prunus emarginata
AHYKYEADVGNAIAEAIRSGLVKREELFITSKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVNQFETHPYFQRASLVKFCWKHGVCPMAHTPLGGATANVKSFGSISPLDDPVLQGLAKKYKKSVAQIALRWNIDRNTPVIPKSSKIQRLKENLEVLTFKLEKEDIELINSIDKKSRTTL

SEQ ID NO: 15477 - protein, 252 aa, Prunus emarginata
AHYKSEADVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 15478 - protein, 584 aa, Saccharomyces cerevisiae
MGIHIPYLTSKTSQSNVGDAVGNADSVEFNSEHDSPSKRGKIHIESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 15479 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIVQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 15480 - protein, 1268 aa, Vibrio cholerae
MKSLISVPKFSLRSWLMSLWLPLGLLVIGYFVATSKVDQQQQTQAKRISDAVTVRLNLIAAGVQEKVTLYQYGLRGIRTAVMLLSPEHFDYNDMQAYTQARDYKREFPGARGFGLIIKVEPNQTAAFLDRMAAERPSYNFQIRQLTPHQDSLFVITYIEPEQNNREAVGVDIGSEAMRRKAALDAAFNNDVRLTAPITLVQANERAQQGFLILMPVYKTTTVPQDSRQRLEHLFGWSYATILINDVLNSVAGLENDVFLQISDITEQTPIEFFSQEVKDTYDAALQQKLNLSVFGRQWQLSLTPTNRFINELQLRSGTSLFFEVMAVSTILAFGVYLLQLMLMRRSQLIRHKQELASIAEQTLLKANAELEQQVALRTAEISRVNILQRSILSSAGYAIIATDEEGIITAFNPAAEKLLGYRAEEVLFQQTPSIFHLPAEVEHHAAKLTTELGSNIAVGFETLVAKARLGQTDNARWTYLTKTGEQVQVKLNVSALKDEQGQLAGFLSIAFDLTKQLKYEAELAQAKEQAESANKAKSEFLANMSHEIRTPMNGVLGLLQLVANSTLDQRQADYIEKAYSAAKSLLTLLNDILDFSKIEAGKLELDPHPFSLTDLMQDIGLVFSSSAEQKGLEVLYDVTADVPEHLLGDSFRIKQVLINLVGNAIKFTDKGEILISIRSQSLPEGEINLSFSIKDTGIGITLEQQNALFSGFQQADSSISRRYGGTGLGLAISKRLVNLMGGEIGVESEFGCGSTFSFNVVVRNAEKRAIQNSQTFTRSNEKLSVLIVDDNDSSRIILQGIAVSLGWQAKIASDAQEASLLVKQAHRDSTRYDVVFVDWRMPGKDGLTFARELRELHSSVVSLIVMITAHGKELLDEQNNDYERYLDGFLIKPVTKNMMLQAVKSVVFGDLDLSLPTSPLPHELPLQGISLLLVEDNLTNQLVASELLQQLGATIKIASSGEEALEMLESTAEHFDMVLMDIQMPGMDGYQTTREIRKLPRHQLLPIIAITAHAMSDDIAACLAAGMQDHIAKPFDLNELTTKILSHHKAEKAPHVKQVNKSNLNFDQAALAFCQQHHIELEAAVQRLGYSLTIYVNVLKQFEQDLRQALQQLEDKTLTRRNARLLFHSLKGAAGTLGFSNLAKLTARLEDELREHSDDGYQVDNNVLDILKLTLNTATDLVKLLQVEQQIATAQAPVSRTEQAAQLMTLKQHLNLANMAALPLYQQLAPSLQAQTPELNKELEEALVNLTFEQAVVIVDKMLSQFKE

SEQ ID NO: 15481 - protein, 511 aa, Oryza sativa (japonica cultivar-group)
MTSQLGSARRPSKFQPLQINYICGASLFIKEDMKITDVEVEILLGILNLYSLVGSFAAGRTSDWIGRRLTIILAAVIFFVGAIMMGLSVNYPMLMAGRFVAGIGVGYAFMIAPVYTAEVSPASSRGFLTSFPEVFINFGILLGYVSNYAFSRLRLQLGWRLMLGVGAAPSVALALMVLAMPESPRWLVMKGRLADAKVVLGETSDTAEEAATRLAEIKEAVAIPADLDGDVVAVPKRAGGERRVWKELILSPTPAVRRVLLSALGIHFFQQSSGIDAVVLYSPRVFQSAGITDKNKLLGTTCAVGVTKTLFILVATFTLDRFGRRPLLLASAGGMIATLVTLGLGLTVIGEDATGGGWAIAVSIASILAFVAFFSIGLGPITWVYSSEIFPLHLRALGCALGVGLNRVTSGVISMTFLSLSKAITIGGSFFLYAGVASLAWLFFFTYLPETRGRTLEQMGELFRIHNMAGDDDSAATRPPSPEEEEKITNYVEMAAPSSSSSTATSSHHAK

SEQ ID NO: 15482 - protein, 345 aa, Caenorhabditis briggsae
MSENLYGEENRGEMVRLQKMMKNMNCGGPRPAALTLKDFKVGEALGKGAYGHVYRVRNMQDGKDYALKQIVMSASRDGVPQSVIREIAVMKRLTRQAHPNVVSLRTVLHTVDTSRNIIKIAMIMEICDWDLHTFLQNVPKVIPEKQAKHIIGQMMKGLDFLHSHAIIHRDLKPQNILVNRDQTVKLADFGLSKKYTNTSAFTTCVVTLWYRAPEVLLQSYYNSTVDMWSIGCIIYEIYNRVPLFPGPDEAQQLHEIFKKLGTPIGTDWPKQSVLTKDTFPHYTGISMTSDVTGMSAAALDFFKRCLIYDPARRMGSRAALGHEFLKLKPVSVKPRVLRQLRFNNL

SEQ ID NO: 15483 - protein, 427 aa, Caenorhabditis briggsae
MDFASSSSAGPSGSSSSFDYFPEPSTSRTSTLNRNVALPKWRMPAHLAAIVNDSEHSEKTRYFIYNRTDPNIQCDMRAFYNCMEYEEMLKPNYEYFTAVQNELTPYHREQAIDWIYDVAKEENCDGDVFLLAVALIDRFLSLQCILKHDIQMVAGVALFMASKLKAPHPLTAFKISYYSDNSLSIPMILQWELVMITALDWETESPTAFSFFDFLASSYPQIHGMRSEFQYVVHKCQKMHRLATLFPSMQCAIVLYYVSHIRHHLPLAEDIKALMVNMFQLEINLLDPYIPLVKRCLAPAPIYAVEPEQQVPAPIAPIAPIAMQEEDIDGDDEQEDDEEEEMEMVVSPKEKAPEGTLTPPNGEEEPHQVQVFAQVPECDQSPITPLNDSGFSSDFSSPSNSAEKKRRRSSDWFEDEDYTPPKIFKFK

SEQ ID NO: 15484 - protein, 677 aa, Xanthomonas campestris pv. campestris
MATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVVAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 15485 - protein, 307 aa, Petunia x hybrida
MDQYEKVEKIGEGTYGVVYKARDRVTNETIALKKIRLEQEDEGVPSTAIREISLLKEMQHANIVRLQDVVHTVKSDCILSFEYLDLDLKKHMDSSPEFSKDPRLVKMFLYQILRGIAYCHSHRVLHRVLHRDLKPQNLLIGRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSALPKWPSKDLATIVPNLDGAGLDLLDKTVRLDPSKRITARNALEHEYFKDIGYVFRSKGSSRV

SEQ ID NO: 15486 - protein, 222 aa, Zea mays; identical to SEQ ID NO: 6635

SEQ ID NO: 15487 - protein, 171 aa, Streptococcus pyogenes MGAS315
MPYSLEEQTYFMQEALKEAEKSLQKAEIPIGCVIVKDGEIIGRGHNAREESNQAIMHAEMMAINEANAHEGNWRLLDTTLFVTIEPCVMCSGAIGLARIPHVIYGASNQKFGGADSLYQILTDERLNHRVQVERGLLAADCANIMQTFFRQGRERKKIAKHLIKEQSDPFD

SEQ ID NO: 15488 - protein, 264 aa, Streptococcus pyogenes MGAS315
MENMFSLQGKIALITGASYGIGFEIAKAYAQAGATIVFNDIKQELVDRGMAAYRELGIEAHGYVCDVTDEAGIQQMVSQIEDEVGVIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 15489 - protein, 216 aa, Streptococcus pyogenes MGAS315
MIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLKKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 15490 - protein, 369 aa, Streptococcus pyogenes MGAS315
MTKQKEITTFNVQVAEFIRYHKKEGTAIDDDVTEKLVIPFALDADQIDDLLERLTDGGISITDKEGNPSSKYIVEELKPEELTDEELIGSNSAKVNDPVRMYLKEIGVVPLLTSEEEKELAVAVAKGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMEMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLRDFIED

SEQ ID NO: 15491 - protein, 333 aa, Streptococcus pyogenes MGAS315
MMSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKAVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 15492 - protein, 327 aa, Streptococcus pyogenes MGAS315
MFNDIPVFDYEDIQLIPNKCIITSRSQADTSVTLGKYQFKLPVIPANMQTIIDETIAEQLAKEGYFYIMHRFDEDSRKPFIKRMHEQGLIASISVGVKACEYEFVTSLKEDAPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHIESPGKTVEVDGETFKEYYGSASEYQKGEHKNVEGKKILLPTKGHLSDTLTEMQQDLQSSISYAGGKDLDSLRHVDYVIVKNSIWNGDSI

SEQ ID NO: 15493 - protein, 181 aa, Streptococcus pyogenes MGAS315
MTKHITLAVSGSISAYKAADLTSQLTKIGYDVHIIMTQAATQFITPLTLQVLSKNAIHLDVMDEHDPKVINHIELAKRTDLFIVAPASANTIAHLAYGFADNIVTSVALALPATTPKLIAPAMNTKMYQNPITQENIKRLSTIGFTEIPPKSSLLACGDKGPGALADIDVILATIDTIWKL

SEQ ID NO: 15494 - protein, 574 aa, Streptococcus pyogenes MGAS315
MLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 15495 - protein, 279 aa, Streptococcus pyogenes MGAS315
MVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAISNPDTTSF

SEQ ID NO: 15496 - protein, 244 aa, Streptococcus pyogenes MGAS315
MEIKGKNIFITGSTRGIGLAMAHQFASLGANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPIKRIGKAQEVAHLASFLVEQDYITGQVIAIDGGMTMQ

SEQ ID NO: 15497 - protein, 97 aa, Streptococcus pyogenes MGAS315
MEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 15498 - protein, 493 aa, Streptococcus pyogenes MGAS315
MSNWDTKFLKKGYTFDDVLLIPAESHVLPNEVDLKTKLADNLTLNIPIITAAMDTVTGSKMAIAIARAGGLGVIHKNMSITEQAEEVRKVKRSENGVIIDPFFLTPEHKVSEAEELMQRYRISGVPIVETLANRKLVGIITNRDMRFISNYNAPISEHMTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVMLGSMFAGTDEAPGETEIYQGRKFKTYRGMGSIAAMKKGSSDRYFQGSVNEANKLVPEGIEGRVAYKGAASDIVFQMLGGIRSGMGYVGAGDIQELHENAQFVEMSGAGLIESHPHDVQITNEAPNYSVH

SEQ ID NO: 15499 - protein, 148 aa, Taenia solium
MQNRPKSVLTPARLGTSGVVRNTLEDPWVRFQIELEFVQSLGNPDYLTFLAQQGCFDKPEFINYLSYLQYWKSPSYSRFITYPFCLHMLDLLQSPDFRREVAHESVTRFIDDQMLLHWKNYLRKRAEMVNKHVQSLDAMATPGPGPSS

SEQ ID NO: 15500 - protein, 187 aa, Taenia solium
MDDAGVTSSSADDSTTGQRRARQEGSNDSDSSGSQPPPQSSSPSDNTNGNFECNICLDQAQDAVVSRCGHLFCWPCLHQWLEVKKSRPVCPVCKAAVSRDSVIPLYGRGADHKRDPRNKVPPRPQGVRTEPEPQRESPFSAFSNIFGGNARDDGEGSGGNFQVSFGFGPFPFGLFATTFNIGGGGGA

SEQ ID NO: 15501 - protein, 432 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 15502 - protein, 434 aa, Oryza sativa (japonica cultivar-group)
MVTGSFSRSTSARLTARGGVGSPRVSAAAAAHRKWWWWAPSGPSFECAALAFFLSSVALVLACALYLYLFRYQGRGHAVAEFAGDNLESCDVFDGSWVPDRRYPLYNSSDCPFVERGFNCLANGRKDTGYLKWRWKPRGCDLPRFSARDVLERLRGKRVVFVGDSMSRTQWESFICMLMAGVENPKTVYEVNGNQISKTIRFLGVRFASFNLNVEFFRSVFLVQQSPAPRSSPKRVRAILKLDKMDNISRKWENADVLIFNSGHWWTPSKLFDMGCYFEAGGLLKLGTSINSAFKMALETWASWVKEKVDLKRTHVFFRTYEPSHWSGSNQKVCEVTEFPTAEAKGDDRSEFGDILAGVVVNMSVPATILNVTLMGAFRSDAHIGIWSHPSTILDCSHWCLPGVPDAWNELVISHLLTNGEILYIIILLTYYLE

SEQ ID NO: 15503 - protein, 304 aa, Oryza sativa (japonica cultivar-group)
MSLQGGFVKTQKTHAYFKRFQVKFKRRRQGKTDYRARIRLTNQDKNKYNTPKYRFVTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 15504 - protein, 301 aa, Oryza sativa (japonica cultivar-group)
MGGFVKTQKTNAYHKRFQVKFKRRRQGKTDYRARIRLTNQDKNKYNTPKYRFVTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 15505 - protein, 385 aa, Arabidopsis thaliana
IIHQGPVFSESSQELMNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 15506 - protein, 1129 aa, Mesotaenium caldariorum
MESSTGLVAGSRNRNQFVVIPADEEQRRNVTTPAASVCQICGDDVGLSATGELFVACVECGYPVCRPCYEYERKEGSKACPQCKTVYKRLKGSPRVPTDEEDDDIEDLENEFRGHSHVAHKSHDQHDHDHLDDVESVRSGRNTHDPYATYEPYRVQPQVPLLTDAHYETGSEYGGHTTNSDYGGHGVGSDYGGKTNPSEYSHHHHSHHQAIMVPGGQPGSDAGVHAGSFVNGDGISAKSADPKDPASFGYGSIAWKDRVDAWKQRQDKMQMTTAPGGVLVDANKGGPGGPEDPYNGGNDLPLMDESRQPLSRKVDFNMGLIQPYRLMIVIRLVVLAFFLRYRILNPAPSRPLWMTSVICEIWFAVSWILDQFPKWMPINRETYLDRLNLRFEKEGEPSQLQAVDLFVSTVDPEKEPPLTTANTLLSILSIDYPVDKVSCYLSDDGAAMLTFEALSETSEFARRWVPFVKKYNIEPRAPEMYFSQKIDYLKDKIQPSFVKERRIMKREYEEFKVRINALVSKSMKVPEDGWTMQDGTPWPGNNSRDHPGMIQVFLGPSGGLDTDGNALPRLVYVSREKRPGFNHHKKAGAMNALIRVSAVLTNAPYILNLDCDHYVNNSKALRHAMCFMMDPNVGKKVCYVQFPQRFDGIDRSDRYANHNTVFFDINLRGLDGLQGPVYVGTGCCFRRHALYGYEPKKKESSRGCCSMVFCGCCGLCGRKKEKSAVDNPLKTGKFKGSDPSLPMYNIDDLEDGDGQERESLVALKQFEKRFGQSPVFVLSTFHEEGGSVASSSASSTLKEAIHVISCGYEDKTEWGKEVGWIYGSVTEDILTGFKMHCRGWRSIYCMPKIAAFKGSAPINLSDRLQQVLRWALGSVEIFLSRHCPIWYGWSGSRLKLLQRLAYINTVVYPFTAFPLLAYCTLPAICLLTNQFIIPEISSLNSLWFIALFISIFACAFLEMRWSGVGMEEWWRNEQFWVIGGVSSHLYAVFQGLLKVLAGIDTNFTVTAKAADDGEAYADLYLFKWTSLLIPPTTLIIINLIGAVAGVANAINNGYDQWGPLFGKLFFAFWVVVHLYPFLKGLMGKSNRTPTLIIVWSVLLASIFSLLWVKINPFTNTTNGPALVQCGIRC

SEQ ID NO: 15507 - protein, 239 aa, Mesotaenium caldariorum
DQFPKWNPINRETNLGRLQLRYGDALDAVDLFVSTVDPGKEPPLTTANTLLSILAMDYPVEKLNCYLSDDGASKLTFDAVNETSGFAKKWVPFCKKFAVEPRAPEAYFAQKADFLKGQVQSSFVNERRNMKKEYEEFKVRINHLVSDFQNVPEDGWTMADGSYWPGNNARDHPGMIQVFLGPSGGKDVEGNALPRLVYVSREKRPGFNHHKKAGAMNALIRVSALLTNAPHILILDCDH

SEQ ID NO: 15508 - protein, 319 aa, Synechococcus sp. PCC 7942
MSLSPRSDRTEIRRSWGLDSIVSALSQASTDPLPHHLLSDQFYPLPSRESLGLILHGLRSVLFPRHFGDPELSVETTHYFIGNTLDKTLNLLNEQIRRELWLQHVTQGTPEATPAVLSQHASELTQAFAQALPEIKRLLDSDVNAAYLGDPAAQSISEILFCYPGITAITFHRLAHRLYQLGLPLLARITAEVSHSETGIDIHPGAAIGGSFFIDHGTGVVIGETCVIGDRVRIYQAVTLGAKSFPRDETGALIKGQARHPVIEDDVVIYAGATLLGRITVGRGSTIGGNVWLTRSVPAGSFISQAQIRSDNFESGGGI

SEQ ID NO: 15509 - protein, 428 aa, Pfiesteria piscicida
MKWGDVGGSGSKDVPIAKDAARGAEIGGRGAAVAPSIGQSESSGSFQKLCGEVLLDLPKHLVAVKQVGKGAYGEVFLCKDERTQGQVAVKVIRDFTKDLLFGKRIFREVKILMALQHENLMRLIDLPAVPSPDFNVVYMVMPYMLADLHRMIYSSLKLVESHCQAFTCQILRGLKYLHSAGIVHRDLKPANIMVNKNCTLRITDFGLARGRCDDEEVLTDYVVTRWYRAPELMLVPSSYFEAIDLWSVGCIHFECVARTVLFPGEHHFDMLKKIADTLGMFTPEGVAWCPQDQKGEVDTMLNKLEDLRSKELNSLASRLPEASEVCLDLLLKLLDKVPSTRISAAEALEHPYLQHLRDPAGETVAKRPFAWDFDVFEPSERALKDRIYAECARIHPEIITRDAKYLMDRGFKVPAQRPSPADEKPDGS

SEQ ID NO: 15510 - protein, 234 aa, Hyacinthus orientalis
MGRGKIEIKRIENTTNRQVTFCKRRNGLLKKAYELSVLCDAEVALIVFSTRGRLYEYSNNSIKSTIERDKKACADSSSSSAVIEVNTQRYYQQEASKLRQQIQILQNANRHLMGESLDPLNVKELKQLETRLERGITRVRSKKHELLFAELEYMQKREVELQTDNMYLRAKIGENERAHQASVVQAGTEFDALPTFDSRNYYQVHMLQAASHYSHHQDQTALHLGYETKADPSA

SEQ ID NO: 15511 - protein, 388 aa, Mus musculus
RTRGRTRGPVATIAIFNALHVDPVLNMLVFGESILNDAVSIVLTNTAEGLTRKHMSDVSGWQTFSQALGYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLGLEPMEKRQLIGTTTIVIVLFTILLLGGSTMPLIRLVDIEDARARRRSKKDVNLSKTEKMGNAIESEHLSELTEEEYEAHYIRQQDLKGFMWLDAKYLNPFFTRRLTQEDLHHGRIQMKSLTNKWYEEVRQGPSGSEDDEQELF

SEQ ID NO: 15512 - protein, 355 aa, Homo sapiens [sequence omitted]

SEQ ID NO: 15513 - protein, 350 aa, Canis familiaris
MGNAAAKKGSEQESVKEFLAKAKEDFLKKWENPAQNTAHLDQFERIKTLGTGSFGRVMLVKHKETGNHFAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFCEF

SEQ ID NO: 15514 - protein, 752 aa, Chlamydomonas reinhardtii
MALPGSTMNLTTRCSTTPRSAVVARAVAAPTRPTTKSAVPELLDSRPGERNLNFMEYAQATQMLDRLKGQASDLELLLDQLNALEASLDESVLAPPTVDDPKERAARQARRAAKRAERRAQATSATVAAAAGPAMSAVVSHSTPTKAAAAPATSTASSSSSDSGLLDLVSFVGGFDTRPIPATTSAPPAGASSSDVQHLEDLFKLSVGEPDIPRASASAAPAVLRPRKLTPKKPSAAPSAAVTAAPSPAPTLPSTPSTSARIAPAPGSLADELERLLGPTTSREAAESEDEDSFAGPSEDDLLALEQEVSRKSSRLPVLDEEDEEDEQQQLEDNEEDAVAGPGSLEASAMATRTSSQLSIMQTGPSLLSLVPASAAPGRSAKARASRRAARNGHASGRLGGATANAAGRGKVGSKDGTMNFLGKVESLSTLDVEKEREVTAVCRDFLFLEKVKRQCEKTLHRPATSEEIAAAVAMDVESLKLRYDAGLKAKELLLKSNYKLVMTVCKSFVGKGPHIQDLVSEGVKGLLKGVEKYDATKGFPFGTYPHWWIRQPVSRSLAETARAVRLPMHMIEQLTRLKNLSAKLQTQLAREPTLPELAKAAGLPVTRVQMLMETARSAASLDTPIGGNELGPTVKDSVEDEREAADEEFGSDSLRNDMEAMLLELPEREARVVRLRFGLDDGKEWTLEEIGEALNVTRERIRQIEAKALRKLRVKTIDVSGKLMEYGENLEMLMDGSREMAARTSSGTRKT

SEQ ID NO: 15515 - protein, 165 aa, Zea mays subsp. parviglumis
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 15516 - protein, 159 aa, Gossypium hirsutum
MGFTEKQEGLVKESWEVLKQDIPHSSLRFFSLILEIAPGAKNMFSFLRESEEIPQNNPKLKAHAVKVFKMTCESAIQLREKGEVVVADTTLKYLGTVHVKSGVKDPHFEVVKEALLRTIEEAIGEEKWNEEMKNAWGEAYDQLAEAIKAEMKNHHDETA

SEQ ID NO: 15517 - protein, 156 aa, Lycopersicon esculentum
MGFTDKQEALVRDSWEFMKQDIPQLSLRFFSLILEIAPVAKNMFSFLKDSDELPENNPKLRAHAVKVFKMTCESAIQLREKGEVVVGETTLKYLGSIHLQKRVADPHFEVVKEALLRTVKEATGNKWKDEMKEAWSEAYDQLASAIKAEMHAEAAA

SEQ ID NO: 15518 - protein, 161 aa, Brassica napus
MGEIVFTEKQEALVKESWEILKQDIPKYSLHFFSQILEIAPAAKDMFSFLRDTDEVPHNNPKLKAHAVKVFKMTCETAIQLREKGKVVVADTTLQYLGSVHFKSGVLDPHFEVVKEALVRTLKEGLGEKYNEEVEGAWSKAYDHLALAIKAEMKQEDSQKP

SEQ ID NO: 15519 - protein, 163 aa, Gossypium hirsutum
MATYEGKVFTEEQEALVVKSWTVMKKKTAELGLKFFLKIFEIAPSAKKLFSFLRDSNVPLEQNTKLKPHAMSVFVMTCESAVQLRKAGKVTVRESNLKKLGATHFKYGVVDEHFEVTKFALLETIKEAVPDMWSDEMKNAWGEAYDRLVAAIKIEMKACSQAA

SEQ ID NO: 15520 - protein, 160 aa, Medicago sativa
MGTLDTKGFTEEQEALVVKSWNAMKKNSAELGLKLFLKIFEIAPSAQKLFSFLKDSKVPLEQNTKLKPHAMSVFLMTCESAVQLRKSGKVTVRESSLKKLGANHFKYGVVDEHFEVTKFALLETIKEAVPEMWSPAMKNAWGEAYDQLVNAIKSEMKPSS

SEQ ID NO: 15521 - protein, 317 aa, Ictalurus punctatus
MPREDRATWKSNYFLKIIQLLNDYPKCFIVGADNVGSKQMQTIRLSLRGKAIVLMGKNTMMRKAIRGHLENNPALEKLLPHIRGNVGFVFTKEDLPEVRDMLLANKVPAAARAGAIAPCEVTVPAQNTGLGPEKTSFFQALGITTKISRGTIEILSDVQLIRPGDKVGASEATLLNMLNISPFSYGLIIQQVYDNGSVYSPEVLDITEDALHKRFLEGVRNIASVCLQIGYPTLASIPHSIINGYKRVLRVAVETDYSFPMADKVKAFLADPSRFAVAAAPSVAAAPAAVRLVPLLSRPRRSPRSLMRTWLRPVRLK

SEQ ID NO: 15522 - protein, 386 aa, Oryza sativa (japonica cultivar-group)
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENSDGDFNTGSQIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 15523 - protein, 400 aa, Oryza sativa (japonica cultivar-group)
MNTTSANELMMHRHVQAAPYAAAPQQQGGKQRAPGLPPTPPPPPAAASSHSSHGDVCMDDTARGGLLPPRKAHRRSRSDVPFGYFQPLPPPSPKMEAGGGWALPGCGGAGDVDLLNAYMSLEGMGGADGLNNSDGDSRGSSMRTNGADSSENESEDYVGADSQALLWGGAGGGEAAGKKRRNNAAGEKAARHARSLSMDSLMGKLSFAANGEPAKFSLEFGSGEFTPAEMKRIMADEKLAEMALADPKRVKRVLANRQSAARSKERRMRYIAELEQKVQILQTEATTLSAQLTLLQRDSSGMATQNNELKFRLQSMEQQAQLRDALNEALTAEVQRLKLAANEVCDTSSSSNLAHQIQLRCQNQMLDLHKQQQQQVEQIPFYQLELPEQQNGTARNHESK

SEQ ID NO: 15524 - protein, 266 aa, Synechococcus sp. PCC 7942
MGKLDNQIALVTGSSQGIGQEIAIRLASEGASVVIDYRSHPEGAEETRKQVEAAGAQCHLAKDHAPEGYVVQADLGDVTQVRNLVAESIKHFGKLDILVNNAGMERRAPFWEVTEADYDMVLNVNLKGAFFAAQALVQHLLETKRPGKIINISSVHEELPFPNFASYCLSKGGIKMMTRDLAVELGEYGITINNVAPGAIETPINTNLLNNPTELNALLGNIPLKRLGKPKDIASLVLFLASPDADYITGTTIFADGGLLWNYHEQ

SEQ ID NO: 15525 - protein, 386 aa, Candida dubliniensis
MDIVLEICDYYLFDKVYADVFPKDGPVHEYLKPAIQSFSEINFPKLQNWDSFDTNSTLISSNNFNISNVNPATIPGYLLSKIASYQDKSEIYGLAPKFFPATEFIDTSFLSRSNIFREVLSLFIITTLFGWLLYFIVAYLSYVFVFDKKIFNHPRYLKNQMSLEIKRATSAIPVMVLLTIPFFLLELHGYSFLYEEINESTGGYKAILWQIPKFILFTDCGIYFLHRWLHWPSVYKALHKPHHKWIVCTPFASHAFHPVDGFFQSLPYHLYPLLFPLHKVLYLLLFTFVNFWTVMIHDGSYWSNDPVVNGTACHTVHHLYFNYNYGQFTTLWDRLGNSYRRPDDSLFVKDQKKEEEKKIWKEQTRQMEEIRGEVEGKVDDREYIDQ

SEQ ID NO: 15526 - protein, 670 aa, Takifugu rubripes
MADHLLHYNDSAGVGNRFARKGALRQKNVHEVKNHKFTARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTYDMNVHKQCVVNVPSLCGTDHTERRGRLFLKIEVKLDRLHVTVGEARNLIPMDPNGLSDPYVKLKITPDPKNETKQKTRTIRSSLNPCWNESFTFKLKPSDKDRRLSVEVWDWDRTTRNDFMGSMSFGVSELIKAPHCGWYKLLSQEEGEYYNVPIPEVDDVNLELRQKFEKAKLGQGKKVITPSDHRRFSLPSGNMDRVRLNDFNFLALLGKGSFGKVMLAEMKSTDELYAIKILKKDVVIQDDDVECTMVEKRVLAQRDKPPFLTQLHSCFQTVDRLYFVMEYINGGDLMYHIQRMGKFKEPQAVFYAAEIAVGLFFLHRKGIIYRDLKLDNVMLDSEGHIKIADFGMCKESMYEGMTTRTFCGTPDYIAPEIIAYQPYGKSVDWWAYGVLLYEMLAGQPPFDGEDEDELFQSIMEHNVSYPKSMSKEAVSICKGLMTKHPSKRLGCGPEGEMDIREQAFFRRIDWDRLANREIQPPFKPKVGGKGAENFDKFFTRTQPVLTPPDHLVIANIDQSEFAGFSYVNPQFVPPSLHSVV

SEQ ID NO: 15527 - protein, 1547 aa, Tritrichomonas foetus
MLILLFLDFALAARIAVNGFMPLIFKSKYSHFILGETTKTKSDAEIYIVESAFYNQVPNDYIEVCSFREKIPEFALFSKIKTNRHISISPDVEGSETLSSIIFAYDISVTAFSPDFLISRDSDFLIKSINSINNLNNTKSERILSAADQEPSFLILPKGSQPPNGFKQVALKKTIFKFLQNAQTDFYVFTKSSSNHKNLANKICSPIYEPKTFYLYIVIFLLFVIIVAYHAYSSEFTKINTKHDFWIFDRNENILHGKDLNELDEITRSYVIHSLRVSIISNHFISTVIKMTRKEKVFVFKRNFVFPIKNKWFISFNLNENFPISDKLAFDVIVKSGDRIVDANPSIKLSSYRDYRPIHLSYTLDNNIKCLVDLPTSALAPFQPFGQLFTLILSIFYKFEDLVSNHPYFESNFSEFLDFCCKRLYARQCYFFSHNHLKYEYNELPYKKYTNEDLIARSNELINSTGFTLSNDLFDDGTRCFIHRIKSGSNDIIFLLAFLSDKVEQAFEFYALPLTSFISNFLYQNIHVEKRLKKYESSREIIKSFNTVSFIEIAIKKHSIISFDSPLIENHPATIAELKQIIKDYSIEDYQTFREELDSVIRREKVLNHHPITAIINGHKRYIEVSALISDDSTLDDQILVILAEDVTSSREMENELIECLPEIKQAFSSLAMISFTIIDNEVIIDTDELFVSLGLPIPKDRALKPLLHKDDLIKYEMLLTGERGTFRLVDNDGVSLSYSGFSDGENGYLIDLLSFAGIRDHGESLDEGLQLAASNAHIIFWAIDLRTDTVKPLYKQPTIWDSLSVERDMKFSRIIEYIYTDDREYFIQNYNDVIHYNKEQWTGEARLLRIGGIYEYHKFVITRANDFLLNCVALNINKQKEMESKLSETQRLRDLLLSSKRLALWTFRNDKTEIPFKHQSFDDMVTNDIEMNWNSLNIIHPEYRSEFAKKLELTLENGDGMEIDLPLLLNGKEIWVSFRGRFKPSMKNIVGVCIHITELRSALLQLETETRRAEIANSQKTVFLANMSHEIRTPMNGIFGMLDILATKELTTEQRLLVDSIRASTFQLMNLLDDTLKLTKIEQGDIESSPSIFSLTKAVEPIFIATALRASQSKLKFNVSISQKIPKLMFGELQLTLQIINNLVSNALKFTKQGSISINLDWQRIKHQNASQTNHSKNVSSRIENDSGSYDDDVEEICIIEVIDTGIGISPEQQRFIFDRFKQANQSVARFFGGSGLGLALVQDIVHFMQGQIEIDSDVGHGTRFTCKIPMMSIMNEYSPPFLDGKKHIIMTMIDDKLLSDSIQEWMTFHKYEIIPFESPDEIIEKISMVNTASPDKVSVDAIFVEGRKDTWQRIKHSVTRISNGKSIVICAIIEPGDQPEAVLKYTMTKPILLPNLVDFMNGIRYKKNDFKLPSQEKVCDDKTQKILVVEDNKTNQFVMKKILQNIGCPMRIAENGKEAIDALEQEEFDLIFMDCQMPVLDGIEATKIIRSCDKNYSSIPIIALTASAVEGDEETCRKAGMDAYLSKPVRIQQIKNIIAQFNNQH

SEQ ID NO: 15528 - protein, 241 aa, Malus x domestica
MAFFGILVIGFLSLVSSVNGYYGGWSNAHATFYGGGDASGTMGGACGYGNLYSQGYGTNTAALSTALFNNGLTCGACYQIRCVNDPQWCLPGSIIVTATNFCPPGGWCDPPQQHFDLSQPVFLRIAQYKAGVVPVSYRRVRCRRRGGIRFTVNGHSYFNLVLVTNVGGAGDVQSVAIKGSRTRWQAMSRNWGQNWQSNSYLNGQSLSFIVTTSDGRRLVSYNVAPPNWSFGQTYTGRQFLY

SEQ ID NO: 15529 - protein, 1215 aa, Drosophila melanogaster
METVVAFNNELSGLYDSRPPISKAKMAAITKSAMRAIKLYKHVVQSVEKFILKCKPEYKVPGLYVIDSIVRQSRHQYGMDKDLFAPRFQRNLTETFANLFRCAPEDKSRIIRVLNLWQKNNVFKSEVIQPIFDLADPNHPIYHQMPPVGGSGGQGGGVGPGPSSSGALSLADISSGPNGLNSSGMEISMNSSGGDDKMGGAMPDLSEKKIKQLLNNPNVLRQLHTLQNFQNLKPQEENQKHRYQDEALQQHFQNVMKGNAGMPPGMGMGMNMNDSMDLNKDVEFISEQQTIEVINLDGGDSRSPTPDRDRYKRSRRNSRSRTRSPRGRGAGGGTGNDRRRRGTRSRSRSRSPRSSRRRGSRDRDRMDRSNRDKERDREHERERRKKGLPDIKKEHLSVCSTTLWVGHLSKLVYQEELSDTFGEYGDIVSIDQIVPRGCAFIVMNRRQDAHKAMQALKNHKLQGRAITISWAAGKGVKSKEWKDYWDLELGVTYIPWSKLSSDTDFDALEEGGMFDEDTMPIQMKQKINQAKNAAKEHKGASIAEAAGAPSVGVPPPNLIFGIDTTQPPPVGPVGPVGPPPGPGAPPPGLMGMVRGQFPMAPPMGINMPPPIMMPPTNMPPPMMMPTTNMPPPMMMPPTMMPPGFPGIGGPPHPMALPPGAPFPPPGAVPPPIPSGGQISNSGNVSDDQMDIEMDLEDAPPLPPQQQANFNPSPSNVDLSPAAMANEMFQQRDRERDRDNRDRSRGPGNSRWGGRDDVVEAAERWRAENGGGGGGPGSGLGPNAAFNEARARLNLNPIEHGMPRPDFMDFDNRGGPGGPRGMGPRGNHNGGGPGGDFFPPNMNHNRFNQPTSLMQMRIPPPASFNQRMGGPAGNGGNGVGPMFMRNQGGGPGGAGPSGGGPGGAGTGGGGPGGRQQGPGFFNPRNPFNDNQRGRGGQSGGGVRGVGGGGGGGPGGRGRWSDDEDEGGNNFKRRGGPGGPGGNRFRGERGGEMMDDRRGNNSRGGRGGPREDRERPGFGNRRGSRDDSNRHSISSTDEGNKAASETEPKPKNVETELGSTNTGAPAAATRVDTEEDWDQELQDYEARMEAQKPGERASQSANSPPQEKLPAENENFAKPADVTGDPLVAKSQTETSAACTPLYDELPPPAVPQTPTQPPKEPQGSPPRPAPPVIETEAAPHEESVPAPPAELQTEAPSAEEPIAPAASADVVAEADP

SEQ ID NO: 15530 - protein, 350 aa, Homo sapiens
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 15531 - protein, 804 aa, Homo sapiens [sequence omitted]

SEQ ID NO: 15532 - protein, 773 aa, Homo sapiens
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTVSTE

SEQ ID NO: 15533 - protein, 717 aa, Burkholderia cepacia
MEARFSAHRPVWRMLRHVLATMLLTGSVGTGAATACWKPIFTDEERRWIGDHPVVHIAVEANRHPIEYMRNGRHAGLVAGYLSAISRMSGLSFQTVPGTERGHAYDALAAGKVDLLPGVWRELVPDRIGAGALVSAPYLVGRLTVVTRNNSAMIFGLQRLKGRRIAIKGRGAVEYFVRHSGVPLHVLTFDSEELALAAVANGEADAALGVDVTILPIMRRQFTGQLYMSGMLADRPVSLAMLTRADLPILASIIDKSLAAIPVSETAEITRDSIELGDYGKPTIRSIVHYRAPVVLGVALALLTFAALAYLMWKSRAAAIRSKRDKAMFLAFVSHEIRTPMQTVLSSLEFLQRSRLSVQQGGRVDAAASAAETLLTLLDDILDYSRLESRKVTLSPQTVELDVWARQTVDLVRWRADRKTLALTLDVAGPPSVHVSIDPVRVRQIVLNLLVNAINFTAAGAVTLRVRYVAARHGRNGTLCLEVRDTGIGIAPDRLGHVFETYWQADRAPQPGSGGSGLGLAICRELVELMHGSITVDSTPYVETVFTVQLPVPAADGAPLAKSAAAAQALADATAAPVYRGAPRVLIVDDHETVRAALQDQCDALGCVGIVAGSGEDALRHLAQGRIDMVLLDCNLPDIDGYALARMIRQEEAARKARRVSIIAISAESGDMHRMLCLESGMDGVLGKPLRLDTLRQAIARWYPTDADNTLEVSTVP

SEQ ID NO: 15534 - protein, 514 aa, Holospora obtusa
MSNLSTSRMSKWRERLWPVYPEEMSIFLPMVVIMFSILFNYTVARNVKDSLLVNSPGSSGKVLPWVKLGLVTPCSIFAVIGYAKLSNLLSKQRLYFATLLPFAVYFLLFGFILYPMREYFNLSVDWIKECQSIYPLLKDFFPAVAYWNYSLFYMMAELWGNMGIALLFWQFANQITPTTQAKRFYPVYGFWSNLGLVAAGSLTAFSENFLKPERLASGEKDFGPQLRLYCSCMVVACIAIVVSYWWLNAKVLTDAQKGTDAKGRKSKPKLTLKESAVYLLKSRYLMYIAILMLAYGITINIVEVTWKDSVGHYFSDPVTGLRDMNAYNAFMGKMFIGTGITTMVFILFSKNFVQSLGWRFSANITPFVTMITGVGFFLFVVFKDYLGGLCELFGTSTLSVAVGLGLVQNVLTKGVKYALFDPTKEMAYIPLDEEEKVKGKAAIDVIGGRAGKSGGSVLQLICNAATGGLGIPQLSVPLLGGLLVSITCWWIWAVNKLAIAYAKKVLETEQVKEI

SEQ ID NO: 15535 - protein, 644 aa, Prunus persica
MDSCDCIDAQWPPDELLVKYQYISDVFIALAYFSIPLELIYFVQKSSFFPYRWVLMQFGAFIVLCGATHFINVWTFYMHSKTVAVVMTVAKVSCAVVSCATALMLVHIIPDLLSVKTRELFLKNRAEELDREMGRMLTQEETGRHVRMLTHEIRSTLDRHTILKTTLVELGRTLGLQECALWMPSRTGMNLQLSHTLNYQIQVGSTVPINLPIINEVFTSSRAIRIPYTCPLARIRPLVGRYVPPEVIALRVPLLNLSNFQINDWPDLSAKSYAIMVLILPTDSTRKWRDHELELVDVVADQVAVALSHAAILEESMRARDQLMEQNVALDLARREAEMAIHARNDFLAVMNHEMRTPMHAIIALSSLLLETELISEQRVMIETVLKSSNLLETLINDVLDLSRLEDGSLELDIRKFNLHGVFREVINLIQPITSVKKLSMSLILSPDLPLCAVGDENRLMQTILNVAGNAVKFTKEGYISIVASVAKPESSRDWRPPEFYPASTDGHFYLRVQVKDSGCGILPQDIPHLFTKFSQPRSGSNRINDGAGLGLAICRRFINTMGGHIWIESEGIDKGSIVAFIVKLGICDNPCDTTAAHQMAPQALPQPQPQPNYGSGDRIAHRPTVSFRDGGYTSSNPRYQRSI

SEQ ID NO: 15536 - protein, 283 aa, Homo sapiens
MPTEQSGPAPASLAVCTWTVETAVLIETLISLGAEGQLSTCNLFSTQDHAALPLPRLAFQCMPGREKQTRSTSAPVGHRGISQETLTGVHNLHKMMANGILKVPAINVNDSVTKSKQASLTDGIMQATEVVTASKVVVIVGYGNVGKDCAQALRGFVDHVIVTEIDPINALQAAMESYEVTTMDKACQEDIFVTTTGCNDSILDWHFKQMKDDAVMVMAQIELWTHPDKYPIRVHFGPKKLDEAVLEAHWSKLNEKLTKLTEKQALYLGMSRDSPFESDPYCY

SEQ ID NO: 15537 - protein, 306 aa, Homo sapiens
MKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGTYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQ

SEQ ID NO: 15538 - protein, 157 aa, Homo sapiens
MAGGKAGKDSGKAKAKAVSRSQRAGLQFPVGRIHRHLKTRTTSHGRVGATAAVHRAAIPGYLTAEVLELAGNASKGLKAKRITPRHWQLAVRGDEELDSLIKATTAGGGVIPSHPQISDWKEGTAENCLEGCFNQPSSSPSLYWNWDRRNNGDMWNF

SEQ ID NO: 15539 - protein, 310 aa, Homo sapiens
MLELLVQKKKQLEAESHAAQLQNLIQFLKVARRNRREQLGHFQKELSVLEEDIKRVEEMSGLHSPVSEDSTVPQLEAPPASHSSIMDSTEYSQYPDNSVASIEAKADVCCVKFSRSSRCHLAFGCADHCVHYYDLRSTKQPIMVFKGRQKAVSYAKFASGEEIVFASTDSQLTLWNVGKLYCLHSFKGHINEKNFVGLASRGEYIACGSENNSLNLCYKALSKTLLTFKFDTVKSVLDKEGKEDDTNEFVGAACWRAQPDGEFNMLIAANSEGTIKVLELVRRVYSTLNVLDPADIPLQLTMIEETENVM

SEQ ID NO: 15540 - protein, 235 aa, Mus musculus
MNYKIYKKAKKTICQNSFGNEEKKKEPAISSQNSPEAREESSSSSNVSSRKDETNARDTYVSSFPRAPSTSDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 15541 - protein, 735 aa, Homo sapiens [sequence omitted]

SEQ ID NO: 15542 - protein, 581 aa, Homo sapiens
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 15543 - protein, 372 aa, Lycopersicon esculentum
MCGGAIISDLVPPSRISRRLTADFLWGTSDLNKKKKNPSNYHSKPLRSKFIDLEDEFEADFQHFKDNSDDDDDVKAFGPKSVRSGDSNCEADRSSKRKRKNQYRGIRQRPWGKWAAEIRDPRKGIRVWLGTFNSAEEAARAYDAEARRIRGKKAKVNFPDEAPVSVSRRAIKQNPQKALREETLNTVQPNMTYISNLDGGSDDSFSFFEEKPATKQYGFENVSFTAVDMGLGSVSPSAGTNVYFSSDEASNTFDCSDFGWAEPCARTPEISSVLSEVLETNETHFDDDSRPEKKLKSCSSTSLTVDGNTVNTLSEELSAFESQMKFLQIPYLEGNWDASVDAFLNTSAIQDGGNAMDLWSFDDVPSLMGGAY

SEQ ID NO: 15544 - protein, 209 aa, Coffea arabica
DQYEKVEKIGEGTYGVVYKARDRLTNEMIALKKIRLEQEDEGVPSTAIREISLLKEMQHNNIVRLQDVVHSEKRIYLVFEYLDLDLKKHMDSCPELAKDPCLIKTFLYQILHGIAYCHSHRVLHRDLKPQNLLIDRRTNALKLADFGLARAFGIPVRTFTHEVVTLWYRAPEILLGSRHYSTPVDIWSVGCIFAEMVNQRPLFPVDSEI

SEQ ID NO: 15545 - protein, 754 aa, Limulus polyphemus
MPNFSGTLKLKLCEAIDLKPTEYATRHANVVGKQQLAIDPYVSIDIDEVHVDRSSTKQKTFKPIWNEFFTSEVHNGQNLGLTVFHDAAIPPDDFVANCTISFEEILTSSKEANSNESDIWVDLEPEGKIHVIVELQSQENAAQKPREFKERPGLNRRRGAMRRRVHQVNGHKFMATILRQPTFCSHCREFIWGLGKQGYQCQVCTCVVHKRCHEFVVTKCTGMKDTTNDEIGGSRFNINIPHRFMVHNYKRPTFCDHCGSMLYGLIRQGLQCEACKMNVHKRCQRNVANNCGVNPKQMAEILNAMGFSGDKLTKRKKKTSITESCNKLLHPITERSLTTPLPGTCEEQELSGNATRLEVQAAAEEFKRLCLQLPQGGILPVDRSPIGGSSSSDVIFEQSYRTEEWDSKKFGLSEFTFIKVLGKGSFGKVMLGERKGTDEVYAIKVLRKDVILQDDDVDCTMTEKRILTLAAKHPFLTALCCSFQTEDRLFFVMEYVNGGDLMFQIQKARKFDEARARFYAAEVTLALMFLHRHGVIYRDLKLDNILLDSEGHCKIADFGMCKEGIAGGATTTTFCGTPDYIAPEILQELEYGPSVDWWALGVLMYEMMAGQPPFEADNEDDLFESILHEDVVYPVWLSKEAVSVLKGFMTKNPAKRLGCVPSQGLEQAILNHIFFKEIDWDALESRKVKPPFRPKIKTKRDVNNFDQDFTKEDPVLTQVNPDVIRTINQEEFRGFSVVNEDYCPNRNMVEGPAT

SEQ ID NO: 15546 - protein, 253 aa, Bacillus subtilis
MNLTDKTVLITGGASGIGYAAVQAFLNQQANVVVADIDEAQGEAMIRKENNDRLHFVHTDITDEPACQNAIRSAVDKFGGLDVLINNAGIEIVAPIHEMELSNWNKVLNVNLTGMFLMSKHALKYMLKSGKGNIINTCSVGGVVAWPDIPAYNASKGGVLQLTRSMAVDYAKHNIRVNCVCPGIIDTPLNEKSFLENNEGTLEEIKKEKAKVNPLLRLGKPEEIANVMLFLASDLSSYMTGSAITADGGYTAQ

SEQ ID NO: 15547 - protein, 939 aa, Marinomonas mediterranea
MLALNSVSLRSKLFFAIYTPCLILSIIASFAFTLSRFDTIDRNFKEGVEKSVSQMTVSAEHALSHSDEGMLNDTLRTLLKHDHINTVQLYNAEEKLITELGKTSEGNTLPFTNANESDENPHFFATIAPIKHPVTRLEHQSNTNFITSSYSVPQVSGWLKVEASKEASIVSKYRYLSATLGTFFIFNLLAIFALLNVTASLLRPIEKISDTVNKITQGHFGATKGLNLPTQYSTVVSDLNDISSRLENHRAEILSNVDQATEDIRRNMDSLEEKSAQLHIANKEATESNRLKSQFLANISHEIRTPLNAIMGYIQILQKDQLDKQQRLYMDTIAQSTTNLLTIISDILDFSKIEAGKLSLDLTDINIRDIVDEVYQILSSANLVNASKELDLIPEFDLDVPTWVIGDPVRIRQVLTNLIGNAIKFTHEGSVRTTVKILEKSNSSLKLSFQIIDTGVGIPENKLDNLFKPFSQVDTSTTRKFGGTGLGLVITKKLVKQMGGNVEVSSEHGIGSNFRFTIVLKPSQKEQKVEDPISKSLLVFEPSLNYRNYLKTYLNHVGANCTFTSSLEQTVTLLNSQTSLDAVLLNIDSHTEKLEEIQELVAYITQQFRLPCILLTKRPHDISKSSILHTLCSEILMTPISHNRLNKSLRSLEEPKLLSEDRLYADETTTTELTTELELEAVEPPEETSPLSGIQILAVDDTQINLQLLGHWLEPHGLQVDLAYSGKQAIEMAKETQYDLILMDIQMPEMDGMEATQRLRKLTNYVHTPIVALTAHALGSEQKQIVSSGMNAYLTKPVNEDILLETITQWCQSKKSYQDLADEKVVALFDIDKALSIANGKSVIAKDMFDMLLNTLEADKKLILHHFEEKDLAKLIHVVHRLHGGSKYTGAIELSKHAGFLETHLKELQFDDVEGVLEDFTDSIDALIDIAPLIKWPQE

SEQ ID NO: 15548 - protein, 721 aa, Petunia x hybrida
MIAIPQGAKGVLGVSSFMPSISSEEQICKKDANFARNDPQICKKDGNFARNEPQICKKEGNFTRNEPVSVLDTRSPSPSSSSCSYAGKVEGQKEELVKELQPFPLVGLEPEKCSLGFGDLDNLLPELCGADQTLLRWISGDMEDPSVSLKQLLLGGNANGFHGSSGFEASAAGSLVHTDNVSFSGSDVSLNANIEKIGSVIDSNGRPSNGFDYLNANLYAKSLPLPPASSFQEQKLGQKPQSFSPNQALFQNASYGNMFDSSSYDDTNQEQPPSKRHNSGTLGSSVGGLLPKVPFFDPSGDLSMRRQLLGEMQQHFNLLPPQQFQPKPLIVPKLEAACGGGNGSLMVPRHQQQEQQFIYDQIFQASELLLAGHFSNAQMILARLNQQLSPIGKPFKRAAFYFKEALQLPFLLPCTSTFLPPRSPTPFDCVLKMDAYKSFSEVSPLIQFMNFTSNQAILEALGDVERIHIIDFDIGFGAQWSSFMQELPSSNRKATSLKITAFASPSTHHSVEIAIMHESLTQFANDAGIRFELEVINLDTFDPKSYPLSSLRSSDCEAIAINFPIWSISSCLFAFPSLLHYMKQLSPKIIVSLERGCERTELPLKHHLLHALQYYEILLASIDAANVTPEIGKKIEKSLLLPSIENMVLGRLRSPDRMPQWRNLFASAGFSPVAFSNLTEIQAECVVKRTQVGGFHVEKRQSSLVLCWKQQELLSALTWRC

SEQ ID NO: 15549 - protein, 503 aa, Saccharomyces cerevisiae
MLCAISGKVPRRPVLSPKSRTIFEKSLLEQYVKDTGNDPITNEPSSIEEIVEIVPSAQQASLTESTNSATLKANYSIPNLLTSLQNEWDAIMLENFKLRSTLDSLTKKLSTVMYERDAAKLVAAQLLMEKNEDSKDLPKSSQQAVAITREEFLQGLLQSSRDFVARGKLKAPKWPILKNLELLQAQNYSRNIKTFPYKELNKSMYYDKWVCMCRCEDGALHFTQLKDSKTITTITTPNPRTGGEHPAIISRGPCNRLLLLYPGNQITILDSKTNKVLREIEVDSANEIIYMYGHNEVNTEYFIWADNRGTIGFQSYEDDSQYIVHSAKSDVEYSSGVLHKDSLLLALYSPDGILDVYNLSSPDQASSRFPVDEEAKIKEVKFADNGYWMVVECDQTVVCFDLRKDVGTLAYPTYTIPEFKTGTVTYDIDDSGKNMIAYSNESNSLTIYKFDKKTKNWTKDEESALCLQSDTADFTDMDVVCGDGGIAAILKTNDSFNIVALTP

SEQ ID NO: 15550 - protein, 460 aa, Drosophila melanogaster
MSAINSRNQKMEQQRQLMEAYIRQKRASPGMVQASDLQINRPMSGMRSNSRELHAYDGPMQFISSPQNPDQILTNGSPGGINPVAMNTSRNHSNNMRSLSTINQEADLIEEISSHELEDEESSPVTVIEQHQQSASHSANSTQSQKPRARQHSFSDNLDEDDYTNRNVAGAAPVRPAGMASPPYKDATLDGSSNGTGNGTGGESEGDVIGNIDQFVMQPAPQGVLYKCRITRDRKGMDRGLFPIYYLHLERDYGKKIFLLGGRKRKKSKTSNYIVSCDPTDLSRNADGFCGKLRSNVFGTSFTVFDNGNKESTESPRLDLAVIIYDTNILGFKGPRNMTVILPGMTEDDQRVKISSADPKQQGILDLWKMKNMDNIVELHNKTPVWNDETQSYVLNFHGRVTQASVKNFQLVHDSDPEYIVMQFGRTSEDVFTMDYRYPLCAMQAFAIALSSFDGKIACE

SEQ ID NO: 15551 - protein, 387 aa, Hydra vulgaris
MPDEITTVKEGWLMKRGEYIKNWRPRYFVLRSNGLFLGYKEKVKGGDGGCEPINTFSIERCQIMRQSKPKPNVFIIRCFQLTTLVERTFAVDSNFDREEWISALEEISRRLAKEEINRRSTSIIDFTDSIHRPKMTLEDFEMLKVLGKGTFGKVMLGKEKKTGNVFAIKLLRKDVILAKDEVEHTLTENRVLQNMKHPFLTELKYSFQTNDRLVFVMEYVNGGELFFHLSRDKVFSEARARFYGAEITLALKYLHENKIVYRDLKLENLLIDSEGHIKITDFGLCKEEISFTDTTKTFCGTPEYLAPEVLEDNDYGHAVDWWGFGVVLYEMLCGRLPFYNRDHEVLFELILSEPVRFPSRLSLSSKSILSGLLEKNPDKRYVMHFFF

SEQ ID NO: 15552 - protein, 281 aa, Physcomitrella patens subsp. patens
MGRGKIEIKKIENTTSRQVTFSKRRGGLLKKAHELAVLCDAEVALVIFSSTGKHFEFASSGSMRDIIERYRKSSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGWLSEQQIPSTEEGCAGESSLKWDHPHFHIQNRLHANISPSVRTYKLHVDR

SEQ ID NO: 15553 - protein, 204 aa, Schizosaccharomyces pombe
MSLILYPKPTSYLYQPFIKAYFSLNMAIFEINNSFLICAVSIALNPLLWNIAARSEYNHKTLTKLANGDSKKACYMLAACIFVAGIVRDLIYQNALKQQPTLGIFMNPLVQGIAKLIFCFGSVLVLSSMYKLGLVGTYLGDYFGFLLPERVSGFPFNVNDNDNPMYNGSTLCFLSTALRYGKVAGLLLTLEVFFVYRIALKFEE

SEQ ID NO: 15554 - protein, 776 aa, Schizosaccharomyces pombe
MMLGFFFGRISYDAGIGFLQHMQSNHRKVVTWISDFGFFDKENHPKLYDLTKKQLISKMDSSYNYDTSPLEFNSWLVFRHFVDLILMCDFCSYILMGLAWTCWPKVNIILQFLRIFGGIALIVFNYWVKMDAHRVVRDYAWYWGDFFFLLRSSLVFNGVFELAPHPMYSVGYAGYYGMSLLTGSYAVLFASILAHAAQFGFLLFVENPHIERTYGTDINHARLSPRGEDNEFELPPEHDLVGFVNFDFTRISDVALLIIALYSIFIILLSSNSHYSQFWAIFQAFVWRFLHSIIHAFILFYQSKSKAWTKHFIRNGESAAYAWSQWKGLYNLTLNMSYISFVMAAWKLYHLPSNWTYGLVSLRHALGFGLIALHIYTSVSIYEDLGQYGWFYGDFFLPSRSPKLVYQGIYRYVNNPERFLGCSAYWGLALISSSAWIFLIAILAQLSNLAIIRLVEQPHMQKVYGNTLRKEAGISKLIKQATSEKGNILPKTVETHMKALTTSVDKVLDQTAEALEEFVNTAPPKVQELLKGTESNLRKNAQLAILKLFAPQLSSSTHFDYKLEIKGIDNNQVLLGHPITVCWTASPNHEINDWIGLYKLSDNASDLYTQTSSEGRWSAIDANGYTSHCSSIKSLSNDKNSGEVEFSGDLLFWETGTFEFRYHYGGKHLVMAKTEPFVITATSMNTTDVDEVSAYLLKSIKFCDPNITPHDGDASLCDISEGSARKLTSIIKYSFGIDLSYRVVQVDGSCSALSRRIVNSLKILQSFDGPSGAKDD

SEQ ID NO: 15555 - protein, 242 aa, Daucus carota subsp. sativus
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 15556 - protein, 216 aa, Daucus carota subsp. sativus
MGRGKIEIKRIENSNNRQVTYSKRRNGLIKKAKEITVLCEAAVSVVIFSSPSKLYEYCSPSTSITEMLDRYHQHSGQRLWDPEHEALSNEIKRIKEENEKMQIDLRHLNAEDISSLNIKELMTIENDLENGLMNIGEKRRESYKRMQKDGQRLEEENMQLRYVYQQQMEAMAGKVRDIENEFNHLKVNDQSYEAQMPFAFRLQPNQPNLHNQMLLD

SEQ ID NO: 15557 - protein, 223 aa, Daucus carota subsp. sativus
MARGKIQIKKIENATNRQVTYSKRRNGLFKKAHELSVLCDAKVSIIMVSSTNKLHEFITPNLSQKQLYDQYQKAKPCDLWSNHYQAMQEQLRKLREVNRNLRNEISHRKGESLNGVSHEELYILEQKMQEAVDITRAQKMKTITNQIEKSKKKVRNGEQVQRTLLQDLELFKEEDPHYGLVDNGGDYETVFGCSNAYPGLLALRLQSNHYNFHGGAGSDLTFA

SEQ ID NO: 15558 - protein, 255 aa, Daucus carota subsp. sativus
MSFVDDQSGDLSLHERKSGRGKIEIKRIENTTNRQVTFCKRRNGLLKKAYELSVLCDAEVALIVFSNRGRLYEYANNSVRGTIERYKKANSDTPNTATVSEANTQYYQKEAARLRQQISNLQNSNRHLMGEALGAVPAKELKGLETKLQNGLSRVRSKKNELLFAEIEFMRKREIDLHNNNQYLRAKISENERAQQQMSLMPGASGSSEQYRDVGQPHESFDARNYLQVNGLQPNNANYSSHQDHQTQHVPLQLV

SEQ ID NO: 15559 - protein, 246 aa, Daucus carota subsp. sativus
MGRGKVELKRIENKINRQVTFAKRRNGLLKKAYELSVLCDAEVALIIFSNRGKLYEFCSTSSMNKTLGRYHRCSYGALETGQTDRDTQSSYQEYIKLKAKVEALQQSQRHLLGEELGQLGTKELEELERQLDSTLRQVRSTKTQYMLDQLSDLQQKEQELVEINKALRNKLEENDVRIQSQWEAAERNNVAYRSHPAEHPPDHGVFESLECNNTMHMGYNSAMNDHQMASATPTQNASGVIPGWML

SEQ ID NO: 15560 - protein, 382 aa, Daucus carota
MRFTRVYTEVFNMTDHSLLCTETNNLCFDDLEARDDQDPRIDCENVVGNESEALICAVPLQRDEDFVFVFESKVNFCPEVIFSTDRSGELDLCVRKEALDWIYKAHAHYNFGALSVCLAVNYLDRFLSLYELPSGKKWTVQLLAVACLSLAAKMEEVNVPLTVDLQVADPKFVFEAKTIKRMELLVLSTLKWRMQACTPCSFIDYFLRKINNADALPSGSLIDRSIQFILKTMKGIDFLEFRPSEISAAVAICVTREAQTLDINKAMSNIIPVEKDRVFKCIEMIQDLTLVTETSNVASGRTRAQVPQSPVGVLDAACLSYKSDERTVGSCPNSSLHTETSPHTKRRKLIEIMKCGFYSITQFQIFSEWEFWCGCLCKRPPL

SEQ ID NO: 15561 - protein, 200 aa, Oryza sativa (japonica cultivar-group)
MAAGKGKGKEGECDMAAAAAEAEKKGEGSTVSRGAAGERVVEDSGGGRRTIHLKSKDGKQHDVTEASARLSKTIAGMILAGGGGGGADQCIPTPDIDHDTLRVVMQYCDKHAADDADEEDLKEWDEDFVDELDQDALFDVIAAANYLDIDGLLDLTCKRVADTIKGKTPEEIRKEFNIVNDLSKEEEEEIRRENPWAFEQ

SEQ ID NO: 15562 - protein, 170 aa, Oryza sativa (japonica cultivar-group)
MRKHHNTRIRFFHVMITLKSSDGEPVEVTEASARISKVIGDKIDAGRGGEAIPLPHVDKKTLKKVIEYCDEHANENSDTDEQKEELKNWDKAFIDELDEDDGSFLFLVLLASSYLKIDGLLDLTYQRVADNSKAKTTEEIRKTFSTIEIELSDKEEEEQQQEEEIRPENV

SEQ ID NO: 15563 - protein, 221 aa, Oryza sativa (japonica cultivar-group)
MAEEKGKAVMPMEVDQVEDEREAETVVEAVQKAVYDALEKVEMMEEEGEAAVAEAADKLLEEAVEKAVTEALEEAGWDAAEKALSDDLEKVSLEAESARMITLESSDGEVVKVKEASARLSKTIGNIIDDGRGDEAIPLPDVSYKTLKKVVEYCDKHADEKSDTDEQKEELKNWDKAFIDELAEDDDSLVKVIMASNYLKIDGLHNLASQCKTTREQIGKA

SEQ ID NO: 15564 - protein, 277 aa, Oryza sativa (japonica cultivar-group)
MAEEKGKGKEEGEGSAMASKAAGILVVPGAVGVGNALLEAFAKVAVEKKDEVATVSELVRKLVSEGVAEEVAVTEALEHPVFDSPEKVVPEVAEEEESGGRMITLKSLDGKTVKVKEASARLSETIGNLIDDGRRRGDETIPRLFVSYKALMKVIEYCDEHANNKADTDERKEELKNWDKAFIDKLDEDNILFVEVLAASNYLKITGLSKLTDQRFVDPFNTSNKTPDAEETRVNLIPANTSATASTSRPSTSTSSPSTSTSASHSATRRGRGRRRH

SEQ ID NO: 15565 - protein, 182 aa, Oryza sativa (japonica cultivar-group)
MATGNGEAAVVEKEGEGTMVPEALEKKVVLDAAEKEEEEKDSEAEAEAEARISKLVGDMIDNVCADHGIPLPKVDIKTVRKMAEYMNKHFAITNKEELKIWDEGFINELDGDEDKYSLFKIIRASERVGFYGLLDLASDMVARKIKAGKAIDEIRKFLGVEKDFTKEEEEKIRRENAWAFEE

SEQ ID NO: 15566 - protein, 174 aa, Oryza sativa (japonica cultivar-group)
MATGSGAAAAAAADAEEKESGSRMITLTSNEGKAFVVTEASARQSATIRSMVDDGGCVDKGFPLPNVDSKTLARVIQYCDEHGNKEPHTVDERAALAKFDRDFIAELDADKAFLYDVTMAANYLHIQGLLALTTQCVADTIKGKTPEEIRTAFGIEYDLTAQDEKEIKEEDTHA

SEQ ID NO: 15567 - protein, 233 aa, Oryza sativa (japonica cultivar-group)
MDHNLLAQHSLQTQKVLVQLASQLGLERRKPERRRRPRRRRRGRGEEPVAAAVVEMEGEDAVVPEAVAADAEKAEEKESGSRMITLKSNEGKAFVVTEVSARQSTTIGHMIDDDCTREAVPLPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 15568 - protein, 246 aa, Oryza sativa (japonica cultivar-group)
MAAAAAAAAEEEEEKESGSSRMITLKSNDEKLVEVTEASARQSRAIANLIDDGCADVIPLPNVDSKTLAKVIPYCDEHGRANSGTDEERAALGRFDADFVGELDKDKASLIDVIMAANYLNIQGLLDITCQRVADTIGSATAEKIREAFDIEDDLTEAEKKEIREENAWAFDGIPCLLVGIWFDGGIPIQEIRLQICNISQWSVLDRSGNAFPAREFALGASLVLLAWIVVRIELRMGKKHRCDFI

SEQ ID NO: 15569 - protein, 298 aa, Mus musculus
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFKGLGDCLVKIYKSDGIKGLYQGFNVSVQGIIIYRAAYFGIYDTAKGMLPDPKNTHIFISWMIAQSVTAVAGLTSYPFDTVRRRMMMQSGRKGTDIMYTGTLDCWRKIARDEGSKAFFKGAWSNVLRGMGGAFVLVLYDEIKKYT

SEQ ID NO: 15570 - protein, 492 aa, Mus musculus
MDPSSKKVTGRLMLAVGGAVLGSLQFGYNTGVINAPQKVIEEFYNQTWNHRIGEPIPSTTLTTLWSLSVAIFSVGGMIGSFSVGLFVNRFGRRNSMLMMNLLAFVAAVLMGFSKLGKSFEMLILGRFIIGVYCGLTTGFVPMYVGEVSPTALRGALGTLHQLGIVVGILIAQVFGLDSIMGNADLWPLLLSVVFVPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFEVGPGPIPWFIVAELFSQGPRPARIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 15571 - protein, 178 aa, Artificial
  synthetic sequence
MADSTAAQDAPRQEEDARKVNLVSMDGDSFEVSRSVASMSELVKTLISDEQEDDEVQEIPLPNVKSTVLSKVIEFCSHHHNNPMREIEKPLKSSDMHDVVSDWDANFVDIEQDILFELILAANYMDIKSLLDLACAKVASMIKGKTPQEIRETFNIVNDFTPEEESQIREENKWCEEA

SEQ ID NO: 15572 - protein, 250 aa, Bacillus thuringiensis serovar alesti
MTVKKLYFIPAGRCMLDHSSVNSTLTPGNLLNLPVWCYLLETEEGPILVDTGMPEIAVNNEGLFNGTFVEGQILPKMTEEDRIITILKRAGYEPDDLLYIISSHLHFDHAGGNGAFSNTPIIIQRAEYEAAQYREEYLKECILPHLNYKIIEGDYEVVPGVRLLYTPGHSPGHQSLLIETEKSGPILLTIDASYTKENFEDEVPFAGFDSELALSSIKRLKEVVAKEKPIIFFGHDIEQEKGCKVFPEYI

SEQ ID NO: 15573 - protein, 250 aa, Bacillus thuringiensis serovar canadensis
MTVKKLYFIPAGRCMLDHSSVNSTLAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRAEYEAALHREEYMKECILPHLNYKIIEGDYEVVPGVQLLYTPGHSPGHQSLFIETEQSGSVLLTIDASYTKENFEDEVPFAGFDPELALSSIKRLKGVVAKEKPIVFFGHDIEQEKGCRVFPEYI

SEQ ID NO: 15574 - protein, 250 aa, Bacillus thuringiensis serovar galleriae
MTVKKLYFIPAGRCMLDHSSVNSALTPGKLLNLPVWCYLLETEEGPILVDTGMPESAVNNEGLFNGTFVEGQILPKMTEEDRIVTILKRVGYEPDDLLYIISSHLHFDHAGGNGAFTNTPIIVQRTEYEAALHREEYMKECILPHLNYKIIEGDYEVVPGVQVLYTPGHSPGHQSLFIETEQSGSVLLTIDASYTKENFEDEVPFAGFNPELALSSIKRLKEVVAKEKPIVFFGHDIEQEKGCRVFPEYI

SEQ ID NO: 15575 - protein, 250 aa, Bacillus thuringiensis serovar kyushuensis
MTVKKLYFVPAGRCMLDHSSVNSTLTPGNLLNLPVWCYLLETEEGPILVDTGMPESAVNNENLFDGTFVEGQILPKMTEEDRIVNILKRVGYEPEDLLYIISSHLHFDHAGGNGTFTNTPILVQRAEYETAQHSEEYLKECILPNLNYKIIEGDYEVVPGVQLLYTPGHTPGHQSLFIETENSGPVLLTIDASYTKENFEDEVPFAGVDSELALSSIKRLKEIVRKENPIVFFGHDIEQEKSCKVFPEYI

SEQ ID NO: 15576 - protein, 250 aa, Bacillus thuringiensis serovar ostriniae
MTVKKLYFIPAGRCMLDHASVNSTLTPGKLLNLPVWCYLLETEEGPILVDTGMPESAVNNEGLFNGTFVEGQILPKMTEEDRIVNILKRVGYDPEDLLYIISSHLHFDHAGGNGAFTNTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKEVVTKEKPIVFFGHDIEQEKGCRVFPEYI

SEQ ID NO: 15577 - protein, 250 aa, Bacillus thuringiensis serovar pakistani
MTVKKLYFIPAGRCMLDHSSVNGTLAPGSLLNLPVWCYLLETEEGPILVDTGMPESAVNNEGLFNGTFVEGQILPKMTEEDRIVNILKRVGYEPDDLLYIISSHLHFDHAGGNGVFTDTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKGVVAKEKPIVFFGHDIEQEKGCRVFPEYI

SEQ ID NO: 15578 - protein, 250 aa, Bacillus thuringiensis serovar entomocidus/subtoxicus
MTVKKLYFIPAGRCMLDHSSLNSTLTPGKLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEKSGPVLLTIDASYTKENFEDEVPFAGFDPELALSSIKRLKGVVAKEKPIVFFGHDIEQEKGCRVFPEYI

SEQ ID NO: 15579 - protein, 250 aa, Bacillus thuringiensis serovar toumanoffi
MTVKKLYFVPAGRCMLDHSSVNSTLTPGKLLDLPVWCYLLETEEGPILVDTGMPESAVNNEGLFNGTFVEGQVLPKMTEEDRIVNILKRVGYEPEDLLYIISSHLHFDHAGGNGAFINTPIIVQRAEYEAAQHSEEYMKECKLPNLNYKIIEGDYEVVPGVQLLYTPGHTPGHQSLFIETENSGPVLLTIDASYTKENFEDEVPFAGFDPELALSSIKRLKEVVIKEKPIVFFGHDIEQEKGCKVFPEYI

SEQ ID NO: 15580 - protein, 250 aa, Bacillus cereus
MTVKKLYFIPAGRCMLDHSSVNSALTPGKLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKEVVAKEKPIVFFGHDIEQEKGCRVFPEYI

SEQ ID NO: 15581 - protein, 738 aa, Nicotiana tabacum
MDCNCFDPQWPADELLMKYQYISDFFIAVAYFSIPIELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRTLALEECALWMPTPPGLELQLSYTLRHQNPIGFTVPIQLPVINQVFGTNRAVKISPNSPVARLRPAGKYMPGEVVAVRVPLLHLSNFQINDWPELSTKRYALMVLMLPSGSARQWHVHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDVGTFNLHVLFRKVLNLIKPIASVKNCLSRLTCLQICPEFAIGDEKRLMQILLNVVGNAVKFSKEGSVSISAVAAKSESLSDPRAPEFFPVQSENHFYLRVQVKDTGSGINPQDIPKLFCKFAQNQALATKSSGGTGLGLAISKRFVNLMEGHIWIESEGLGKGSTAIFIVKLGIPGRSNEPKLPFMPRLPANHMQMTFQGLKVLIMDDNGFSRMVTKGLLVHLGCDVTTVSSGDECLRVLTQEHKVVFMDVSIPGIDCYEVAVQIHEKFGKHHNRPLIVALTGNTDRVTKENCMRVGMDGVILKPVSVDKMRSVLSELLEHGVILQS

SEQ ID NO: 15582 - protein, 736 aa, Lycopersicon esculentum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSKEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 15583 - protein, 735 aa, Brassica oleracea
MEVCNCIEPQWPADELLMKYQYISDFFIAVAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQHPVEYTVPIQLPVINQVFGTSRAVKISPNSPVARLRPVSGKYLLGEVVAVRVPLLHLSNFQINDWPELSTKRYALMVLMLPSDSARQWHVHELELVEVVADQVAVALSHAAILEESMRARDLLMEQNVALDIARREAETAIRARNDFLAVMNHEMRTPMHAIIALSSLLQETELTPEQRLMVETVLKSSSLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDNRAPPDFFVVPTGSHFYLRVKVKDLGAGINPQDIPKLFTKFAQTQSLATRSSGGSGLGLAISKRFVNLMEGNIWIESEGVGKGCTAIFDVKLAISNESKQSGIPKVPANPQHVNFAGLKVLVMDENGVSRMVTKGLLVHLGCEVTTVSSNEECLRVVSHEHRVVFMDVCTPGVENYQIALRIHEKFTKRHQRPLLVALTGNTDKSTKEKCMSFGLDGVLLKPVSLDNMRNVLSDRLEHRVLYEAM

SEQ ID NO: 15584 - protein, 741 aa, Malus x domestica
MLACNCIEPQWPADELLMKYQYISDFFIALAYFSIPLELIYFVKKSAVFPYRWVLVQFGAFIVLCGATHLINLWTFSIHSRTVAMVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISANSPVAKLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTAEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLGFPERSNESKLPFAPKLQANHVQTNFPGLKVLVMDDNGVSRSVTKGLLAHLGCDVTAVSLIDELLHVISQEHKVVFMDVSMPGIDGYELAVRIHEKFTKRHERPVLVALTGSIDKITKENCMRVGVDGVILKPVSVDKMRSVLSELLEHRVLFEAM

SEQ ID NO: 15585 - protein, 740 aa, Cucumis melo var. reticulatus
MENCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRALKISPNSPVASLRPRAGRYVAGEVVAVRVPLLHLSNFQINDWPELSTKRYALMVLMLPSDSARQWRVHELELVEVVADQVAVALSHAAILEESMRARDLLMEQNVALDLARREAETAIRARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGPDLPVFAVGDEKRLMQAILNVVGNAVKFSKEGSISISAIVAKSETFREIRVPDFHPVPSDSHFYLRVQVKDTGSGISPQDIPKLFTKFAQTTVGPRNSGGSGLGLAICKRFVNLMEGHIWLESEGLGKGCTATFIVKLGIADQSNESKLPYTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 15586 - protein, 754 aa, Lycopersicon esculentum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTPKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 15587 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSGSGINPQDIPKLFTKFAQTQSLATRNSGGSGLGLAICKRFVNLMEGHIWIESEGPGKGCTAIFIVKLGFAERSNESKLPFLTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 15588 - protein, 740 aa, Cucumis sativus
METCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRAVKISPNSPVASLRPRAGRYVAGEVVAVRVPLLHLSNFQINDWPELSTKRYALMVLMLPSDSARQWRVHELELVEVVADQVAVALSHAAILEESMRARDPLMEQNVALDLARREAETANHARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGLDLPVFAVGDEKRLMQAILNVVGNAVKFSKEGSISISAIVAKAETFREIRVPDFHPVPSDSHFYLRVQVKDTGSGISPQDIPKLFTKFAQTTVGPRNSCGSGLGLAICKRFVNLMEGHIWLESEGLGKGCTATFIVKLGIAEQSNESKLPFTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 15589 - protein, 741 aa, Pelargonium x hortorum
MESCNCIEPQWPADELLMKYQYISDFFIAIAYFSIPLELIYFVKKSAVFPYRWVLVQFGAFIVLCGATHLINLWTFNMHSKTVEIVMTTAKIMTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGFTVPIHLPVINQVFSSNHAIKISPNSPIARLRPIAGKYMPGEVVGVRVPLLHLSNFQINDWPELSTKRYALMVLMLPSDSARQWHVHELELVEVVADQVAVALSHAAILEESMRARDLLMEQNVALDMARREAETAIRARNDFLAVMNHEMRTPMHAIIALSSLLQETELTPEQRLMVETVLKSSNLLATLINDVLDLSRLEDGSLQLDIGTFNLHALLREVHNLIKPIASVKKLCISLNVATDLPEYAVGDEKRLVQIILNVVGNAVKFSKEGNISITAFVAKSESLRDPRAPDFFPICGENQFYLRVQVKDSGLGINPQDIPRLFTKFAQTQPVATKNSGGSGLGLAICKRFVNLMEGHIWIDSEGPGKGCTATFVVKLGIPERSSEPKLLLMPKVPANHGQTNFSGLKVLLLDDNGVSRAVTRGLLAHLGCDVTTVSSSDELLRVVSQDYKVVFMDVCMPEVDGFEIAVRIHEKFMTRHERPLIVALTGNIDQVTKDNCTRVGMEGVVLKPVSIDKMRNVLSNLLEHRVLFEAI

SEQ ID NO: 15590 - protein, 740 aa, Pelargonium x hortorum
MEACNCFEPQWPADDLLMKYQYISDFFIAVAYFSIPLELIYFVKKSAVFPYKWVLVQFGAFIVLCGATHLINLWTFNLHTRTVEIVMTTAKLMTAAVSCVTALMLVHIIPDLLSVKTRELFLKNKAAELDREMGLIRTQEETGRHVRMLTHEIRSTLDRHTILKTTLVELGRTLGLEECALWMPTRTGLELQLSHTLRQQNPVGYTVPIHLPVLNQVFSSNRAIKISPNSPIARLRPLAGKYVPGEVVAVRVPLLHLSNFQINDWPELSTKRYAMMVLMLPSDSARQWHVHELELVEVVADQVAVALSHAAILEESMRARDLLMEQNVALDMARREAETAIRARNDFLAVMNHEMRTPMHAIIALSSLLQETDLTSEQRLMVETILKSSNLLATLINDVLDLSRLEDGSLQLDIATFNLHAVFRQVFNLIKPIASVKKLFITLNVSPDLPEYVIGDEKRLVQIMLNVVGNAVKFSKEGIISVTAFVAKSESVRDPRAPDFFPVSSDNQFYMRVQVKDSGSGINPQDMPKLFTKFAQSQPVATKNSGGSGLGLAISKRFVNLMDGHIWIDSEGPSKGCTVTFVVKLGIPEGSNEPKLPLMPKVSANNSQTDFPGLKVLLMDENGISRMVTKGLLMHLGCDVTSVSSSEECLRMVSQDHKVVFMDVRVPGLDGHELAVRIHEKFMKRHERPLIVALTSNADKVTKENCLRVGMEGVILKPVSVDKMRNVLSKLLEHRILFEA

SEQ ID NO: 15591 - protein, 738 aa, Passiflora edulis
MESCNCIEPQWPAEELLMKYQYISDFFIALAYFSIPLELIYFVKKSAVFPYRWVLVQFGAFIVLCGATHLINLWTFTMHSRTVATVMTIAKVLTAVVSCATALMLVHIIPDLLSVKTRELFLKNKAAELDREMGLIRTQEETGRHVRMLTHEIRSTLDRHTILRTTLVELGRTLALEECALWMPTRTGLELQLSYTLRQQNPVGYTVPIQLPVINQVFSTNRAVKISPNCPVARLRPLAGKYVPGEVVAVRVPLLHLNNFQINDWPELSTRRYALMVLMLPSDSARQWRVHELELVEVVADQVAVALSHAAILEESMRARDLLMEQNVALDLARREAETAIRARNDFLAVMNHEMRTPMHAVIALSSLLQETELTPEQRLMVETILKSSNLLATLINDVLDLSKLEDGSLQLDSGTFNLHAVFREVLNLIKPIASVKKLLLLLNLAPDLPEYAVGDEKRLIQIILNIVGNAMKFSKEGSISITAIVAKLESLRDARVPDFFPTPSENHFYLRVQVKDSGVGINPQDIPKLFIKFAQTQTTGARNSSGSGLGLAICRRFVNLMDGHIWLESEGLGKGCTAIFIVKLGIPERLNESKPPFMSKVAVDHGQTTFPGLKVLLMDDNGVSRMVTKGLLLHLGCDVTTVGSSEECIRVASQDHRVVFMDVGMPEGFEAAVRLHEKFTKRHERPLVVALTASTDRMTKENCMRVGMDGAILKPVSVDKMRSVLSDLLEHKVLFEC

SEQ ID NO: 15592 - protein, 577 aa, Streptococcus bovis
MTEMLKGIAASDGVAVAKAYLLVQPDLSFETVTVEDTSAEEARLDAALKASQDELSIIREKAVETLGEEAAAVFDAHLMVLADPEMISQIKETIRAKQTNAEAGLKEVTDMFITIFEGMEDNPYMQERAADIRDVAKRVLAHLLGAKLPNPATIDEESIVIAHDLTPSDTAQLNKQFVKAFVTNIGGRTSHSAIMARTLEIAAVLGTNDITSRVKDGDIVAVNGITGEVIINPTDEQVAEFKAAGEAYAKQKAEWALLKDAKTVTADGKHFELAANIGTPKDVEGVNANGAEAVGLYRTEFLYMDSQDFPTEDEQYEAYKAVLEGMNGKPVVVRTMDIGGDKELPYLDLPKEMNPFLGFRALRISISETGNAMFRTQIRALLRASVHGQLRIMFPMVALLKEFRAAKAIFDEEKANLKAEGVAVSDDIQVGIMIEIPAAAMLADQFAKEVDFFSIGTNDLIQYTMAADRMNEQVSYLYQPYNPSILRLINNVIKAAHAEGKWVGMCGEMAGDQKAVPLLVEMGLDEFSMSATSILRTRSLMKKLDTAKMQEYANRALTECSTMEEVLELSKEYVNVD

SEQ ID NO: 15593 - protein, 809 aa, Zea mays; identical to SEQ ID NO: 5474

SEQ ID NO: 15594 - protein, 553 aa, Mus musculus
MIQRLWASRLLRHRKAQLLLVNLLTFGLEVCLAAGITYVPPLLLEVGVEEKFMTMVLGIGPVLGLVSVPLLGSASDQWRGRYGRRRPFIWALSLGVLLSLFLIPRAGWLAGLLYPDTRPLELALLILGVGLLDFCGQVCFTPLEALLSDLFRDPDHCRQAFSVYAFMISLGGCLGYLLPAIDWDTSVLAPYLGTQEECLFGLLTLIFLICMAATLFVTEEAVLGPPEPAEGLLVSAVSRRCCPCHVGLAFRNLGTLFPRLQQLCCRMPRTLRRLFVAELCSWMALMTFTLFYTDFVGEGLYQGVPRAEPGTEARRHYDEGIRMGSLGLFLQCAISLVFSLVMDRLVQKFGTRSVYLASVMTFPVAAAATCLSHSVVVVTASAALTGFTFSALQILPYTLASLYHREKQVFLPKYRGDAGGSSGEDSQTTSFLPGPKPGALFPNGHVGSGSSGILAPPPALCGASACDVSMRVVVGEPPEARVVTGRGICLDLAILDSAFLLSQVAPSLFMGSIVQLSHSVTAYMVSAAGLGLVAIYFATQVVFDKNDLAKYSV

SEQ ID NO: 15595 - protein, 430 aa, Mus musculus
MAMPRNGSRLDIVHENLKMGSDGESDQASGTSSDEVQSPTGVCLRNRIHRRISMEDLNKRLSLPADIRIPDGYLEKLQISSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINERGELKLADFGLARAKSVPTKTYSNEVVTLWYRPPDVLLGSSEYSTQIDMWGVGCIFFEMASGRPLFPGSTVEDELHLIFRLLGTPSQETWPGVSSNDEFKNYNFPKYKPQPLINHAPRLDSEGIELITKFLQYESKKRVPAEEAMKHVYFRSLGPRIHALPESVSIFSLKEIQLQKDPGFRNSSYPETALS

SEQ ID NO: 15596 - protein, 310 aa, Oryza sativa (japonica cultivar-group); identical to SEQ ID NO: 3120

SEQ ID NO: 15597 - protein, 379 aa, Zea mays; identical to SEQ ID NO: 5489

SEQ ID NO: 15598 - protein, 372 aa, Yersinia pestis KIM
MRVKRVQLTPLRLQVRKVIEFLPIFSFSIPQSTGLTMKRELAIEFSRVTEAAALAGYKWLGRGDKNAADGAAVQAMRIMLNQVNIDGRIVIGEGEIDEAPMLFIGEHVGTGQGDAVDIAVDPIEGTRMTAMGQANALAVLAVGDQGTFLHAPDMYMEKLVVGPAAKGAIDLNLPLEQNLCNIATALNKPLADLTVITLAKPRHDGIIAAMQQLGVKVFAIPDGDVAASILTCMPESEVDVMYCIGGAPEGVISAAVIRALDGDMQGRLLPRHQVKGDSEDNRRIGEQELLRCKSMGIEAGNVLQLGDMARNDNVIFSATGITKGDLLEGIYRKGNMATTETLLIRGKSRTIRRIRSTHFLDRKDPALHEFLL

SEQ ID NO: 15599 - protein, 274 aa, Yersinia pestis KIM
MMSSEELEQVWSNIKSEARALAECEPMLASFFHATLLKHENLGSALSYILANKLANPIMPAIAIREVVEEAYRSDAHMIVSAARDILAVRLRDPAVDKYSTPLLYLKGFHALQAYRIGHWLWAQDRKALAIYLQNQVSVAFGVDIHPAATIGCGIMLDHATGIVIGETAVVENDVSILQSVTLGGTGKTSGDRHPKIREGVMIGAGAKILGNIEVGRGAKIGAGSVVLQSVPAHTTAAGVPARIVGKPESDKPSLDMDQHFNGSIQGFEYGDGI

SEQ ID NO: 15600 - protein, 443 aa, Yersinia pestis KIM
MRDVSQILRLVASESALIANLFNGYAKISPLTAFIRTIMMTGLSGKHIVLGISGGIAAYKSPELVRRLRDKGADVRVVMTHAAKAFIAPLTLQAVSGYPVSDDLLDPAAEAAMGHIELGKWADLVIIAPATADLLARMAAGMANDLLTTVCLATAAPIAAVPAMNQQMYRAPATQENLQTLSKWGVLLWGPDSGSQACGDIGPGRMLDPQEIVALAYNHFSAKQDLQHLSVMITAGPTREPLDPVRFISNQSSGKMGFAIAQALAARGSNVTLIAGPVNLSTPEGVKRIDVITALEMQQAVQKIAQQQNIFISCAAVADYRAEHVSDEKIKKQGDEITLKLVKNPDIVAGVASMAKNRPFVVGFAAETQNVEEYARQKLARKNLDLICANDVSLAEHGFNSDTNALHLFWSTGEKRLPLSDKYLLSQRLIDEIVSRYDEKNRH

SEQ ID NO: 15601 - protein, 556 aa, Yersinia pestis KIM
MWSLKESMEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 15602 - protein, 929 aa, Yersinia pestis KIM
MTLLMGVTLTVIWLILIATTAFFSYENTRQILINELTHMASMRADLSNHQFEGAERDAASLISRRESLQSTSPLPEISIKHYDSYYIPFNLDSCNINQHKNDLWIIQAYGTAGQTYYLDSFIIKQKEGIVLFPPQKSSSDYLNQRRKDLLLLPKFPTHNNIYWGAPTYTPQGGWHVSVAVCDKVGTLAGFALKLNDLIAYNHPVEQRDINLLLDKNGELLPISQQATSSNQLHEILNQLKNSKLHDGWQQTPDYLVLRTQLKGPGWQQLVIYPRMGFAWEALKPALYQLPFALAILLLLTSVLSLLLRYYLAIPLWNFINIIGATGPQAMEPRLPINRIDELGHIARAYNNLLDTLNEQYDTLEMKVKERTLALAEAKRAAEQANRRKSDHLTTISHEIRTPLNGALGAVELLQNTPLDAGQMRLAETAHQCSLSLLAIINNLLDFSRIESGQMTLSLEKTALLPLLDQAMLTIHSQALSKSLALSTFISANIPLELELDTLRLRQILVNLLGNAVKFTPQGRIQLRVRRQNQTLCFTVEDTGCGIDVQHQQTIFQPFMQTSDHEQGTGLGLAIADNLAKMMGGHLTVFSEPGQGSCFSLCLPFNAITPPMPFHGELFAPQRLHAQLSAWGMTCQPELANQPSRHFVDNALCYLPGRLYAKLKQYLQGAETEALKSLPLQPWQMHILLVDDSETNRDITGMMLQQLGHQVTRADSGTTALAIGRQHRFDLVLMDIRMPVLDGLATTARWRHDPANIDSHCMITALSANASPDEQIKTSQAGMNHYLSKPVTLGQLAEMLDLTAQFQLERGVDLSPQLSEPQPLLDLADSALSLKLYQSLQVLIQQAKDAIENLPVLSHTLHTIKGCAGQAGLIELQDAVIQLEHALDTHETLTQQEIIQLDEIIHVLLQPPTTCESTFIISQGQSLMVK

SEQ ID NO: 15603 - protein, 372 aa, Yersinia pestis KIM
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 15604 - protein, 347 aa, Yersinia pestis KIM
MRIEEGLKLGFKDVLIRPKRSTLKSRSEVALERQFTFKHSGWNWSGVPIIAANMDTVGTFRMAEVLASFDILTAVHKHYTLEQWAEFVKRSPESVLLHVMVSTGTSSADFDKMKQILALSPSLKFICIDVANGYSEHFVSFLQRAREACPDKVICAGNVVTGEMVEELILSGADIVKVGIGPGSVCTTRVKTGVGYPQLSAVIECADAAHGLGGQIVSDGGCSVPGDVAKAFGGGADFVMLGGMLAGHDECEGRVVEENGEKFMLFYGMSSESAMKRHVGGVAQYRAAEGKTVKLPLRGSVDNTVRDIMGGLRSACTYVGASHLKELTKRTTFIRVAEQENRVFGTD

SEQ ID NO: 15605 - protein, 933 aa, Yersinia pestis KIM
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 15606 - protein, 515 aa, Yersinia pestis KIM
MLEAIDYALYNATAIFYLFHIHLGEILPMLRIAKEALTFDDVLLVPAHSTVLPNTAELGTQLTATIRLNIPMLSAAMDTVTESRLAIALAQEGGLGFIHKNMSIERQAEEVSRVKKHESGVVTEPQTVTPTTTLRQVKELTARNGFAGYPVVTEDYELVGIITGRDVRFVTDLDQPVTAVMTPKERLVTVKEGETREVVLQKMHEKRVEKVLVVDDSFHLRGMITVKDFQKAERKPNACKDEHGRLRVGAAVGAGAGNEERIDALVAAGVDVLLIDSSHGHSEGVLQRIRETRAKYPNLQIVGGNVATGAGAKALADAGVSAVKVGIGPGSICTTRIVTGVGVPQITAIADAVEALEGTGIPVIADGGIRFSGDIAKAIAAGASCVMVGSMLAGTEESPGEIELYQGRSFKSYRGMGSLGAMSKGSSDRYFQTDNAADKLVPEGIEGRVAYKGLLKEIVHQQMGGLRSCMGLTGCGTINELRTKAEFVRISGAGIQESHVHDVTITKESPNYRMM

SEQ ID NO: 15607 - protein, 241 aa, Yersinia pestis KIM
MLIPAQGIGFLLAKGLAEFGAEIIINDITAERAEKAVAELRASGFIAHAAAFNVTNHDEVNEAIEKIESHIGAIDVLINNAGIQRRHAFTEFPEKDWDDVIAVNQKSVFLVSQAVARYMVKRQRGKIINICSMQSELGRDTITPYAASKGAVKMLTRGMCVELARYNIQVNGIAPGYFKTDMTKALVDDQAFTDWLCKRTPAARWGDPEELIGAAVYLSSKASDFVNGHLLFVDGGMLVAV

SEQ ID NO: 15608 - protein, 559 aa, Yersinia pestis KIM
MSAPLYKQELLMLNNPRKDIPLIVTSLLCIILIALAFSLFPQQSSQMAETIFSGVTRLLGSTIQILVLLGLILVLYIAVSKYGNIRLGEGKPEYRTIPWLFMFICAGLGSSTLYWGVMEWAYYYQTPGLNIAPKTPKALEYSVSYSFFHWGISAWATYALASLIMAYHFHVRKNKGLSLSGIISAITGVNPQGFWGRLVDLIFLIATIGALTISLVITAATFTRGLTALIGVPNNFAVQAGVMLVAAVIFSFSSYIGIDHGMQRLSKMVGWGAFGFAVLVLLVGPTEFIINNTINSIGLTTQNFLQMSLFTDPMGDGRFTRSWTVFYWLWWISYTPGVAMFVTRVSRGRKLKEVIWALLLGSSLGCWFFFGVLESYAIQQFISGALDVPLILNTQGGETAVQMLLSALPMGKLFLAAYLFIMIIFLASHMDAVAYCMAATSTRNLREGEDPNRMLRLFWCVVITLIPLSILFAGASLDTMKTTVVLTALPFLLILLIEVYGFVRWIKQDYAHVPAHLIEQSTPQVMLPAESLPPATASMLVVETLVVETAAPPASKHNQ

SEQ ID NO: 15609 - protein, 268 aa, Yersinia pestis KIM
MKSRSSLTALREILAMILDSFELKGKVALVTGCDTGLGQGMAIGLAEAGCDIIGVNIVEPRETIEQVTALGRRFFSLTADLSNIECIPSLLERAVAEFGHIDILVNNAGIIRREDAINFSEKDWDDVMNVNIKSVFFMSQAVAKQFIKQGNGGKIINVASMLSYQGGIRVPSYTASKSAVMGVTRLLANEWAKHGINVNAVAPGYMATNNTQQLRKDEERSKEILDRIPAGRWGLPDDLKGPVVFLASKASDYISGYTIAVDGGWLAR

SEQ ID NO: 15610 - protein, 265 aa, Yersinia pestis KIM
MFSYQSHGKQLSPFLLLDYAGPMDFTPTTQRRGVGQHPHRGFETVTIVYHGEVEHRDSTGNGGIIGPGDVQWMTAGAGILHEEFHSDAFAQKGGPFEMVQLWVNLPAKDKMTAPGYQAIRREAIPQVNLPDDAGNLRVIAGEYAGNIGPAKTFSPLNVWDIRLTQGKSCEFSLPAGWNTALIVLHGTLLVNGDAIAREAEMVLLDPTGTHLSIEANNDTVLLLLSGEPIDEPIVGYGPFVMNTQAQIAEAIADFNGGRFGNMDVA

SEQ ID NO: 15611 - protein, 1283 aa, Yersinia pestis KIM
MHTPIIWCNSLRTTFLLRGRFSLRTVLYCLLLISGQLHASLMTGRQGCDTGQPLTIHSIANSYNDDLLLTPATDTRQSSRRTVKVGVVMDANTPFVVNRDDNAIEGIVADYLKIISDASQLSFQMIGYCDYGLVLNALENGQIDLMAGTPMLAQPGLIASHAFFTNRHVEVRSKNWDPTKRTHPETVAIVNNEPLSPEFLFNYHADRIVAYPNQLQGLLAVAYGNADVFVANATSANYLIDQLQLLTLQIRNFAPYHPAPYSFLARESNQKLIDYLNQILELLPTRATGDIQQRWFGSKHHYNIDAKLLLTEQELSWIQHHPVVTYIAPLDLAPLIFRDRRTGEMAGFSVDLIDIIARRTGIKFDPVYTKDTGEGVRSFKAGKVDLLPIVAVRNGQYGNNLYSSSIAQSLWGIMTREDRMDINNVGDLAGKRVGIQAGSASSSIISNPLLAQRITFVEAPDTMTLVRWLQQGKVDAVVKNMMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGDIRDIFLWIIPLNNAEQGVLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQISNTNHSQSTEDNDRGGNQSNLSEKNTAQQENAPAIHSTTITSSVNRLAAAQNKLRTLSGGNPAVELQLLQSLLESNLQDAVTLTQLYRQLCVEDEDVVETVDTAETVDTADTVEDGETRGPGSTVGRHSTAGSDHIPHADIYKQMASLVHRIKGSVQLIDAQELVASCVKFESQ

SEQ ID NO: 15612 - protein, 319 aa, Yersinia pestis KIM
MSKIVSLGIHVLDVLGRHVNRFPPGGELDIINEIRLTVAGTAAGMSVDLAKLGGDVYAMGAVGLDESGNFIIDTLRRYGGNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 15613 - protein, 379 aa, Yersinia pestis KIM
MEMIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 15614 - protein, 240 aa, Yersinia pestis KIM
MILLARLSISVTGHGNLCCFLFVAIFFCHDIGGCMLTVWGRNNSTNVKKVLWCLEELGIPYQRIDVGGQYGKLNDPQYRALNPNGLIPCLQDKDFILWESNTIVRYLAAQYGQNSLYLADHHQRASAEKWMDWATSSVVEPFKAVFIGLVRTPPEQQDKVKIAQGMEKMNTLMSIANDALGEQAYLSGDAFGIGDIPLGCLAYAWFNLPIERPELPHLQRWYQSLTQRIAFQKVIAIGLS

SEQ ID NO: 15615 - protein, 632 aa, Yersinia pestis KIM
MLAVSPTDTNPNTLKCGYRLMEQNPQSQLKLLVTRGKEQGYLTYAEVNDHLPEDIVDSDQIEDIIQMINDMGIQVLEEAPDADDLMLAENTTDTDDDAAEAAAQVLSSVESEIGRTTDPVRMYMREMGTVELLTREGEIDIAKRIEDGINQVQCSVAEYPEAITYLLEQYDRVEAGESRLSDLITGFVDPNAEEDIAPTATHVGSELSTEEMDDEDEDEDEDDDAEDDNSIDPELARQKFSDLREQYENARMEIKKNGRNHANAAAEILKLSEVFKQFRLVPKQFDYLVNNMRAMMDRVRTQERIIMKLCVEQCKMPKKNFVTLFSSNETSDTWFNAAVAMGKPWSEKLKDVSEDVQRSLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATSESLRSATHDVLAGLTAREAKVLRMRFGIDMNTDHTLEEVGKQFDVTRERIRQIEAKALRKLRHPSRSEVLRSFLDD

SEQ ID NO: 15616 - protein, 243 aa, Yersinia pestis KIM
MPCAMNWRWRLMVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGISDYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 15617 - protein, 284 aa, Leishmania donovani
MAGVDKAMVTLSNGIKMPQFGLGVWQSPAGEVTENAVKWALCAGYRHIDTAAIYKNEESVGAGLRASGVPREDVFITTKLWNTEQGYESTLAAFEESRQKLGVDYIDLYLIHWPRGKDILSKEGKKYLDSWRAFEQLYKEKKVRAIGVSNFHIHHLEDVLAMCTVTPMVNQVELHPLNNQADLRAFCDAKQIKVEAWSPLGQGKLLSNPILSAIGAKYNKTAAQVILRWNIQKNLITIPKSVHRERIEENADIFDFELGAEDVMSIDALNTNSRYGPDPDEAQF

SEQ ID NO: 15618 - protein, 440 aa, Oryza sativa (japonica cultivar-group)
MWPAAAASLHVLVLPPLPPPGCRTRRAAPVLARRGRGVRHAARRDTPPNPVDAVDCVGTGADVECYVDDRPGAEVGPIRREATPPPSPQDAVDCVGTGTDVECFVDGPGAGAGVGAEPLLARVSEEEEDGVSASAAALVGREWWEWASLVSPFFFWGTAMVAMKGVIPKTGPFFVAALRLLPAGALLVAFAAARGRRQPSGWAAWVAVAAFGLVDAACFQGFLAEGLQKTSAGLGSVIIDSQPLTVAVLAALLFGESIGAIGVGGLVLGVVGLLLLEVPALSVEGNDTAIWGSGEWWMFLSAQSMAVGTIMVRWVSKYSDPIMATGWHMIIGGLPLLVISVLNHDPALNGHLQELTLNDVLALLYTSIFGSAISYGVYFYNATRGSLTTLSSLTFLTPMFASIFGFLYLGETFSPVQLGGALLTLVAIYMVNYKSIVGEK

SEQ ID NO: 15619 - protein, 119 aa, Homo sapiens
FGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 15620 - protein, 334 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLSPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMK

SEQ ID NO: 15621 - protein, 318 aa, Zea mays
MQTPLCANAPAEKGGKNFMIDFMMGGVSAAVSKTAAAPIERVKLLIQNQDEMIKSGRLSEPYKGIVDCFKRTIKDEGFSSLWRGYTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 15622 - protein, 350 aa, Ixodes scapularis
MRGQTTRLRLPACVWCALLCSYAVRQANSKPLQRVPVDERDAEGDANGSETKEPNGAGPLFITKVAKEKGSEVARNLSKVTLPSGFPVFEAYSGYITVDETYDSNMFFFLVKAKPDASNKPLTIWMEGGPGFSGLLGMFTKNGPVGITKDGVICARLDALTTHTDVVYLDAPVGGGFSFTKNMTHGFSKDLTGTSKDVSEFLKQFLNVFSEYKTRDLYVGGESYGGRLAVGFSNYISKNKHQESSDAATRLNLKGVIAGSPFLGPLLETIDSSEFLFSVGMLDTTSKVVFHQAFEKLKTETNRTIQLVSFFEDSVSGLHQTKSNAFSKVNGLQYSFKCPSHQDTTGVCRI

SEQ ID NO: 15623 - protein, 472 aa, Mus musculus
MATKCTKCGPGYSTPLEAMKGPREEIVYLPCIYRNTGTEAPDYLATVDVDPKSPQYSQVIHRLPMPYLKDELHHSGWNTCSSCFGDSTKSRNKLILPGLISSRIYVVDVGSEPRAPKLHKVIEASEIQAKCNVSSLHTSHCLASGEVMVSTLGDLQGNGKGSFVLLDGETFEVKGTWEKPGDAAPMGYDFWYQPRHNVMVSTEWAAPNVFKDGFNPAHVEAGLYGSRIFVWDWQRHEIIQTLQMTDGLIPLEIRFLHDPSATQGFVGCALSSNIQRFYKNAEGTWSVEKVIQVPSKKVKGWMLPEMPGLITDILLSLDDRFLYFSNWLHGDIRQYDISNPQKPRLAGQIFLGGSIVRGGSVQVLEDQELTCQPEPLVVKGKRIPGGPQMIQLSLDGKRLYATTSLYSAWDKQFYPDLIREGSMMLQIDVDTVNGGLKLNPNFLVDFGKEPLGPALAHELRYPGGDCSSDIWI

SEQ ID NO: 15624 - protein, 242 aa, Oryza sativa (japonica cultivar-group)
MRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 15625 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSETAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 15626 - protein, 387 aa, Zea mays
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVIRKTLKSDGIAGLYRGFNISCVGIIVYRGLYFGLYDSIKPVVLTGSLQDNFFASFALGWLITNGAGLASYPIDTVRRRMMMTSGEGVKYKSSLDAFQQILKKEGPKSLFKGAGANILRAIAGAGVLSGYDQLQILFFGKKYGSGGA

SEQ ID NO: 15627 - protein, 773 aa, endosymbiont of Riftia pachyptila
MKLRTQLLLFLFLYGFIPLIAMVAINLPFVLDRMELFYHKAHLQNLRADFKDLDEHLASRHVILRLLAKLPEPGTILERQPEKSSSEIDAARLRYTGWINETLRDQLDIVQILFIDNQGRPRFWLERDSRDQQWKPTIKKPELPSKALFQASIRREFGFVGVSQIRLNQRTNDPRRLMTLTLISPVFERAKPGGPIGAVAISIDVGGMAQAYRDTLWVTNNGAYLEERLKGDTRPLAFADFQGLEEIFRQGSLALWKGDKQQVIWVPLFMTEESGPLWVGRSVDPSPLAEFRTSLSLRVILIVLVALIIVLLSSRWIAQQIAHFSETLADGIGRVLKSDQPVAFHWRGPREIEELGEKLTALAETHAHHTQAQREHARQLEESNRYKSEFLANVSHELRTPLNSILLLSKMLREEGDNLGEQQCKQLKVIHEAGSDLKALIDNILDLSRIEAGQAGLVLDQIDIRRMVEELLELVQPQFEAKGLYLKAEFDPQLPDGFLSDQEKVRQILKNFLSNSIKFTAEGGAILHVYRDLDSACCPLCFALQDSGIGIPQEKHELIFEAFKQADGSTNRRFGGTGLGLSISRQLAQLLGGEIRLQSQEQQGARFTLCLPLQPPADAAIEPPPEQPSLLTVSRPRSQPEEPPVDAFTGVRLLLVDNNLNNLLALTPLLEGWGLEVTAAGDGDEVLETLNEESDFAITLVDTMMLGMDGYDTIRRIREEARFSAMAIIALTADTTAEDRERCLEVGADDFISKPIEMEELKTVIERTCPHDH

SEQ ID NO: 15628 - protein, 339 aa, Zea mays
LNPTAILQSTIGGAPPSTAAAAAENGDTTRKVVPLSKDALQDFMVSIITQKLQGEKKPFYVLDLGEVVSLMDQWNVALPNVRPFYAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHNGSGDADSNAYLGAIAAAKQVFETAAKFGMSKINVLDIGGGFTSGHQFTTAATAVKSALQQHFSNEPELTIIAEPGRFFAETAFTLATTIIGKRVRGDLREYWINDGLYGSMNCVLYDNATS

SEQ ID NO: 15629 - protein, 491 aa, Pseudomonas mendocina
MDTTRPAYQNLELQPLAGQWRAGSSGRPLEVFDPYNDELLLRIALASREDLDAAYRKARDSQREWATTAPAERARVLLEAVKIFDERREEIIDWIIRESGSTRIKAQIEWGAARAITLESASLPNRVHGRIIASNISGKESRVYRAPLGVIGVISPWNFPLHLTARSLAPALALGNAVVVKPASDTPITGGLLLARIFEEAGLPAGVLSVVVGSGAEIGDAFVEHPVPALISFTGSTQVGRNIGRIASGGEHLKHVALELGGNSPFVVLADADVEQAVNAAVVGKFLHQGQICMAINRIIVEQPLLEDFTRRFVERVKALPYGDPSKPGTVVGPVINARQLAGLKEKIATAKAEGATLLLGGEPQGNVMPPHVFGNVTADMEIAREEIFGPLVGIQSARDAEHALELANSSEYGLSSAVFTASLERGVQFARRIHAGMTHVNDIPVNDEPNAPFGGEKNSGLGRFNGDWAIEEFTTDHWITLQHSPRPYPF

SEQ ID NO: 15630 - protein, 664 aa, Mus musculus
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKLNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEVISLTSLSYPNLPISSEFLTNFLLMAECFCFLGNCFCCAVTTLHTNFTTKITEQKEVPPTSSALLACRYLQPFCSKIKAKYRKLQ

SEQ ID NO: 15631 - protein, 839 aa, Sorghum bicolor
MTRLLSSYLLTVIFTVFLLLLKASAAGTPSDTLSSSSNITDGETLVSSGSSFTLGFFSPAGVPAKRYLGVWFTMSPEAICWVANQETPLNNTSGVLVVDDSTGTLRLLDGSGHTAWSSSSSTTTTSSAPPPPVVLPQAQLLDSGNLVVRDQSTGDVLWQWFDHPGNTYLAGMKFGKNLRTGAEWTTTSWRASNDPAPGDYWRSLDTRGLPDTITWHGNVKMYRTGPWNGQWFSGIPEMASYLDLYSNQLVVGADEIAYSFNTTAGAPISRLLLNENGVMHRLGWDPVSLVWTSFAEAPRDVCDNYAMCGAFGLCNMNTASTMFCSCAVGFSPVNPSQWSMRETHGGCRRDVPLECGNGTTTDGFKMVRAVKLPDTDNTTVDMGVTLEQCRERCLANCACVAYAAADIRGGDHGCVMWTDAIVDVRYIDKGQDMYLRLAKSELVEKKRNVVLIILLPVTTCLLALMGMFFVWVWCRRKLRGKRRNMDIHKKMMLGHLDETNTLGDENLDLPFFSFDDIVSATNNFAEDNMLGQGGFGKVYKGILGENREVAIKRLSQGSGQGTDEFRNEVVLIAKLQHRNLVRLLGCCIHGDEKLLIYEYLPNKSLDSFIFDAARKNVLDWPTRFRIIKGISRGVLYLHQDSRLTIVHRDLKTSNILLDADMNPKISDFGMARIFGGNQQEANTNRVVGTYGYMSPEYAMDGAFSVMSDTYSLGVILLEIISGLKITSTHSTSFPSLLAYAWSLWNDGKAMDLVDSFVLESCSANEALRCIHIGLLCVQDNPNSRPLMSTVVFMLENETTLLSVPKQPMYFSQWYLEAQGTGENTNSSMNNMTVTVLEGR

SEQ ID NO: 15632 - protein, 302 aa, Sorghum bicolor
MASAAVPAATGGLKEDIAGLYDESSGVWERICGEHLHHGFYEPAGDATAVRPDVRRAQIRTIDEALAFAAVPDDLEKRPKTIVDVGCGIGGSSRYLARKYGAQCTGITLSPVQAERGNALTAAQGLSDQVSLQVADALEQPFPDGMFDLVWSMESGEHMPDKRKFVSELARVAAPGGTIIIVTCCHRNLNPSETSLKPDEQRLLKRISDAYCLADWFLPSDYVSIAKSLSLEDIRTADWSENVVPFWPAVIKLSLSWKGLTSALTCGWKTINGAMGILLLIQGYRKGLIKFTVITCRKPGPP

SEQ ID NO: 15633 - protein, 48 aa, Phanerochaete chrysosporium
IIAKEGVKSLFKGAGANILRGVAGAGVLSLYDKLQQVLFGKVYSGGSG

SEQ ID NO: 15634 - protein, 391 aa, Oryza sativa (japonica cultivar-group)
MNTTSANELMMHRHVQAAPYAAAPQQQGGKQRAPGLPPTPPPPPAAASSHSSHGDVCMDDTARGGLLPPRKAHRRSRSDVPFGYFQPLPPPSPKMEAGGGWALPGCGGAGDVDLLNAYMSLEGMGGADGLNNSDGDSRGSSMRTNGADSSENESEDYVGADSQALLWGGAGGGEAAGKKRRNNAAGEKAARHARSLSMDSLMGKLSFAANGEPAKFSLEFGSGEFTPAEMKRIMADEKLAEMALADPKRSAARSKERRMRYIAELEQKVQILQTEATTLSAQLTLLQRDSSGMATQNNELKFRLQSMEQQAQLRDALNEALTAEVQRLKLAANEVCDTSSSSNLAHQIQLRCQNQMLDLHKQQQQQVEQIPFYQLELPEQQNGTARNHESK

SEQ ID NO: 15635 - protein, 65 aa, Daucus carota
DNIQGITKPAIRRLARRGGVKRISGLIYEETRGVLKIFLENVIRDAVTYTEHARRKTVTAMDVVY

SEQ ID NO: 15636 - protein, 260 aa, Lycopersicon esculentum
MADSSREENVYLAKLAEQAERYEEMIEFMEKVAKTADVEELTVEERNLLSVAYKNVIGARRASWRIISSIEQKEESRGNEDHVNTIKEYRSKIEAELSKICDGILSLLESNLIPSASTAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 15637 - protein, 232 aa, Ophioglossum pedunculosum
RRGLLKKAEELAVLCDAEVGVVILSNTGKVFEYPIGRTKAILERYIKHVQEKRKSSSSEHGDGSFQEMESLKQEILHLEATQKHFGGGELSSLTLQDVHQLELQVEMGLSNVRSRKVQLLLEQTEHLKRKEHCLHEESRTLQEKISEVCGYIQSNARTTNTGQTQAFRDNDPQVSQVLFSLQPSRSDIQDSANIRTSLRLGMYETSPQMNERSTAESSDVNSVLYTPQDWMH

SEQ ID NO: 15638 - protein, 186 aa, Ophioglossum pedunculosum
RGGLMKKAFELSVLCDVEIAVIIFSSTGKLYEYASSCMQKILSKYTSRPEGLQSLRVLNDDQAYYYCYQMAWLRQQITQLERLQRQMTGEDLTSLNMEELNDLEHSIYLALLRVQARKERLLMEKLQNGGLKAAQQLHEDECGGGSREVREEEAMPAQPSSVKRVLEKSTYSEASLELRLRLLSES

SEQ ID NO: 15639 - protein, 217 aa, Ophioglossum pedunculosum
RSGLLKKAYELSVLCDAEVALIIFSGTGKLFEFASSSMKKILERYRKYGGGLHDNSIATRDAEYWRNEVMRMKEHIACLEESQRHLLGENLVSLSVKNLQKLEHQLEIGANRIRTRKTQILLEQIQELQKKEHFLHGENNILKTKLEQLSTRQVPSLGTLIYTSTVTTTSTTSAGAGVEDNAGGHDSMNAMQKMTLHSNFQPATSAQNTLQLGYYPD

SEQ ID NO: 15640 - protein, 429 aa, Glycine max
PKGQNEPFHYDGEFNLLFSDLWHTSSHEQEVGLSTKPLKWIGEPQTLLINGRGQFNCSLASKFINTTLPECQFKGGEECAPQILHVEPNKTYRIRIASTTSLAALNLAISNHKLVVVEADGNYVTPFAVDDVDIYSGESYSVLLRTDQDPNKNYWLSIGVRGRKPSTSQGLTILNYKTISASIFPTSSPPITPLWNDFEHSKAFTKKIIAKMGTPQPPKLYDRRVFLLNTQNRVDGFTKWSINNVSLTLPPTPYLGSIKFKINNAFDQTPPPMNFPQDYDIFNPPVNPNATIGNGVYMFNLNEVVDVILQNSNQLSVNGSEIHPWHLHGHDFWVLGYGEGKFKLGDEKKFNLTHAPLRNTAVIFPYGWTALRFKADNPGVWAFHCHIEPHLHMGMGVIFAEGVHKVGKIPREALTCGLTGKKLVENGHY

SEQ ID NO: 15641 - protein, 559 aa, Melanocarpus albomyces
EPTCNTPSNRACWSDGFDINTDYEVSTPDTGVTQSYVFNLTEVDNWMGPDGVVKEKVMLINGNIMGPNIVANWGDTVEVTVINNLVTNGTSIHWHGIHQKDTNLHDGANGVTECPIPPKGGQRTYRWRARQYGTSWYHSHFSAQYGNGVVGTIQINGPASLPYDIDLGVFPITDYYYRAADDLVHFTQNNAPPFSDNVLINGTAVNPNTGEGQYANVTLTPGKRHRLRILNTSTENHFQVSLVNHTMTVIAADMVPVNAMTVDSLFLAVGQRYDVVIDASRAPDNYWFNVTFGGQAACGGSLNPHPAAIFHYAGAPGGLPTDEGTPPVDHQCLDTLDVRPVVPRSVPVNSFVKRPDNTLPVALDLTGTPLFVWKVNGSDINVDWGKPIIDYILTGNTSYPVSDNIVQVDAVDQWTYWLIENDPEGPFSLPHPMHLHGHDFLVLGRSPDVPAASQQRFVFDPAVDLARLNGDNPPRRDTTMLPAGGWLLLAFRTDNPGAWLFHCHIAWHVSGGLSVDFLERPADLRQRISQEDEDDFNRVCDEWRAYWPTNPYPKIDSGL

SEQ ID NO: 15642 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 15643 - protein, 100 aa, Leishmania infantum
MAKGKRSTDAKGSQRRQKKVLRDNIRGITRGCVRRMARRGGVKRISTEVYEEVRRVLKAYVEDIVRCSTAYTEYARKKTVTACDVVTALRKQGHILYGYA

SEQ ID NO: 15644 - protein, 100 aa, Leishmania infantum
MAKGKRSTDAKGSQRRQKKVLRDNIRGITRGCVRRMARRGGVKRISTEVYEEVRRVLKAYVEDIVRCSTAYTEYARKKTVTASDVVTALRKQGHILYGYA

SEQ ID NO: 15645 - protein, 135 aa, Trypanosoma cruzi
MATPKQAAKKASKKHGGGRSAKAGLIFPVGRVGSLLRRGQYARRIGASGAVYMAAVLEYLTAELLELSVKAASQQAKKPKRLTPRTVTLAVRHDDDLGMLLKNVTLSRGGVIPSLNKAVAKKHKSSKKARATPSA

SEQ ID NO: 15646 - protein, 213 aa, Petroselinum crispum
MIQTQKVDNRRMGNHKQKWTAEEEEALKAGVKKHGMGKWKTILVDPDFATALTHRSNIDLKDKWRNLGISSSAAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKL

SEQ ID NO: 15647 - protein, 304 aa, Micromonospora echinospora
MDVPGAPTAGPLVLDGGLGTELQRHGRSVSAPWWTARCLLDAGGRRLVSRVHAAYVAAGADVLTADTFRTTLRTAYRAGTDEATAAGLVRTAVTLARRAADSTGAGRRVLVAASVAPVEDCYRPDLVPGAAVLRREHGWLADQLARAGVDLALVETMNTVREAVVATRAVREHGLPAWVSFVCTGDARLLSGEDLAAAADAVRAAGAAAVLVNCTDPAGTERALRRLRAAGPGLLGAYPNVEDRSGVPPATPVDRYLPPGLTPDAFADLWAAWRPVGLRIVGGCCGTTPAHIAALRSRLAPRPG

SEQ ID NO: 15648 - protein, 297 aa, Micromonospora echinospora
MDQRHLLMHQAMLGDRRRIEAYDRALAGAVDEDTVVADVGAGTLALTALALRHGAAHVYAVEADPQVAAVADRIIKANDWDDRVTLVVGDARLARLPRQVDVTVCELMGNLGPEEDMARILRTFNRRNLRPGGVVVPERVVTRLAAVQFDDEGWGIWSDDFLGMRLDVVQELVEPSAHLHFLSREPVLLGEPAVLVDTARGDTGLRAARPLALPLERDGTLHAVLGYFTATLAPGIELSNMPSYLGCNWAVFVWPLRHTRVAAGDTVHVRPRRPEGPAARDVTRWRLDCHLDRADKR

SEQ ID NO: 15649 - protein, 578 aa, Aplysia californica
EFRCCRCKKTCWSSECLAGMRCEWCGVSAHATCYRSLPVECKFGSLREILLPSSCLTIPRLDVPMETILGISRKSTFPARTVSEEWSSSGDSKTEDEERERRSPREKDGRDKDKEDCEIIRVFDGNASLKKRLYRTISVPRNATVQAILEAALKTFHISDDPKNYFVTEASESSLAGERELEESMPVRSQLKTPDGKRPSIFLRYKEQKDSGCIKVYPGGLRVSCGYKNILVNKDTTTEEVILTSLRKFGVEDKDPESFELIEVLLDKGVTERKVERTAKPFQIMVHSRRESLRQNRMTRFYLQQKEDPHGPSISLYVGNLPTGLSQRQYEKILVDIIGKENKWERFDGIYYEYGSLVLIYTIPEIATTVFNILQESTFDDKQILALLLPNIQPHMIPDYVKPLMVFVNVKSGGCQGLDLITSFRKLLNPHQVFNLENGGPLPGLYVFRNIPYYKILVCGGDGTVGWVLSCLDNVGQDAECQSPPMAIVPLGTGNDLARVLRWGPGYTGGEDPLNVLRDVIDAEEIKLDRWTVIFHPNEKEQDETKMAIANDTNSANTTEDPTSIFVMNNYFATATEF

SEQ ID NO: 15650 - protein, 357 aa, Methanopyrus kandleri
MAVKAKGQPPSGYEPKVAEWKRREVKELKELMDEYENVGLVDLEGIPAPQLQEIRAKLRERDTIIRMSRNTLMRIALEEKLDERPELEPLLDYIEGPVAFIFTNLDPFKLYKLLEESKASAPAKPGDIAPEDIVVPEGPTPFEPGPIVSELQQAGLPAQIQDGKVVITKDTVLVKEGEEIDEKTAEILKKLEIEPMEVGVDIVAIVAEGTLFERDDLAIDFDEYEDMAKEAAQHAFNLSINAAIPTAETADVIVAKAHTEALNLAVNAGVPVPDETVMGCILAKAHGEMLALAGAIAEVDEEALDEELLEMVSRSAEAAERKEKEEEEEEEAEEEEAEEEEEEEEEEAAAGLGALFG

SEQ ID NO: 15651 - protein, 263 aa, Staphylococcus xylosus
MFTDLEGKVVVITGGSSGIGKAMVEQFGKEKAKVVINYLSESSLDDVAESIKLIEDAGGQAIKVHADVSKEEDVNNLIKAAVDTFGTLDILINNAGFEKPIPTHEMPLEEWQKVIDINLTGAFIGSKAAVNQFLKEDKKGIILNTSSVHDRIPWPNYVNYAASKGGLKLMMETMSMEYAQHGIRINNISPGAIVTEHTREKFSDPETRAETLEMIPAKEIGEADQVANVARFLCSDLADYIHGTTIYVDGGMTNYPAFMGGKG

SEQ ID NO: 15652 - protein, 323 aa, Sporidiobolus salmonicolor
MVGTTTLNTGASLELVGYGTWQAAPGEVGQGVKVAIETGYRHLDLAKVYSNQPEVGAAIKEAGVKREDLFITSKLWNNSHRPEQVEPALDDTLKELGLEYLDLYLIHWPVAFPPEGDITQNLFPKANDKEVKLDLEVSLVDTWKAMVKLLDTGKVKAIGVSNFDAKMVDAIIEATGVTPSVNQIERHPLLLQPELIAHHKAKNIHITAYSPLGNNTVGAPLLVQHPEIKRIAEKNGCTPAQVLIAWAIVGGHSVIPKSVTPSRIGENFKQVSLSQEDVDAVSKLGEGSGRRRYNIPCTYSPKWDINVFGEEDEKSCKNAVKIK

SEQ ID NO: 15653 - protein, 156 aa, Nicotiana glutinosa
MAEVEYRCFVGGLAWATTDQTLGDAFSQYGEILDSKIINDRETGRSRGFGFVTFKDEQAMRDAIEGMNGQDLDGRNITVNEAQSRGSGGGGGGYRGGRGGGGGGYGGGGRREGGYGGGGGGYGGGRREGGYGGGGGYGGGRREGGYGGGSEGNWRN

SEQ ID NO: 15654 - protein, 1868 aa, Caenorhabditis elegans
MNWDTLKGVLKTRRLTKRTIPAYIHPTSRSDSTSSTQSATAGFILNEEPITLFRLELERLQYILHFPEEVAFQLSSTEYQLFYSIQPMDYVRYVSCDLTSVPVSENPSPVRNLVKRLSEVSSWITHVIVSQPTHDDRKVALTAILRIVETCWNIGNFNAAVEVLMGLKSEKLRPFWLSLRQEEKSQFDSLCETLLPANQALPSQAYINAVQRALRMPQSRVIPFFGIFLRDLYAIVNDLPNIVVIGQEGETQKLEFMSDPNGEDHFSSRIGVGGLLNADKINLVAIVLDNLELFHRHSRTMIKLLEEQAVPPIQIPQNEREQKEKEAKTYEPVQVVRGSSHGVALIPLDTLTFDLDVIQRLQHGTTVIHYEPDSGRSNLCLLRLDPSCGQINWHKISYSVNKDPKEKDVLAKVSVSNLQPLDSGRGAPSPMPSGRTPGTGGVGVEEGELKLSVVKGVELVDSYDIDIEAIYRRHSMEEMSVPVSCWKVSHGQLLSDNEFIYFLAPQQIAQFWTNGLQSVVKSLQGQQRYPDRRMLWIKNVYLSLYEITGESNCGPRPFEALQAFGLSQTNTNATRPNDSSLSSEPGGAKSRLKNLKNAMQKKLRGASREGSRSQSPQPHSPLVRPPSIKSQISSQSGPPGPNSPGYLLKPRGEPANSDAGDIDSIYTPRSRTPTSSSYGGRSVGGRSCKSWRSRGGETPNSGSISSSGQMSIQVSGLSGPSGKEFQEKPLTLVEFAELFRLFNTRMRKDLRDVFNDVLSTATTPQHCPKRERDRHSPRMQSRLASVSNSYNADFLSNDFLTRNTAVTSHHISEKQNKIYNALALASVNSMGGLMDTSRSSMLTPQMLRAFVNTHQMEQIDEQTAIKLIQDHEPDGICRQKNQMSFEGFTRFLCDPVNFAFVPETIEPDEEDLRYPLSHYYINSSHNTYLTGHQLKGPSSSEMYRQVLLTGCRCVELDCWDGDDGLPLIYHGHTLVSKIGFRQVVEIIKKSAFITSDLPVILSIENHCSLQQQAKMAQMFKTVLGDLLVSNFLFEADFSDSPRLPCPLQMKNKILIKNKKMIVDPPTPLPMIERGAVQRGETQLNLHRKQSKNSYESSTVDEVEDDDLDEFLDDEENEEDDQEEVQVRSEKEDSPKTSKRAEKSARNIKQQDSLCSDHSVEQAKPSTSKTTSKTNDRKTEDEVLYAQLAQNAIRNQQPRKNNTGVQIAPELSDIVIYMQATKFKGFPPVDGIQSPRIMEEGPASASLSFSSRARTPSNLLNTPAPPRRQRSSTQLSQELAAEFLGSVRANATATCYQVTSLNENAAKKLMKRHPAKCVSYTRDHLIRTYPSAKHYDSSNFNPINCWAHGMQMVALNFQTPDVIMAVNQAMFEQSGNCGYQLKPRCLWDESHLLYNKFLPLSKDIAGHSALLLNLTIISGQHVYPNTHYASLYVEIEVIGIHNDCVREKSKVVQRNSVNPIWNHTTQLRIACVDLAFLRIAVCDSGQNGRVVAHRVVPVKCIRPGFRHLPLRTPTNLPIDNAMIFLRTRFEQEEHIYLHDDDSNTYCNLEHTLAYRTDLTPNLSPTPILKKQIFVLRITGAFADETAITVHSESGSTVKTVMQQALLNAGKNADQVEEYVLIEESLPAPSGEDPIEQRVLPLNEPIMDAVACWNGSMRRFVLRKKGSDPSSRAWITSIIKSGTSGSSTSVSPSPLTKDGHVKSASSNQLHGRSLDTDAFGEHLEVTEGLNPRARSMGDTFLVCVHNVSEDQPYAILRAGIHSTAADIIRQVFVKARRSNVDDSEFVLVEETCDDPKLNQGQMTPKYPNNRTTSRVLGQNENVWKAQSRWKSMGRFVLENRKDTVHATLEKVRSFISKLEAAKASMDPRHE

SEQ ID NO: 15655 - protein, 1895 aa, Caenorhabditis elegans
MNWDTLKGVLKTRRLTKRTIPAYIHPTSRSDSTSSTQSATAGFILNEEPITLFRLELERLQYILHFPEEVAFQLSSTEYQLFYSIQPMDYVRYVSCDLTSVPVSENPSPVRNLVKRLSEVSSWITHVIVSQPTHDDRKVALTAILRIVETCWNIGNFNAAVEVLMGLKSEKLRPFWLSLRQEEKSQFDSLCETLLPANQALPSQAYINAVQRALRMPQSRVIPFFGIFLRDLYAIVNDLPNIVVIGQEGETQKLEFMSDPNGEDHFSSRIGVGGLLNADKINLVAIVLDNLELFHRHSRTMIKLLEEQAVPPIQIPQNEREQKEKEAKTYEPVQVVRGSSHGVALIPLDTLTFDLDVIQRLQHGTTVIHYEPDSGRSNLCLLRLDPSCGQINWHKISYSVNKDPKEKDVLAKVSVSNLQPLDSGRGAPSPMPSGRTPGTGGVGVEEGELKLSVVKGVELVDSYDIDIEAIYRRHSMEEMSVPVSCWKVSHGQLLSDNEFIYFLAPQQIAQFWTNGLQSVVKSLQGQQRYPDRRMLWIKNVYLSLYEITGESNCGPRPFEALQAFGLSQTNTNATRPNDSSLSSEPGGAKSRLKNLKNAMQKKLRGASREGSRSQSPQPHSPLVRPPSIKSQISSQSGPPGPNSPGYLLKPRGEPANSDAGDIDSIYTPRSRTPTSSSYGGRSVGGRSCKSWRSRGGETPNSGSISSSGQMSIQVSGLSGPSGKEFQEKPLTLVEFAELFRLFNTRMRKDLRDVFNDVLSTATTPQHCPKRERDRHSPRMQSRLASVSNSYNADFLSNDFLTRNTAVTSHHISEKQNKIYNALALASVNSMGGLMDTSRSSMLTPQMLRAFVNTHQMEQIDEQTAIKLIQDHEPDGICRQKNQMSFEGFTRFLCDPVNFAFVPETIEPDEEDLRYPLSHYYINSSHNTYLTGHQLKGPSSSEMYRQVLLTGCRCVELDCWDGDDGLPLIYHGHTLVSKIGFRQVVEIIKKSAFITSDLPVILSIENHCSLQQQAKMAQMFKTVLGDLLVSNFLFEADFSDSPRLPCPLQMKNKILIKNKKMIVDPPTPLPMIERGAVQRGETQLNLHRKQSKNSYESSTVDEVEDDDLDEFLDDEENEEDDQEEVQVRSEKEDSPKTSKRAEKSARNIKQQDSLCSDHSVEQAKPSTSKTTSKTNDRKTEDEVLYAQLAQNAIRNQQPRKNNTGVQIAPELSDIVIYMQATKFKGFPPVDGIQSPRIMEEGPASASLSFSSRARTPSNLLNTPAPPRRQRSSTQLSQELAAEFLGSVRANATATCYQVTSLNENAAKKLMKRHPAKCVSYTRDHLIRTYPSAKHYDSSNFNPINCWAHGMQMVALNFQTPDVIMAVNQAMFEQSGNCGYQLKPRCLWDESHLLYNKFLPLSKDIAGHSALLLNLTIISGQHVYPNTHYASLYVEIEVIGIHNDCVREKSKVVQRNSVNPIWNHTTQLRIACVDLAFLRIAVCDSGQNGRVVAHRVVPVKCIRPGFRHLPLRTPTNLPIDNAMIFLRTRFEQEEHIYLHDDDSNTYCNLEHTLAYRTDLTPNLSPTPILKKQIFVLRITGAFADETAITVHSESGSTVKTVMQQALLNAGKNADQVEEYVLIEESLPAPSGEDPIEQRVLPLNEPIMDAVACWNGSMRRFVLRKKGSDPSSRAWITSIIKSGTSGSSTSVSPSPLTKDGHVKSASSNQLHGRSLDTDAFGEHLEVTEGKWLNPRARSMGDTFLVCVHNVSEDQPYAILRAGIHSTAADIIRQVFVKARRSNVDDSEFVLVEETCDDPKLNQGQMTPKYPNNRTTSRVLGQNENVWKAQSRWKSMGRFVLENRKDTVHATLEKGRRVESTTSSSTTTRKISLSSVRSIGLPRKFSKFGKSLTMDAGPK

SEQ ID NO: 15656 - protein, 294 aa, Daucus carota
MDQYEKVEKIGEGTYGVVYKARDRVTNETIALKKIRLEQEDEGVPSTAIREISLLKEMQHENIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQQPLFPGDSEIDELFKIFRIVGTPNEDTWPGVTALPDFKSAFPKWPSKELGNVVPNLDVAGLNLLKKMLCLDPSRRITARSALEHEYFKDIGIVP

SEQ ID NO: 15657 - protein, 253 aa, Vitis labrusca x Vitis vinifera
MVRAPCCDKVGLKKGPWTTQEDQNLTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTPAASACDSDSFNSSGKMSPQPSSSEFSSFTDSSTRTMETHSTGVKNEQMEEYSPESFPEIDESFWSDALSSDNSSMASDFPAVADELQLQTPELACGQISNMMDDGMEFWYDVFIRAGGLQEL

SEQ ID NO: 15658 - protein, 253 aa, Vitis labrusca x Vitis vinifera
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLTKKLATPDSKGHFTAAASTCDSDSFNSSGKMSPQPSSSEFSSFTDSSTRTMETHSTGVKNEQMEEYSPESFPEIDESFWSDALSSDNSSMASDFPAVADELQLQTPELAYGQISNMMDDGMEFWYDVFIRAGGLQEL

SEQ ID NO: 15659 - protein, 355 aa, Vitis labrusca x Vitis vinifera
MVTSVAPRVESLSSSGIQSIPKEYIRPQEELTSIGNVFEEEKKDEGPQVPTIDLKDIESEDEVVRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPETVSETEPPLFPPRTFSQHIQHKLFRKTQEALLSK

SEQ ID NO: 15660 - protein, 369 aa, Anabaena azollae
MQVKAAVAYSVVQPLTIETVELEGPQAGEVLVEIKASGVCHTDAYTVSGADPEGLFPAILGHEGAGVVVEVGADVKSVKPGDHVIPLYTPECRQCEYCLSFKTNLCQAIRVTQGRGLMPNATSRFSIVGKMIHHYMGTSTFANYTVLPEKAVAKIREDAPFDKVCYIGCGVTTGIGAVIYTAKVEAGANVVISGLGGIGLNIIQAAKMVGANMIVGVDINPKKRALAEKLGMTHFVNPHEIEGDLVSYLIDLTKGGADYPFECIGNINVMRQALECCHKGWGVSVIIGVAGAGQEISTRPFQLVTGRVWKGSAFGGARGRTDVPKIVDLYMNGQINIDDLITHVMPIEQINHAFDLMYRGESIRSVVTF

SEQ ID NO: 15661 - protein, 566 aa, Kluyveromyces lactis
MSSNLSEKAVDQQKEFGLLKSTSSVDSVHEVEAGVKVGEDDDNYFFSEDQILTQIKVYEDEIANTPVTKTLRQRMRRMEFCEVNFSNKTYMVIMLGFFASFAGILSGVDQSTISGASYGMKASLKLTSDEDSLISSLMPLGAVGGSILLTPLSEYFGRKVALVISCIFYTIGGILCAAAQDVHTMYAGRFLIGVGVGIEGGGVGVYIAESVPSTVRGSLVSLYQFNIALGELVGYVIGVIFFDVKGGWRYMLGSSLVFSTILFVGLFFLPESPRWLIHKGYDVEAYKVWRRLRDTSDLGNKREFLEMKHAAEQDRQLKEQESRFKSMFDLILIPRNRRALLYSIMMVSLGQLTGINAIMYYMSTLMGQIGFSPKQAVAMSMVGGAALLIGTIPAILYMDKFGRRPWSMTIIGFSVGLVLVGVGYQIDLNTNLAAAEGVYLTGQILYNIFFGTYATLTWVVPSESFSLATRSIGMTICSAFLYLWAFTVTYNFNKMKDAFTYTGLTLGFYGGIAIVIGIPYQLLFMPETKDKTLEEIDDIFEMPTRQLVKQNLKNLKDYVSGNRKSI

SEQ ID NO: 15662 - protein, 250 aa, uncultured Bacillus sp.
MTVKKLYFVPAGRCMLDHSSVNSTLTRGELLDLPVWCYLLETEEGPILVDTGMPESAVNNEGLFNGTFVEGHILPKMTEEDRIVNILKRVGYEPEDLLYIISSHLHFDHAGGNGAFTNTPIIVQRAEYEAAQHSEEYMKECILPNLKYKIIEGDYEVVPGVQLLYTPGHTPGHQSLLIETEKSGPVLLTIDASYTKENFEDEVPFAGFDSELALSSIKRLKEVVRKENPIVFFGHDIEQEKSCKVFPEYI

SEQ ID NO: 15663 - protein, 309 aa, Oryza sativa (japonica cultivar-group)
MEIRSRRDRSKIKMFRALQIVLRGKSRGFVSHFSSTASNSERLAGKVAVITGAASGIGKATAAEFVRNGAKVILADVQDDVGRAVASELGADAASYTRCDVTDEAQVAAAVDLAVARHGQLDVMVNNAGIVGSLSRPPLGALDLADFDAVMAVNTRGVLAGVKHAARVMAPRRRGSIICVASVAGVLGSVTPHPYSVSKAAVLGAVRAAAGEMARSGVRVNAISPNYIPTPLVMRIMAEWYPGASADEHRRVVEREINEMEGATLEPEDIARAAVYLASDEAKYVNGHNLVVDGGYTVGKAPNLPAPPQ

SEQ ID NO: 15664 - protein, 356 aa, Oryza sativa (japonica cultivar-group)
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 15665 - protein, 390 aa, Oryza sativa (japonica cultivar-group)
MEQMNTAAAKSIRCRAAVSRVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 15666 - protein, 251 aa, Carica papaya
IAVKCNPEPSFLSMLAAMGSNFDCASRAEIEYVLSLGISPERIVFANPCKPESDIIFAEKVGVNLTTYDSEDEVYENKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYD

SEQ ID NO: 15667 - protein, 251 aa, Daucus carota
IAVKCNPEPSFLSMLAAMGSNFDCASRAEIEYVLSLGISPGRIVFANPCKPESDIIFAEKVGVNLTTYDSEDEVYKIKKHHPKCELLLRIKPMNDGNARCPMGPKYGALPEEVEPLLRIAQASRLTVSGVSFHIGSGDADSNAYLGAIAAAKQVFETADKFGMSKMNVLDIGGGFTSGHQFTTAATAVRSALQQHFSNEPELTIIAEPGRFFAETAFTLATTIIGKRVRGDLREYWINDGLYGSMNCVLYD

SEQ ID NO: 15668 - protein, 251 aa, Phaseolus vulgaris
IAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETADKFGMSKMNVLDIGGGFTSGHQFTTAATAVKSALQQHFSNEPELTIIAEPGRFFAETAFTLATTIIGKRVRGDLREYWINDGLYGSMNCVLYD

SEQ ID NO: 15669 - protein, 164 aa, Thermosynechococcus elongatus BP-1
MPEILPLSETDPHDFWMQQAIALAEQAGAADEVPVGAVIVSAENELIATGENRRQRDHDPTAHAEIIALRRAGQRLGTWYLTGCRLYVTLEPCPMCAGAIVQARIHTLIYGTTDPKSGAIDSVLQLPQSPAVFHRIQVIRGVQAVACRQQLQRWFRQHRQKERQ

SEQ ID NO: 15670 - protein, 462 aa, Thermosynechococcus elongatus BP-1
MVIASVNPTTAEVLKTFSPLGAEEVDRAIAQAATTFETYRLTSFEQRAQWLENTANLLQQQRETLARLMTLEMGKPIAEARAEIDKCAWVCRYYAEQGAAFLEPEFIPTEASYSAIHYQPLGIILAVMPWNFPFWQVFRFAAPALMAGNVALLKHASNVPQCALAIAQIFRQAGFPEGVFQTLLIPGSAVADLVADPRIKAATLTGSEAAGTSLAQAAGQHLKKTVLELGGSDPFIVMPSANISQAIATAVQARMINNGQSCIAAKRFIVHEAVYDTFAEGIKAAFESWVIGDPLEPTTQLGPLATAAIRDELHAQVELALGHGAKAFYRRSLDLPTQCRQGYFFGPTILTEVTPNNPVFTQELFGPVAMLFRVSSLTAAIELANATPFGLGASAWTQDSDEAEILVRDLEAGAVFINAMVKSDPRLPFGGIKTSGYGRELGRAGLLEFVNIKTVCRANTHS

SEQ ID NO: 15671 - protein, 315 aa, Thermosynechococcus elongatus BP-1
MDTSKDLVRTYLREIGRVPLLTHEQEVIYGKQVQQLAAMNEIREKLAAELNREPTRAEWAAAANISEGELETIIENGERAKRKMVEANLRLVVSVAKKYIKRNVDLLDLIQEGTIGMQRGVEKFDPTKGYRFSTYAYWWIRQAITRAIAEKGRTIRLPIHITEKLNKIKKAQRQLSQRLGRAATINELAAELELTPAQVREYLERARQPLSLDVRVGDNQDTELGELLEDSSISPEEFATQSLLRSDLERLMAELTPQQRHVLSLRFGLENGQPLTLAKVGELLNISRERVRQIEREALSKLRKRRGDIHEYLAS

SEQ ID NO: 15672 - protein, 980 aa, Thermosynechococcus elongatus BP-1
MTGLYEAETIAIARQLWAASQESRNFFSQLREQMRIEDKLLGWAMEHPGLRVQLFRLIDCLPSLRSQTEVARHLQEYLSDPSVELPPGLKKLLNFAQPDSLPAQAAATTFTTAVQALAHKYIAGETTEQVLKTIGRLRKQGMLVTMDILGEAVITEAEAQQYCDRYLDLMEHLSPLGQREGVNPVQVSVKLTAFYSQFDPLDVSGCRAKVGEPIRRLLHRAQELGVAVHFDMEQYAYKDITLAILKDILLEPEFRDRADIGLTLQAYLRDSYQDAQDLITWVQQRGTPITVRVVKGAYWDQELIKAVQHHWPLPVYQHKQNTDANFERIIELLLSHHTVLRTAIASHNVRSQARAIAIAQRQHIPPTAMECQVLYGMADKLAKALVEAGQTVRVYCPYGDLIPGMAYLIRRLLENTANSSFLRQQLGAVAIEELLAPPEPTADFEAVNVHLTTGKTSTFVNAANSDYARASQREAIQAALIHVHRQLGQTYTPIINGDRVNPREYSESLNPSQPEEIVGRVGLATIEDAEHAIRAAKAAQAQWQQTSVAERATLLRRAADLLEAQRHELVAWMCYEVGKVVAEGDAEVSEAVDFCRYYADEMERLSSGYDRNFPGETNHYHYQGRGLAVVISPWNFPLAIPTGMTAAALVTGNCTILKPADPAAVVAAKLAEILMAAGFPPGVFQFLPGRGSVIGPYLTQHPDVHLIAFTGSQEVGCRIIAEAAVLQRGQSHIKRVIAEMGGKNAIIIDESADLDQAVAGVVQSAFGYSGQKCSACSRVIVLESIYKPFVERLVAATQSLNIGPAHLPSTRVGPVVTAAARDRIQEYIAKGQQEAELLLSVPVPEMGYFVSPTIFTNVPPTATIAQEEIFGPVLAVLRAETFTQALAIANATAYALTGGLYSRTPSHIQQAKAQFAVGNLYINRGITGAIVDRQPFGGFKLSGIGSKAGGRDYLLQFLEPRVITENVQRQGFAPIAGVDD

SEQ ID NO: 15673 - protein, 652 aa, Thermosynechococcus elongatus BP-1
MVVLKTETTQGSWSDKLRGIARWWSEFKIQTRLMATATLVVSIIMSGLTFWAVNTIQTNAHLNDTRYGRDLGLLLAADVAPLVAKGDTAAVAEFSRKFYERSASIRYILYADPDGEIYYGLPYSAPQVESALTLRRRIQLPETYHASQEPLVRQHQTPNGLVADVFVPLTFNGENLGVVALGINPNPTLIASANLTRDLTIAVFVSLWIMVILGGVFNALTITQPIKELVQGVKNIAAGNFKQRINLPFGGELGELITSFNDMAERLASYEAQNIEELQAEKAKLDTLVSTIADGAILLDTDMRIILVNPTAQRLFNWEGMNVIGQNALDCFPAPVCEKLTCPLYKASRGESEGGEFRVTLQEPSSRSVRILLTTVMDVQREKPKGIAITIQDITREVELNEAKAQLISNVSHELRTPLFNIKSIIETIQEYGSSLSEKEQQEFLETANHETDRLTRLVNDFLDISRLESGRPYQFGSVQMAQVIDQIMRTYQLNAANKSITLTAEVENPLPPVWGNYDLLIGALTNLVGNALKFTPENGRVTIRAYVWHPSSDPEQERVRIEVADTGMGIAPEDQPRVFERFFRVENRVHTLEGTGLGLAIVQDIIHKHNTQIHLISELGVGSTFWFDLAIDESALVDNPDGRAETALPPA

SEQ ID NO: 15674 - protein, 193 aa, Thermosynechococcus elongatus BP-1
MLPDSRWHRTKTRHPTYINLTYIEKKRFTRNQRNQNQYSLREITMDEFMAAAIAEAEQGLQEGGIPIGSVLVRHGQIIGRGHNQRVQRGSPILHAEIDCLANAGRIGRYDDTVLYSTLMPCYLCAGAVVQFGIKKVIAGESQTFAGAREFMEAHGVEVIDLNLERCQQLMRDFIAQYPQLWFEDIGKLTSKEA

SEQ ID NO: 15675 - protein, 349 aa, Thermosynechococcus elongatus BP-1
MSNKGSSDLRLLLSTLVISGLVAGLAYWQLSQHWTRSPDQNAGSPLHTPTSKWQKIALAMTLRGHEDEVNAIALSPDGNFLVSAGDDRRLYFWNLATGTALGQAKGHTDWIYALVMTPDGQTVISGSKDKTIKLWGVGDRQLQATLSGHQDFVNGLALSPDGRTLASASYDHTVKLWNVPSRQEITTLKANEGIMLSVAISRDGRFLATGGVDKLIRIWDLPSRRLLRTLEGHTSDVNSLAFTPDSSQLVSGSDKDGIKLWNLTTGELQQQFGTEGGQVFSVAVSPDGSTLASGHGDQTVKLWSLSGQLLRNLKGHSGAVYSVVFGQDQLISASEDKTIKVWRLFPETP

SEQ ID NO: 15676 - protein, 375 aa, Thermosynechococcus elongatus BP-1
MLSCPMVAIPIQPLSERPLTTDLVRQYLQEIGRVPLLTPSEELRLAEQVQQYQALLAVRDQSDDPQLKRYVAAVRERDRLRPLLGRPLSRAQWAAGLKMSVAELQTCVQAGRQAWAKAANITLSELQHIERQGQRAKNQLLQANLRLVVNIAKKYQHHGVEFLDLIQEGSLGLERAVEKFDPTKGFRFSTYAYWWIRQSITRAVASQSRTIRLPIHMVEKLNKIKRAQRRLAAQRGAMPSLADIAQELNLEVSQVRQVLMAVPKSVALEQRVGSDQETELQELIESPAPTPDEVIMRESLRTTLKQLLSDLSPRERQVMELRYGLGEQPALELAEVAVLLGLSRERIRQIEHRALQKLRQPQRRREIQDYLEEFA

SEQ ID NO: 15677 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 15678 - protein, 716 aa, Thermosynechococcus elongatus BP-1
MQEGLYIVLISIHGLIRGDRLELGRDADTGGQTRYVVELAKTLAAHPRVAQVDLVTRLIPDAKVSPDYAQPIERIGDRARIVRLACGPRRYLRKEVLWPYLDVFADELLRYLRQSGRMPDVIHSHYADAGYVGCRVAGWLGVPLVHTGHSLGRVKRQRLLAQGSKPDAIEEQFHLTTRIEAEEQTLASAALIIASTHQEVEEQYRLYDQYDPARMAVIPPGVDTSRFYPAPVPADLPFRQELRRFLVEPEKPFIFCLSRPVPRKNVAALLNVYGSDRFLQARANLVLVLGNRTDISKMEASPRQVLMELFLLVDRYDLYGKVAYPKTHRSDEVPDLYRLAAQQRGVFINPALTEPFGLTLIEAAACGLPILATADGGPQEIIRHCRNGLLFDALDLEAIRSALHQAFQSDSQWQTWADNGLKGVQAHYSWHSHVEMYLQALDQLAEKSVLPVLSVQRQPLQCQTHPLPTTLTRNRLLTLERLLISDIDHTLIGDRAALERLLTLLQRRPEMGFGVATGRHLEMTLEVLHEWGVPIPDVLITSVGSEIYYGPHLVPDTSWQQHISYRWEPQRVRDTLADVAGLRLQPPENQRSHKISYNVDTTVLPSITPVLRLLRQQKLHCRPIFSHNQFLDILPLRASKGDALRYLALKWGYPLQKLLVAGDSGNDEQMLTGNTLAVVVGNHSPELEKLRDRPHIYFAKGHYAQGILEAIEHYGF

SEQ ID NO: 15679 - protein, 679 aa, Thermosynechococcus elongatus BP-1
MTSLLLEPLQQYPAEALAPTLAALQKTQTVLPPPHPVWLVSTSVWQQLRSGVIPLWQAACDRWQERPPTAADFKALALEMTHQLPPLDGGELETVFAECHRFWQQQGGDCHLVLTTYLWQGAVDLPWGLGRGTVLNDPSLPLCHQEIEAAFAALVQAKNLYTYWQQGWDFCQLKALILLYPLSTIVASGWWTGRESRLKAIASGVALPHQGIPLPPRGIELTPAEEQRLQQACRGALSHLWLWHRSQTQVWWGQCLPEPLPVAPLPPAVEHTLLAKGIPAAGGQAIAPAIVVTDPCAPAAVAGRILVTKSIPPHWLPLVNAAVGVICEQGGLTSHGAILARELGRPAVVGVANATQQIRSGMTLFLDGHRGAIYQLPPEPLPLLATPPPQTPSPPAVKQLPLQVMVNVSQVSALRLLRSLPCDGIGLLRSELMLLAFLEHRHPCHWLEQGEAEELRDRWVQHLCEFMRAIAPRPLFYRTLDLRPADYRQLLGGHRFEPETDWGLRGVSRYSHCPELFHLELSALAIAHRLETCPLRIVLPFVRSVREVTYCQQALAEHGFTLNAGVELWVMAEVPAILFLLADLAHLGVAGITIGTNDLTQLLLGIDRETALPEFNEDHPAVRGAIAQLIQGAKGHHLGCSLCGEAPARYPHWLPWLIDLGLDSISVSPEVVSQVLSHL

SEQ ID NO: 15680 - protein, 112 aa, Thermosynechococcus elongatus BP-1
MKKVEAIIRPFKLDEVKIALVNAGIVGMTVSEVRGFGRQKGQTERYRGSEYTVEFLQKLKVEIVVEDNQVDMVVAKIIEAARTGEIGDGKIFVTPVEQVIRIRTSEKDHEAV

SEQ ID NO: 15681 - protein, 418 aa, Thermosynechococcus elongatus BP-1
MADDSSVTEGNGCRQYTDNTHLGRLYEDNGMTQANVLDVYDPATAPLEDEVALLSDYGLDAVEIEEEESEDFEEVSDDLDGKPTKGRASRRRTQVKKKHYTEDSIRLYLQEIGRIRLLRADEEIELARKIADLLEMERVRDRLCQELGCTAEELERNPEPWAKELGMTVPAFRHRLFVGRKAKEKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIADRMEMTIEKLRFIAKSAQLPISLETPIGKEEDSRLGDFIESDGETPEDQVSKHLLREDLETVLCTLSPRERDVLKLRYGLDDGRMKTLEEIGQLFNVTRERIRQIEAKALRKLRHPNRNSVLKEYIR

SEQ ID NO: 15682 - protein, 655 aa, Thermosynechococcus elongatus BP-1
MVSGRLSLLGILRGRVFMHLSELTHPNQLHGLSIAQLTQIAAQIRDKHLETVAATGGHLGPGLGVVELTLALYQTLDLEKDRVVWDVGHQAYPHKMLTGRYNNFHTLRQKGGIAGYLNRRESPFDHFGAGHASTSISAALGMAIARDLKGENFKVVAIIGDGALTGGMALEAINHAGHLPHTNLMVVLNDNEMSISPNVGAIPRYLNKIRLSPQVQFITDNLEEQFKHIPFFGENLTPEMQRLKEGMKRLAVPKVGAVFEELGFTYVGPVDGHNLEELIATFQHAHTIPGPVLVHVATVKGKGYAIAEKDQVGYHAQNPFDLVTGKAKPSSKPKPPSYSKVFGETLTKLAENDPRIVGITAAMATGTGLDILQKRVPKQYIDVGIAEQHAVTMAAGMATQGMRPVAAIYSTFLQRAYDQIVHDVCIQKLPVFFCMDRAGIVGADGPTHQGMYDIAYLRCLPNMVLMAPKDEAELQRMIVTGINYTDGPIALRYPRGNGYGVALMEEGWEPLEIGKGELLRSGEDLLLVAYGSMVYPAMQVAEILKEHGMSAAVINARFAKPLDTELILPLAKQIGRVVTLEEGCLMGGFGSAVLEALQEADILVPVLRLGVPDILVEHASPDESKADLGLTPPQMAETIMQKFGVPQRATVVTAS

SEQ ID NO: 15683 - protein, 426 aa, Thermosynechococcus elongatus BP-1 [sequence omitted]

SEQ ID NO: 15684 - protein, 261 aa, Thermosynechococcus elongatus BP-1
MSSTTANTDLKHSTLSLLQAYRDNPAPELRNRLVELNIGLVRKEAHRWVQCTQESFDDLMQVGTLGLIRAIERFDPTKGVAFSSFAIPYIRGEIQHYLRDKSPQIRLPRRWQTLQSQGKRVIQELRQQLERPPTDSEIAQALDVPLEEWQAAKFASYHTTPVSLDAPTFEGEEESVALGDILPDQRYQSFQLAEEDRIRLQQCLRKLEARTCQILEFVFLRDLSQKETAELLGLSAVTVSRQIKKGLQALQQMMRHDDAES

SEQ ID NO: 15685 - protein, 812 aa, Thermosynechococcus elongatus BP-1
MTQSIPRPTSEITNRETAFVLELNALSCKDLPLVGGKNSSLGEMLQQLTPKGINVPDGFATTAYAYRYFIQAGNLETQLRRLLEGLDVEDVTELHRVGQTIRSLILHTPFPPELTDAIAAAYQKMCDRYGPNTDVAVRSSATAEDLPDASFAGQQETYLNVHGLKGVLDACHRCFASLFTDRAISYRQIKGFDHFNVALSVGVQKMVRSDLACSGVMFSIDTETGFKDTALITAAYGLGENVVQGAVNPDEYLVFKPTLKAGYRPILKKALGTKEIRMVYDLGGTKLTRNEPVPERLRKQFALTDEEILTLGRWACLIEEHYSDLRGAYTPMDIEWAKDGMTGELFIVQARPETVQSQKATNILRTYHLEEKGTLLATGRAVGEMIGQGRARVILNVRNIDQFQAGEVLVTHRTDPDWEPIMKKASAIVTDQGGRTCHAAIIARELGIPAIVGCGDATETIPNGAEVTVSCAEGEEGHVYQGLLPFHVAEVPLEKLPRTRTQILMNVGNPEEAFSLAAIPNDGVGLARMEFIIANHIQAHPLALLHYDELKDEAAKRQIAELTQNYSDKGEYFVDKLAQGIGAIAAAFYPKPVVVRMSDFKSNEYANLIGGRQFEPHEENPMIGWRGASRYYDPNYAEGFALECRAMKKVRDEMGLTNVILMIPFCRTPDEGRRVLAQMAKHGLKQGENGLQVYVMCELPSNVVLADAFAEVFDGFSIGSNDLTQLTLGLDRDSALVAHLFDERNEAVKRMVAQAIQTAKAKGRKIGICGQAPSDYPEFAQFLVAQGIDSISLNPDSVLKTMLQIAEAEKEA

SEQ ID NO: 15686 - protein, 333 aa, Thermosynechococcus elongatus BP-1
MTALWQRLILISPFFFWGTAMVAMKEVMPHTSPLWIAGVRLVPAGLLVLGVAIALGKPQPNTLGAWGWISLFALVDGFLFQGLLATGLSKTGAGLGSVMIDSQPLAVALLSRWLYQERVGGWGWLGLLLGLGGISAIGLGDDLLPLLHQPSAWQGIPWGQWWQRGELWMLLAALSMAVGTILMRPLARYADPVVATGWHMVLGGLPLLIWPSLNTPAPWAALQWSDVLNLGYATLFGSALSYGVFFYFAAKGNLTSLSALTFLTPVFALTFGHWFLGETLSQVQLLGVGLTLVSIYIINQRQVLGQWWQQLPLPTRLRESATSVSVKVVDEMK

SEQ ID NO: 15687 - protein, 309 aa, Thermosynechococcus elongatus BP-1
MVRTYLQEIGRVPLLTHEQEIILGKQVQQMMALREKRDALTKELGREATFEEWAAACNLTPTELCNILKRGERAKQKMIEANLRLVVSVAKKYQKRNLELLDLVQEGTLGLERGVEKFDPTRGYKFSTYAYWWIRQAITRAIAQQARTIRLPIHITEKLNKIKRTQRELAQKLGRSATPAEVAKALELEPEQIREYLTLARQPVSLDLRVGDNQDTELGELLEDDSLSPEQFTTVESLRDDVNLWLAELTPQQRQVLTLRYGLGDGQELSLAKVGEQLNLSRERVRQLERQALDHLRRRRQQMYEYLAS

SEQ ID NO: 15688 - protein, 246 aa, Thermosynechococcus elongatus BP-1
MLSTLKADFQIIFERDPAARNWLEVVFCYPGLQAIVLHRLSHWLWRRGIPFIPRFISHIARLLTGIEIHPGATIGKGVFIDHGMGVVIGETAVVGNYCLIYQGVTLGGTGKETGKRHPTLGENVVVGAGAKVLGNLTIGDNVRIGAGSVVLRDVPSDCTVVGIPGRIVYRAGAKIAPLEHGQLPDSEAEAIRYLLDRIELLEQQVQTLQQQKKVPALVQGHLQPSQGQACRLSDRPIEEFLNGAGI

SEQ ID NO: 15689 - protein, 1035 aa, Thermosynechococcus elongatus BP-1
MRIFMFRFPLLSFIQLFLPTTAVIAALLTPLYVGQRQALFKDFRVGQEGKLEEIQLTIANDIDDAVTDPKGLGSFHLWHELIDSPSQGELAEEVQELVDQWHRLKEHYDQLYVLDTRGRIRFQWTSTPQSDPPSTVKAINSYWPILRELTPDQVFVSPVEVTATKSSGLPFPVLYIGVPLYHQSAPKGVLVVRYQLNHLFNNLLSRCNIQMGWCLVADDQGYWLLGEDIREQWGFDFPERRQFTVRHQYPLLWQQMQHQLRGGLFGPDGLFVFQSFSLLQENWISAERSAHSSRRQSNVRWWLIGFLPSSALEQYLDHLNRDFLVSFTALCILAAVAVLLITRDRQRKRSLQKLLETSNARFRSVSEMAPVGIFTLDAQGQPTFLNQRLLQLLQVHNLEEAQQQWIERLHPEDRDRVLKAWAACQQKRVPFHERFRIVHNDSSSHWINARIIPLQESSATDSFVGTWEDISQMMQQQELLEVARQAAEEASRAKSEFLATMSHEIRTPMNAIIGLTGLLLDTPLNPQQQEFVNTIRLSGDALLGVINDILDFSKIESGKLELESYPFNLRTCVEEVLDLLASRAAEREVELAAHIDSGVPCAVIGDMGRLRQVLVNLIGNAIKFTQKGNVTLYVKAKPMPMSQYEFMPSYYSYLFAIQDTGIGISAAGMNRLFKPFSQVDASTTRQYGGTGLGLVICQRLVERMGGQIWVESKKTGESLVVGGTPLAVYESIPIAESGSVFYFTARFLLNPNPAPEPTDDTCYLENRRVLIVDDNATNRQILALQIKKWKMQPLVAESGPSALALLQQQGWVDLAILDLQMPEMDGVTLARQIRAAYGELPLILLTSLGNTLTESEKALFSSLISKPVKQSTLYNALNSLFCEKQKTVSPKPAAAPSFEHLKAELPPLRILVAEDNKVNQMVALRILEKLGYRGDIAANGLEVLDAVQRQPYDVILMDMQMPEMDGITATREVTQLFQGLKKPRPRIIAMTANAMESDRQLCLDAGMDDYVSKPIRLEELVRALRQCQPLQTPTT

SEQ ID NO: 15690 - protein, 729 aa, Thermosynechococcus elongatus BP-1
MPQPIFDRILPAFLYERIATVLLAQASRRGATVLTREEVIASTDAPFLIVVAESFALLLQAEPVPQMSTYRVAILTNPRAIARFLRKIRSQVPVNRRPLIRAVLQQLSPLNAKEQMLPADLAIALMAVLGEETTAQCQSCQPLVTAALNERQAQERLLHQVTTQIRQSLELPELLKIAVDRIREFLDVDRLLVGQFAQTEGELRGQITYESCRNSEIPSVLGIWDDCWQWSGLPSSSYQRLSQGEAIVVSDIQQFYGAVPCLQSFAAHWQIKSWLIVPIIVQDRLWGVLIAHQCDRPRQWQPQEVEFLTHLSQHLSIAIYQAQLYSELQQQKATLEQRVNERTQALREALSAMEAAHRIKNDFLATMSHELRTPLTCVIGVSATLLRWPLGPLTAKQREYLEIIHESGTHLLELINSILDLSEAELGRSQLHRSAFSIRQLCADCLEVVKPQAHRHQVNLRHQLMIPPTRDRFWGDYRRIQQILINLLSNAIKFTPAMGEVILRAWWKEDELIFQVQDTGIGIPAHLQSLLFQKFQQLDSSFGRAYTGAGLGLALTKQWVDLHHGWIDVDSTEGKGSTFTVGLPAISDPLPDPPKPKLDVPPLATTEVLVEPEGRIVLVSEDEATSTLICSILTTAGYQVIWLVDGEVERLLALTPIAVLLAEPFSYGDVQELVDQLRQRCTPEQLKIFILGSKGNYQGVDRYIPLPIHPESFLQQVTMGLTSLATSAQ

SEQ ID NO: 15691 - protein, 871 aa, Thermosynechococcus elongatus BP-1
MTLDAADLDAITQEARHCFLYEDAPEYLLLLEQWAEQVVTDPERHYTAEDYNTLMRAAHSLKGGAGIAQLSELQALSHRLEDILEALKEGRLGDRPRAHHLLVQGIEQAQELLAAAKQNHSLTPTPPYQALLAALTELLSTVSDPSSPPTVAPPDLRTALTQTLEESLQLLEASATDAERETALAQLIATAHTLGKQYPLPWLQQLAAELPKLAADLPLGELVPAIVAECRQLQQAELVKLLPPEPTPPPPAETAPPQDSYLRIPVSRLDRLGNTVSELLIGQERLTLYQQQFLRANRELKQRLDQFRPIRDQVQTFYDRLATPLGGPGRPTNGHNDFDALEFDRYTELHTALQDFQELLVRIQETGADIDLLSRDLQEALDLNRQHLNSLYAELTNSRLVPFRQLAQMFVTAVQALGDRHHKPVQLVIEGGDTLVDQVILQQLKAPLTHLVRNAFDHGLEPPKQRQQLGKSPTGTIWLRARLRGNAVEIQVADDGRGIDLQRVSQKAVELRLCSAEQVPHLSREQILEFLFVPGFSTAKQVSDLSGRGVGLDVVREQVQRSRGHLQITTEPQRGTTFTLTLPLTLSLLPMVLCQVGELTLAIPDLSIREVIALKEYTDIRHPSATIDWQGQSIPLYPLHQLLPYQRPLSGPTRPLGVGVVVDVAGQAVALAVNYLIAERELVVKPFDQTVPVPPYVMGCTVLGSGEVVPVLAPDNFTVLLRPVEVRASPMESPQQPITPQVLIVDDSITVRRLLDRVLRQAGYNVVQCRDGKEALDFLLAAGDQVSLVITDIEMPRLDGYDLLEAIRLSARLRHLPVAMLTSRGGDTHRQKALQLGANGYITKPFQPQGILQTVTQLLTGRHGGVATLSQ

SEQ ID NO: 15692 - protein, 1176 aa, Thermosynechococcus elongatus BP-1
MSFLEYLHAEPRRVIVFDGAMGTNLQAQNLTAEDFGGKEYEGCNEYLVISQPEPVAKVHRDFLAAGADVIETNTFGSSSIVLSEYNLGDRAYEISKTAAELAKSVAAEFSTPEKPRFVAGSMGPGTKLPTLGHIDYDTLYRAFREQAAGLFDGGVDLFIIETCQDVLQIKAALNGVMAVFQERGERRPLMVSVTMEQQGTMLVGSEIGAALTILEPYPIDILGLNCATGPDLMTEHIRYLAQHSPFVISCIPNAGLPENIGGHAHYKLTPMELRLALTRFVEDFGVQVIGGCCGTRPDHIAALAEIAATLTPKARSPQRIPAAASIYSPQPYDQENSFLIIGERLNASGSKKCRDLLNAEDWDGLVALARAQVREGAHILDVNVDYVGRDGVRDMRELVSRLVTNVTLPLMLDSTEWQKMEAGLKVAGGKCLLNSTNFEDGEPRFYKVLELAKTYGAGVVIGTIDEEGMARTAEKKFAIAQRAYRAALDYGIPPWEIFFDPLALPISTGIEEDRGNGRETIEAIRRIRAELPGCHILLGVSNISFGLNPAARQVLNSMFLHEAIQAGMDAAIVSAAKILPLAKIEPEQQQVCRDLIYDRRRFEGDVCVYDPLAELTRLFEGKSAKQNRSQVENLPIEERLKRHIIDGDRLGLEDTLAQALETYAPLEIINTFLLDGMKVVGELFASGQMQLPFVLQSAETMKAAVAYLEPFMEKSATGDTAKGTVVIATVKGDVHDIGKNLVDIILTNNGYRVINLGIKQPVENIIQAYEEHQADCIAMSGLLVKSTAFMKENLEVFNERGITVPVILGGAALTPKFVYEDCQSTYHGQVIYGKDAFADLHFMDRLMSAKAAGQWDDRQGFLDGTTISTPSPRAIALEPTAVPEPETPEVVDTRRSEAVAVDIPRPTPPFWGIRHLKPDQIPLSEVFAYLDLQALIAGQWQFRKPKDQDRATYDAFLAEKVYPILEAWKQRILAENLLHPELIYGYFPCQSEGNTVYIYDPLGDKDAWVPERAIAQFTFPRQKGGRRLCIADFFAPVESGIIDVFPMQAVTVGEIATQVAQELFAANQYSDYLYFHGMAVQTAEALAEWCHARIRRELGCTPDPESIRDILAQRYQGSRYSFGYPACPNMQDQYTQLRLLESDRMGMYMDESEQLYPEQSTTAIICYHPTAKYFSV

SEQ ID NO: 15693 - protein, 413 aa, Thermosynechococcus elongatus BP-1
MSPPAVDIKVSTDAPPKIVKALNLLGSTGSIGTQTLDIVAQYPDRFRVVGLAAGRNLERLIPQIRQFQPEIVSIADPEQLPELEAALADLPQKPQLVAGEAGIAAVAAYGDAEVVVTGIVGCAGLVPTIAAIKAGKDIALANKETLIAGGPVVLPLLQEYGVKLLPADSEHSAIFQCLQGVPEGGLRKIILTASGGAFRDWPVEKLAQVTVADALKHPNWSMGPKITVDSATLMNKGLEVIEAHYLFGMDYDNIEIVIHPQSIIHSLIELQDTSVLAQLGWPDMRLPLLYALSWPERIPTNWSPLDLVKAGDLTFRSPDHQKYPCMGLAYAAGRAGGAMPAVLNAANEQAVALFIAEAIAFLEIPRLIEMVCDRYSAQNIPNPTLEDILAADRWARATVQELAQRGVSPMVAL

SEQ ID NO: 15694 - protein, 808 aa, Thermosynechococcus elongatus BP-1
MTCVLLKAVVESDERADLRQFSRILQLGEKRYLLRNDILDAFADYCRDQERPVPPPSESRLSKLVFYTQEIIVDNESLCWIVRPRIAQQEVCRLLVEDLTIVPMTIPELLDLRDRLVNHYHPNEGDVFEIDVQPFYDYSPIIRDAKNIGKGVEFLNRYLSSKLFQDPRQWQQNLFNFLRIHRYNGYQLLINERIRSPQHLSEQVKQALVVLSDRPPTEAYSEFRFELQNLGFEPGWGNTVARVRDTLEILDQLLDSPDHQVLEAFVSRIPMLFRIALISPHGWFGQEGVLGRPDTGGQVVYILDQVKSLEKQMREDLELAGLGVLEAQPKIIVLTRLIPNAEGTLCNQRLEKIYGTNDAWILRVPFREFNPKVTQNWISRFEIWPYLETFAIDAERELRAEFGHVPDLIIGNYSDGNLVAFLLARRLKVTQCNIAHALEKSKYLFSNLYWQDLEDKYHFSLQFTADLIAMNAANFIISSTYQEIVGTPDSIGQYESYQSFTMPDLYHVVNGIELFSPKFNVVPPGVNEQVYFPYYHYTERLEGDRQRLEELLFTLEDPQQIYGYLEAPEKRPLFSMARLDRIKNLTGLAEAFGRSKALQERCNLILVAGKLRTADSSDREEIAEIEKLYQIIHQYNLHGKIRWLGIRLPKADSGEIYRIIADRQGIFVQPALFEAFGLTILEAMISGLPTFGTRFGGPLEIIQDGVNGFYINPTHLEEMAETIVRFLEACDRDPQEWQRISKAGIERVYSTYTWKIHCTRLLSLAKIYGFWNFSSQENREDMMRYMEALFHLLYKPRAQALLAEHLQR

SEQ ID NO: 15695 - protein, 726 aa, Thermosynechococcus elongatus BP-1
MSPVIEQLQSLNRILVKLARRQPFHGANCEEILQDILSTSARSLKVARVSLWFYADDRQQIECVHLFQESGQGLTAGMKLTASDYPRYFAALQEERTITAHEAGVDPRTQEFRQSYLEPLGITSLLDVPIWVEGVMIGILCYEHMGPPRQWTVAEEQFAASLADLVSLVVESRDRHRALKALEESEARLATFFQATSEAVVIHEQGTILDVNAATERLFGYRAAELVGQSVLLLTHPESRSLILERIQQPMDVPFEALARTKSGEVLIVEVQGKSILYQGRWARVVGIRDITQRKTAQQKVQLAAQQQQLLAEVALRIRQTLELPEVLNTTVVEVRRYLLSDRVFIVAFDPITEEIQVVAAAMAPQWHTNLEALLENVPYRSQLLTTAATLSCGQEGLDSQLRQVYEAHHIQSCLLIPIQHRPQGRCFLLGVHQCDHRREWQPHERAFLEQLATQVAIALQQAELYQQLAALNANLEQQIAERTGQLQQKMSELEELNRLKDLFLHAVSHDLRTPVLGTLMLINHLLQSDTSDTIAVPRSTLTCIQHSQQRQLHLIETLLHIQGDRQPSLSLAIAPTSLATLVNDILADLQPLLEKNKATVKLQIPPTLPLVPVDPIQLRRVYENLITNTLKHNCPGIIITLAAEERGDSVYCTVKDNGVGIPPDQQSHLFELYYRGGASHHRTGIGLGLYLCRQIITAHGGEIGVTEGDSQGATFWFRISLADQI

SEQ ID NO: 15696 - protein, 347 aa, Thermosynechococcus elongatus BP-1
MDNVIGLEIIEVVEQAAIASARWMGKGDKNMADQAAVDAMRNRMNQIHMRGRIVIGEGERDEAPMLYIGEEVGICTRPDAAQYCNPEELIEIDIAVDPCEGTNLCAYGQPGSMAVLAISEKGGLFAAPDFYMKKLAAPPAAKGKVDIRNSATENLKILSECLDRAIDELVVVVMKRDRHNDLIQEIRDAGARVQLISDGDVSAALACAFSGTNIHALMGIGAAPEGVISAAAMRALGGHFQGQLVYDPAVVMTKEWANRTREGNLEELKKAGITDPDKVYEAEELASGETVLFAACGITPGMLMKGVRFFKGGARTQSLVISTQSKTARFVDTIHMFDQQLKSLQLY

SEQ ID NO: 15697 - protein, 1353 aa, Thermosynechococcus elongatus BP-1
MPAAPLPANEPERQRALEQYQVLDTPPEPIFDEITNLAAAICETPIALISLVDRQRQWFKSKVGIDACETPRNVAFCAHVILQDQLVIVPDARLDPRFADNPFVTGPPYIRFYAGMPLVTPQGYGIGTLCVVDYQPRQLNPVQQQTLRTLARQVINELEIRHHLEVTQQQLAYIQQMSSLQEAVFNSSNHAIIATRTDGIITLMNRAAQQWLGYPASELVGKATPERFHDPQEMERYAQILSAQLGEPIPAGFETLVARARRGLADEQEWTFVRRDGSCFPVSLSVTPMHDRQGQLIGFLESAVDITDKKQIEAALRLRERAIIASTNGIVITDYRQPDNPVIYVNPAFERMTGYRATEVIGKNCRFLQGSDRHQPGATAIRNAIKKGQSCRVVLRNYRKNGQLFWNELAISPIYNEFGEITHYIGIQSDVTERQRAQLFLQQQVKRTLLLNRITEEIRQQIEREHICRTAVQQVGVTLNVSRCLLFVYQENAPTPMELVAEYCGPGVPSVNECDLDLTQMRAPFLASVFASDEVFSCDDVQNDDRLAPLHAYCEALRVKSALIVRTAYRNQANGLLILHQCDRQRRWTDAIQSLLKSVAAQVGIGLAQVQLLEQETRQRQQLQQQMQRALLLNQITEQIRQSLDTETVFATTVTQIGQAFGVNRCLIHRYDPGPPPHIPDVAEYLQPGYASMRGISIPVENNPHALAVLSGDTAVVSNDVTQDPLLANAMHLCHQFQIQSMLAIRTSYKGVPNGIIGLHQCDRQRQWTPEEIELLEAVAAQVGIAIAQAELLRHEQQQRQLLAQQNQELEQARLQAELANRAKSEFLATMSHEIRTPMNAVLGFTNLLLDTPLNEQQRDFLQTLHQAGEALLTIINDILDFSKIESGKLVLEQQPFDVRECVEDVLSLLASKAQEKELELLYTCTPETPAQIKGDVTRLRQILVNLVGNGIKFTHEGQVAVHVGVLKREGKDFLQFQVQDTGIGIPRDRLDRLFKPFSQVDASTTREYGGTGLGLVISKRLCELMGGDMSVESTEGQGTTFTFTILAEGQKPYVPPKVHPALEGKRVLVIDDNAASRENLCTLLHNWGMVPIGYSDPRLVLEAAPPWDLAVIDLNMPQMTGLQLAERLQSEPNFNQQPMILLTPLSWLETASRKELITAHVPKPIRPLTLRQTLIRTLSSESATQPALTKTGIDLNLGNRFPLRILLAEDNAVNQKVALHILKRMGYRADVAANGLEVLEALQQRPYDVILMDVQMPKMDGLETTERICAQWPPSQRPWIIAMTANALAGDRERCFAAGMDDYISKPIKIEALAAALNRCRCLNPKSTYPQLCDQINIDSDQGHQSATESMT

SEQ ID NO: 15698 - protein, 1060 aa, Thermosynechococcus elongatus BP-1
MLSKLSFRHKLLLGTLFPIVVIYTGLFFYIRSQVIRRSTADYEAWQQDVASLYAQQFSNALQEITGLATTSANALEAFPTIREEELYSFLRRNLKISRLAYGAAITFTPYSFSPRKRLFAPYVYRDIHRNRLVPKDIGHIYDYTQVRWDWYSEAVRTGQPQWSDPYFEEGAGNVWMVTYAVPFYRQGQIRGVATVDVALPTLQQEIDIQGLQQAQFFVLDRKGRIIFHGDPQLIGQSIFYIAKEYNRSDLAALAEAMISGHSGHLWMTDWVSNERQWFFYTPIPEVGWSLAIRVREEALLDFIHQETWAGLLILVVSFGLISLVTLGVTSYMVRPIQRLAIAAHKIALGNLDIAGEVDTHSQDELGNLGRTFVDMAAQLQESFAELHHFNQRLEEKVKQRTAALEAANQQLSEKERVLHDHNVALVQLSQSPHVQQGHFRMALQEIIQVTAITLRVQRASAWELQGDRLKCVVQYDPAANNHTQPTYLTHSPYPEYLKLLRSGEPLVINDLLTDPRTHELREYARVQRVYSRIDTPIIFNGQLLGVICVESIGKQRVWLLEERRFVANVADIVTIALAAHQRHQAERELLKAKEAAEAANKAKSIFLANMSHELRTPLNAILGFSQILLSDRTLAPQHRQTLEKINRSGEHLLGLINDVLDMAKIEAGRMILQQTTFDLRRMLRDLEEMLKVRAEAKGLRLVFDLAANLPVAVTTDEMKLRQVLVNLLGNGIKFTKEGSVCLKVSYRAQEPPRLAFEVSDTGIGMTPQELKMLFQPFVQTDSSKKVSEGTGLGLAISRQFVQLMGGDIQVRSTKGKGSHFYFEVPIDLGDPRSLEEEKAQTIVGLRSPTSEVRILVVDDLPENRQLLTQLLEPVGFRCREASNGQEAVEIWRAWQPHAILMDIRMPVMDGKTATRQIKKEVGDRLQRGETICPPKILAVTASSFEQDKQELLGLGCDDYIAKPFRPQILFERLAAQLHLEYAYDSTPPAAPPPPTLDPTALTVMPPSWIAELQAAAKKLNAKRIRELIAEIPPEEAALIAGLQQLVKTFRFDKIVELTLV

SEQ ID NO: 15699 - protein, 245 aa, Thermosynechococcus elongatus BP-1
MSETAVAIVTGASRGIGRAIALELAKEGATVVVNYARSAEAALEVVQRIEQQGGTAIAIAADVSVPEQVDTLVAKTVETYGRVDVLVNNAGITRDTLLLRMSLEDWQAVINLNLTGVFLCTRAVSKLMLKQKRGRIINIASVAGQMGNPGQANYSAAKAGVIGFSKTVAKELASRGITVNAVAPGFIATEMTAELKAEDILKFIPLGRYGEPTEVAGMVRFLALDPAAAYITGQVFNVDGGMVMA

SEQ ID NO: 15700 - protein, 452 aa, Thermosynechococcus elongatus BP-1
MQALSTRTAKNTLPRAFAMPQPQVPARQPIALISVHGDPAADVGHESAGGQNIYVRQLGEALAAAGWHVDMFTRKTDPNDPDVIEHSPHCRTIRLQAGPLTYIPREKLFETLPKFVEAFKAYHAKYGYPLIHTNYWLSGWVGWQLRQQFNFQWLHTYHSLGVVKYQVASEQAQRDETRLMVEKAILENADCVIVTSPQEEAYLRRWVSKAGQTRLIPCGTNLKLFYPVADARAQLNLPADEPIVLYVGRFDRRKGIETLVAAMAQIPQGQLLLVGGSDPQRSDGAERRRIEGLVQEYNLGDRVTFVGQIDHEYLAVYYSAANVCVVPSYYEPFGLVAIEAMACGTPVIASAVGGLQFTVIPEETGLLVPPQDANALANAIQRILADPAWARTLGKNGRERVQALFNWEAIALQMGQLYRQLFAASLMGNSPRLEMVKNTASLAAVTKAALAS

SEQ ID NO: 15701 - protein, 639 aa, Thermosynechococcus elongatus BP-1
MANRIIATSVLEELLARLPHLRSQLYFKTSLTALSHAMEDQVLASEDAPIIIACFQRERFYRQEAHRYQRIATKSHHVYVLAAPETEFTSCSRDYETVAFDPSDALSQEWHLTVLGKNYSTCLVCREVQRSPTHRLDVLPPMDAARRFEGIWTFDRQVAATTAEILLNRICEYRPELKGKLRDALALVEAYRQLEGCNRDPAPFVDRLVTYLQAGQYKQIKAYRQIAIQERKERLTNAITTAIRNSLNPTEILTRAVAELGEALKGDRCLIYRCRSTDTRVPIEHEYTSGALTPLQYQYWPVREHPYTQQALAHQQVIQVDDVAADPYYEATRFKPLDAAGVKALLLAPVLYRGRLLGIVELHRGEPLPWHDMDAELVEAIATQVGVALIQAEAYADLEELNAQLEALDRTRSNLIAITGHELRTPLSTIQVCLESLASEPDMDPELRQVMLSTALADAERMRKLIQDFLTLSQLESGRVQWRPEPLPLQELVDLALSSLRTPKEQLPTIQTLLPKELPLVRADGEWLVEVLSKLLDNACKFTERSGQVSIAAKPRPDGLLEVTIADTGRGIEPDRLETIFDRFYQEEGALRRSAGGTGLGLAICRQIITNLGGQIWAESAGRDRGSQFHFTIPIAESF

SEQ ID NO: 15702 - protein, 357 aa, Thermosynechococcus elongatus BP-1
MTSSSTSFSLHGGNSFLRNIWYYGLPAADLKPGRCQAKVLLGEPILFCRTTSGKPFALRNLCPHRGMPLHYGRFDGKEVECPYHGWRFNAHGHCTLIPSLTSDSDVDLKNFGVLSYPVREVQGNLWIFFPANGRNVSEPTLEVPLVPGFSAETQPQAVQKFIFPGHLDQVFINFMDPSHAPFVHGAWWWRKRGKLFEKAKTFDPSPYGFTMRRHPLLRKSWAHHLLGGHPEVEIIYRLPGIRIETNYSDRHTFCFLITLTPINDQETELTATYYWTFPWLAPLKPLLAPLAREFLNQDLRIVAKQSEGLKYKPPLTLIKEADYQAKWYYQLKREYEKATQEEREFVNPLKTQVLRWR

SEQ ID NO: 15703 - protein, 450 aa, Thermosynechococcus elongatus BP-1
MISTSLAANQQILPLTAQTNARGHLTIGGCDVVELVAQFGSPLYILDEFTFRTACRQYQETLQRAYGGESLVLYASKAWNCLATCALAHSEGLGIDVASGGELYTALSAGVPASHIYFHGNNKSPQELLYALEVNCTIVADNWLELERLAAYVEEHDLSTPPRVMLRLTPGIECHTHEYIRTGHLDSKFGFDPQQFPELLQFAKAHPELDWVGLHAHIGSQIFEEQPHLDLCDVLVDWLAQARAAMLPMRELNVGGGLGIRYVESDNPPAIAHWIKAISHQLSQACQQRHLPLPKLICEPGRSIVGPAAVTAYTVGSRKVIPELRTYIAVDGGMSDNPRPMTYQAQYTALCANRMTTAATETVRVAGKHCESGDILLAHATLPPLQANDILVVASTGAYNYSMASNYNRVPRPAAVIVCDGEANLILQRETYADLVAHDVLPLRLSTPTP

SEQ ID NO: 15704 - protein, 260 aa, Thermosynechococcus elongatus BP-1
MIPYNLSDPRLFGIMVGVMFLMVVSRLLLVAGFFSLVYVVASWTPLRKRRVNLRPYQRGQFWQEFGWSLVTAAIFALAGAIAAVMWQRGWTAVYLELNSPWDYMYFPVSIGLVLLLHETYYYWLHRWMHQPKIYRRVHRVHHHSIVASPWTAFSFHPWEACLQAIFLPLIIVLVPLHPYAIVIQLSLMTLSSVINHLNLEIYPRGFAEHWLGQWLIGATHHSLHHSQFRCNYGLYFTFWDRWLGTESRDYLPLFRDRTQG

SEQ ID NO: 15705 - protein, 387 aa, Thermosynechococcus elongatus BP-1
MTIQLGGHRTARRAYGIDEIALVPGNRTLDPQLVDTRWRIGAIEREIPIIASAMDGVVDVTMAVKLSQMGALGVLNLEGIQTRYEDPAPILERIASVSVDEFVPLMQQLYAQPIQPHLIEKRIQEIKSQGGIAAVSLTPAGASRFGEVVAAAGADLLFVQATVVSPAHLAPEGTDPLDLAAFCERMPMPVILGNCVTYEVALSLMHCGAAAILVGIGPGAACTSRGVLGVGVPQVTAIADCAAARDAYFEETQRYVPVIADGGLVTGGDVCKCIACGADAVMMGSPFARAKEAPGRGYHWGMATPSPVLPRGTRIHVGTTGTLEQILRGPAQLDDGTHNFLGALQTSMGTLGAKDLREMQQVEIVIAPSLLTEGKVYQKAQKLGMGR

SEQ ID NO: 15706 - protein, 94 aa, Thermosynechococcus elongatus BP-1
MSIYVGNLSYTATQEDLEAVFAEYGSVKQVYLPVDRETGRKRGFGFVEMSSDAEEEAAIADLDGAEWMGRQLKVNKARPREAMGGSNNRYSRNR

SEQ ID NO: 15707 - protein, 429 aa, Thermosynechococcus elongatus BP-1
MVSSPIKSEAPVRHDVKDLSLAPLGQQRIEWASREMPVLRQIRDRFEKEKPFAGIRLAACCHVTTETANLAIALKAGGADAVLIASNPLSTQDDVAASLVVNYGIPVFAQKGEDTATYMRHVNIALDHRPNIIIDDGCDVVATLVKERQHQISDIIGTTEETTTGIVRLKAMFRDGVLTFPAINVNDADTKHFFDNRYGTGQSTLDGIIRATNILLAGKTVVVAGYGWCGKGTALRARGMGANVIVTEIDPVRAIEAVMDGFRVMPMLDAAPLGDIFITVTGNKHVIRAEHFAVMKDGAMVANSGHFDIEIDLATLKTLAKQVRVVRNFTEEYILPSGKSIIVLGEGRLINLAAAEGHPASVMDMSFANQALGCEYLVKNKGQLAAGIHPIPAAVDQEIARLKLQAMGIAIDTLTPEQVEYMNSWTSGT

SEQ ID NO: 15708 - protein, 394 aa, Thermosynechococcus elongatus BP-1
MGVGGGIAAYKICDVISTQVKAGWQVSAILSETASQFITPLTLSTLCRRSVLTDADFWHPQAPRPLHIELAETATLMLIAPLTANTLAKLVLGLADNLLTSTVLASQMPILVAPAMNTTMWEQPTVQAHWQQLQQQPRYHSLPPAYGHLACDTVGVGRMAQTQEIIAYLDSLAYTHGKRDLAGKHLLITAGGTREYWDAVRFIGNPATGKMGIALARAALHRGAKVTLIHGAIAEPIPAQVRAIEAMSGEAMFKAVLEVWPEADWLVMAAAVGDVRPAQQWSGKLPKSALPTALPLSPVPDILQAAAQMRRPHQRLIGFAAQTGDVVAPAQEKLKRKGLDLIVANAVDQADCGFGTTENAAVVLDCQGRSRHLAKVPKLILAHQIFDIVQEWLP

SEQ ID NO: 15709 - protein, 153 aa, Lupinus luteus
GVLTDVQVALVKSSFEEFNANIPKNTHRFFTLVLEIAPGAKDLFSFLKGSSEVPQNNPDLQAHAGKVFKLTYEAAIQLEVNGAVASDATLKSLGSVHVSKGVVDAHFPVVKEAILKTIKEVVGDKWSEELNTAWTIAYDELAIIIKKEMKDAA

SEQ ID NO: 15710 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLEVTGVVVSDATLKNLGSVHVSKGVADAHFPVVKEAILKTIKEVVGAKWSEELNSAWTIAYDELAIVIKKEMDDAA

SEQ ID NO: 15711 - protein, 445 aa, Oryza sativa (japonica cultivar-group)
MYKAKRTAAQKVRRCLGKYELGRAIGQGTFAKVRFAKNMETGDHVAIKILDKAKVQKHRLVEQIRREICTMKLIQHPNVVHLHEVMGSKTRIFIVLEYVMGGELHDIIATSGRLKEDEARKYFQQLINAVDYCHSRGVYHRDLKLENLLLDTAGNIKVSDFGLSAISEQVKADGLLHTTCGTPNYVAPEVIEDKGYDGALADLWSCGVILFVLLAGYLPFEDENIVSLYNKISGAQFTCPSWFSAEAKRLIARILDPNPATRITTSQVLQDQWFKKGYESPVFDDKYYPYFHDVYDAFGDSEEKHVKEAMEEQPTLMNAFELISLNKGLNLDNFFESDKKYKRETRFTSQCPPKEIINRIEEAANLLGFNIQKRNYRMRMENIKEGRKGHLNIATEVFQVAPSLHVVELKKAKGDTLEFQKFYQTLSTQLKDVVWELEDAAEDMS

SEQ ID NO: 15712 - protein, 343 aa, Gossypium hirsutum
MENSTQESHLRSDNAVTYESPYPLYAMALSSTPAVTHLNYQRIALGSFIEDYTNRVHIISFDPESLTLITHPSLSFDHPYPPTKLMFQPHRKSPFSSSSDLLASSGDYLRLWEVGHSSIELISVLDNSKTSEFSAPLTSFDWNDVEPNRIGTSSIDTTCTIWDIEKGVVETQLIAHDKEVYDIAWGEGRVFGSVSADGSVRIFDLRDKEHSTIIYESPQPDTPLLRLAWNKQDLRYMATTLMDSNKVVILDIRSPTTPVAELDRHGASVNAIAWAPQSCKHICSAGDDTHALIWELPTVAGPNGIDPLSMYSASSEINQLQWSAAQPDWIAIAFSNKMQLLKV

SEQ ID NO: 15713 - protein, 341 aa, Gossypium hirsutum
NSTQESHLRSDNAVTYESPYPLYAMALSSTPAVTHLNHQRIALGSFIEDYANRVHIISFDPESLTLTTHPSLSFDHPYPPTKLMFQPHRKSPFSSSSDLLASSGDYLRLWEVGHSSIELISILDNSKTSEFSAPLTSFDWNDVEPNRIGTSSIDTTCTIWDIEKGVVETQLIAHDKEVYDIAWGEARVFGSVSADGSVRIFDLRDKEHSTIIYESPQPDTPLLRLAWNKQDLRYMATTLMDSNKVVILDIRSPTMPVAELDRHGASVNAIAWAPQSYKHICSAGDDTHALIWELPTVAGPNGIGPLSMYSASSEINQLQWSATQPDWIAIAFSNKMQLLKV

SEQ ID NO: 15714 - protein, 346 aa, Gossypium hirsutum; identical to SEQ ID NO: 729

SEQ ID NO: 15715 - protein, 345 aa, Gossypium hirsutum
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSAAQPDWIAIAFSNKLQLLKV

SEQ ID NO: 15716 - protein, 346 aa, Gossypium hirsutum
MTATSDPNPEVSDEQQKRSEIYTYEAPWYIYAMNWSVRRDKKYRLAIASLLEQYPNRLQIVQLDDSNGEIRSDPNLSFDHPYPATKTIFIPDKDCQKPDLLATSSDFLRIWRISDDGSRVDLKSLLNGNKNSEFCGPLTSFDWNEAEPKRIGTSSIDTTCTIWDIEKETVDTQLIAHDKEVYDIAWGGVGVFASVSADGSVRVFDLRDKEHSTIIYESSEPDAPLVRLGWNKQDPRYMATIIMDSAKVVVLDIRFPTLPVVELRRHQASVNAVAWAPHSSCHICTAGDDSQALIWDLSSMGQPVKGGLDPILAYTAGAEIEQLQWSSSQPDWVAIAFSTKLQILRV

SEQ ID NO: 15717 - protein, 557 aa, Arabidopsis thaliana
MKMGFLFLFCYLLAFLGYSPVDAAVKKYQFDVQVKNISRICNAKPIVTVNGMFPGPTVYAREGDRVIINVTNHVQYNMSIHWHGLKQYRNGWADGPAYITQCPIQTGQSYLYDFNVTGQRGTLWWHAHILWLRATVYGAIVILPAPGKPYPFPQPYQESNIILGEWWNKDVETAVNQANQLGAPPPMSDAHTINGKPGPLFPCSEKHTFVIEAEAGKTYLLRIINAALNDELFFGIAGHNMTVVEIDAVYTKPFTTKAILLGPGQTTNVLVKTDRSPNRYFMAASPFMDAPVSVDNKTVTAILQYKGVPNTVLPILPKLPLPNDTSFALDYNGKLKSLNTPNFPALVPLKVDRRLFYTIGLGINACPTCVNGTNLAASINNITFIMPKTALLKAHYSNISGVFRTDFPDRPPKAFNYTGVPLTANLGTSTGTRLSRVKFNTTIELVLQDTNLLTVESHPFHLHGYNFFVVGTGVGNFDPKKDPAKFNLVDPPERNTVGVPTGGWAAIRFRADNPGVWFMHCHLEVHTMWGLKMAFVVENGETPELSVLPPPKDYPSC

SEQ ID NO: 15718 - protein, 1101 aa, Arabidopsis thaliana
MEEENAVEILQRYRRDRRKLLDFMLAGSLIKKVIMPPGAVTLDDVDLDQVSVDYVINCAKKGGMLELAEAIRDYHDHIGLPYMNSVGTADEFFLATIPESSGSPPKRAPPPIPVLISSSSPMVTNPEWCESPSAPPLMRSESFDSPKAQELTVDDIDDFEDDDDLDEVGNFRISRRTANDAADLVPRLPSFATGITDDDLRETAFEILLACAGASGGLIVPSKEKKKEKSRSRLIKKLGRKSESVSQSQSSSGLVSLLEMMRGQMEISEAMDIRTRQGLLNALAGKVGKRMDSLLVPLELLCCVSRTEFSDKKAYLRWQKRQLNMLAEGLINNPVVGFGESGRKATDLKSLLLRIEESESLPSSAGEVQRAECLKSLREVAISLAERPARGDLTGEVCHWADGYHLNVRLYEKLLLCVFDILNDGKLTEEVEEILELLKSTWRVLGITETIHYTCYAWVLFRQYVITSERGLLRHAIQQLKKIPLKEQRGPQERLHLKTLKCRVDNEEISFLESFLSPIRSWADKQLGDYHLHFAEGSLVMEDTVTVAMITWRLLLEESDRAMHSNSSDREQIESYVLSSIKNTFTRMSLAIDRSDRNNEHHLALLAEETKKLMKKDSTIFMPILSQRHPQAIAFSASLIHKLYGNKLKPFLDGAEHLTEDAVSVFPAADSLEQYLLELMTSVCGEDTSGPYFKKLIPYEVESLSGTLVLRWINSQLGRILSWVERAYKQEHWDPISPQQRYGSSIVEVFRIVEETVDQFFALKVPMRSIELSALFRGIDNAFQVYTNHVMEKLASKDDLVPPVPVLTRYKKETAIKVFVKKELFDSKHLDERRSINIDVPATAMLCVQLNTLHYAVSQLSKLEDSMWLRWIAKKPREKIVIRKSMVEKSKSFNQKESFEGSRKDINAALDRICEFTGTKIIFCDLREPFIENLYKPNVSQSRLEGLIEALDTELGQLCSVIMEPLRDRIVTSLLQASLDGLLRVLLDGGASRVFHPSESKLLEEDVEVLKEFFISGGDGLPRGVVENQVARVRLVVKLHGYETRELIDDLRSRSSLEMQQGGKGKLGADTQTLVRVLCHRNDSEASQFLKKQYKIPRSHG

SEQ ID NO: 15719 - protein, 474 aa, Arabidopsis thaliana
MSINRNLLNIIIILCICLNLGCNDGAQERETDSHTIQVSSLLPSSSSSCVLSPRASTTKSSLHVTHRHGTCSRLNNGKATSPDHVEILRLDQARVNSIHSKLSKKLATDHVSESKSTDLPAKDGSTLGSGNYIVTVGLGTPKNDLSLIFDTGSDLTWTQCQPCVRTCYDQKEPIFNPSKSTSYYNVSCSSAACGSLSSATGNAGSCSASNCIYGIQYGDQSFSVGFLAKEKFTLTNSDVFDGVYFGCGENNQGLFTGVAGLLGLGRDKLSFPSQTATAYNKIFSYCLPSSASYTGHLTFGSAGISRSVKFTPISTITDGTSFYGLNIVAITVGGQKLPIPSTVFSTPGALIDSGTVITRLPPKAYAALRSSFKAKMSKYPTTSGVSILDTCFDLSGFKTVTIPKVAFSFSGGAVVELGSKGIFYVFKISQVCLAFAGNSDDSNAAIFGNVQQQTLEVVYDGAGGRVGFAPNGCS

SEQ ID NO: 15720 - protein, 894 aa, Arabidopsis thaliana
MSRISSVDVFENWFAQHKEKKLYIVLISLHGLIRGENMELGRDSDTGGQVKYVVELARALGSMPGVYRVDLLTRQVTAPDVDSSYSEPSEMLNPIDTDIEQENGESSGAYIIRIPFGPKDKYVPKELLWPHIPEFVDRALSHIMQISKVLGEQIGGGQQVWPVSIHGHYADAGDSTALLSGALNVPMVFTGHSLGRDKLEQLLKQGRPKEEINSNYKIWRRIEAEELCLDASEIVITSTRQEVDEQWRLYDGFDPVLERKLRARMKRGVSCLGRFMPRMVVIPPGMEFHHIVPHDVDADGDDENPQTADPPIWSEIMRFFSNPRKPMILALARPDPKKNLVTLVKAFGECRPLRELANLTLIMGNRNDIDELSSTNSSVLLSILKLIDKYDLYGQVAMPKHHQQSDVPEIYRLAAKTKGVFINPAFIEPFGLTLIEAGAHGLPTVATINGGPVDIHRVLDNGLLVDPHDQQAIADALLKLVSDRQLWGRCRQNGLNNIHLFSWPEHCKTYLARIASCKQRHPKWQRVEFENSDSDSPSDSLRDINDISLNLKLSLDGEKSGSNNGVDTNLDAEDRAAERKAEVEKAVSTLAQKSKPTEKFDSKMPTLKRRKNIFVISVDCSATSDLLAVVKTVIDAAGRGSSTGFILSTSMTISETHTALLSGGLKPQDFDAVICSSGSELYFTSSGSEDKTALPYTLDADYHSHIEFRWGGESLRKTLIRWISSVEEKKKTKKGEILVEDESSSTNYCLSFKVKDPALMPPMKELRKLMRNQALRCNAVYCQNGARLNVIPVLASRSQALRYLLVRWGIDLSNMVVFVGDSGDTDYEGLLGGIHKTVILKGLASDLREQPGNRSYPMEDVTPLNSPNITEAKECGRDAIKVALEKLGISLLKP

SEQ ID NO: 15721 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 15722 - protein, 439 aa, Arabidopsis thaliana
MGWPFIGETISFFKPHRSDSIGTFLQQRVSRYGKVFKSNICGGKAVVSCDQELNMFILQNEGKLFTSDYPKAMHDILGKYSLLLATGEIHRKLKNVIISFINLTKSKPDFLHCAENLSISILKSWKNCREVEFHKEVKIFTLSVMVNQLLSIKPEDPARLYVLQDFLSYMKGFISLPIPLPGTGYTNAIKARKRLSARVMGMIKEREREEEDMNNAIREEDFLDSIISNEDLNYEEKVSIVLDILLGGFETSATTLSLVVYFLAKSPNLLHKLKEEHAAIRAKKGDGELLNWEDYQKMEFTQCVISEALRCGNIVKTVHRKATHDIKFNEYVIPKGWKVFPIFTAVHLDPSLHENPFEFNPMRWTDKAKMNKKTTAFGGGVRVCPGGELGKLQIAFFLHHLVLSYRWKIKSDEMPIAHPYVEFKRGMLLEIEPTKFLED

SEQ ID NO: 15723 - protein, 368 aa, Arabidopsis thaliana
MDFDSISRESTFLSPLLNQNAMWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 15724 - protein, 389 aa, Arabidopsis thaliana
MTLRSLILEMRSRPHRVVHDLAAAAAADSTSVSSQDYRWSEIPEELLREILIRVEAADGGGWPSRRSVVACAGVCRGWRLLMNETVVVPEISSKLTFPISLKQPGPRDSLVQCFIKRNRITQSYHLYLGLTNSLTDDGKFLLAACKLKHTTCTDYIISLRSDDMSRRSQAYVGKVRSNFLGTKFTVFDGNLLPSTGAAKLRKSRSYNPAKVSAKVPLGSYPVAHITYELNVLGSRGPRKMQCLMDTIPTSTMEPQGVASEPSEFPLLGTRSTLSRSQSKPLRSSSSHLKETPLVLSNKTPRWHEQLRCWCLNFHGRVTVASVKNFQLVAAGASCGSGTGMSPERQSERIILQFGKVGKDMFTMDYGYPISAFQAFAICLSSFETRIACE

SEQ ID NO: 15725 - protein, 196 aa, Arabidopsis thaliana
MASPEEMGDDASEIPSPPKNTYKDPDGGRQRFLLELEFIQCLANPTYIHYLAQNRYFEDEAFIGYLKYLQYWQRPEYIKFIMYPHCLYFLELLQNPNFRTAMAHPANKELAHRQQFYYWKNYRNNRLKHILPRPLPEPVPPQPPVAPSTSLPPAPSATAALSPALSPMQYNNMLSKNDTRNMGATGIDRRKRKKGI

SEQ ID NO: 15726 - protein, 571 aa, Arabidopsis thaliana
MGVWWIVLVVAVLTHTASAAVREYHWEVEYKYWSPDCKEGAVMTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSQNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 15727 - protein, 437 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 15728 - protein, 233 aa, Arabidopsis thaliana
MQRREFLELFEAALRAAKSVKGAESSPEVLRFVDAMNRLKEAPKSLVCDVVCKTSMGKGLGFFIDHKNPKIRSEGRILRDLWMKIHYASGREKSRDRETPVKIPTHSTMKKTGDSKRDKVHEILQSSLAKVATEVVDTEMKRRVMTVCDPWVVAVSVESAMSILFNMGDSNNPDLRRKVLIGEISGERLVKMEKDEMGSEKIQKEVQRIKERARFKEESRMKMLLASADMIMT

SEQ ID NO: 15729 - protein, 233 aa, Arabidopsis thaliana
MDILYVQPVNQECIIALEKVAESLELPCKYYNLGCLGIFPYYSKLKHESQCNFRPYSCPYAGSECAAVGDITFLVAHLRDDHKVDMHTGCTFNHRYVKSNPREVENATWMLTVFQCFGQYFCLHFEAFQLGMAPVYMAFLRFMGDEDDARNYTYSLEVGGSGRKQTWEGTPRSVRDSHRKVRDSHDGLIIQRNMALFFSGGDKKELKLRVTGRIWKEQQNPDSGVCITSMCSS

SEQ ID NO: 15730 - protein, 367 aa, Arabidopsis thaliana
MNMSNKRNQQPSYIADHFSSLDQVITSLREAGLESSNLILGIDFTKSNEWTGRYSFNRKSLHAIGKRQNPYEKAISIIGRTLSPFDEDDLIPCFGFGDVTTRDQYVFSFYPENKSCDGLENAVKRYREIVPHLKLSGPTSFAPVIDAAINIVEQNNMQYHVLVIIADGQVTRNPDVPLGRLSPQEEATMNSIMAASHYPLSIVLVGVGDGPWDTMKQFDDNIPHREFDNFQFVNFTKIMSEHKDAAKKEAAFALAALMEIPFQYKATLSLNRKPVRSSHQHHKPLPPPPEVIERDNAVRSVPNQMTETAEKSDRLAPSTVPVCPICLTNPKDMAFSCGHTTCKECGVVITTCPLCRQPITTRIRLYT

SEQ ID NO: 15731 - protein, 228 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 15732 - protein, 330 aa, Arabidopsis thaliana
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRMFGKQIRYASRKARADTRKRVKGRFVKSGETFEYDPSLVM

SEQ ID NO: 15733 - protein, 373 aa, Arabidopsis thaliana
MIPIAFVQSLANIEGIEKAFPFLKPLIEVKLLKSIIQGFLPGIALKIFLLFLPRILMQMSKFEGFVSTSSLERRAATRFYMFQFINVFLGSIVTGTAFQQLNSFLNQSANDIPKTIGVSIPMKATFFITYIMVDGWAGVAGEILRLKPLIIYHLKNSFLVRTEKDREEATDPGTIGFNTGEPQIQLYFLLGLVYAAVSPILLPFILVFFGLAFVVYRHQVINVYNQKYESAGKFWPDVHRRVVTALVVSQLLLMGLLSTKHASKSTPLLLVLPLLTIGFHKHCKNRYQPAFVTYPLQQEAMIKDTLDRIREPNLNLKAFLRDAYAHPEFRVGEDPEPEEKLESDMSPPDLVATKRWSWRNTPLPSKDSCREIP

SEQ ID NO: 15734 - protein, 376 aa, Arabidopsis thaliana
MMKRETLIEAGIIGGLAGAQVIYAGNSELLSQLLSLGIDPLLIVILCTFASVLLITPLAFLLERKLWPRSLSFKLKIKLVLVALAGVTLFQGLFLEGMKHTSASMATAMPNLCPAFIFVIAWAAGMEKVKLSCMYSRVKMGGTVLCVMGALIMSLMHSTTATLSSVKTIPIVPDEVVVDKDKILGCLYLLLAICGLSSSIVLQASILAEFPAPISMFSMVSLMGGITTVALQYALKGSMEMGSASVIGLGHLVGYAILGGLVSGGGLSFNAWVIKRKGPVIVSLFSPIATVVCVVVSAFTMEESFNLGRKRSHLSSFLFVFLCQISFAGMALMFGGLYFVLWAKGKEDCEEIDEMKQDDEESLLRTEFDLQKPLLL

SEQ ID NO: 15735 - protein, 589 aa, Arabidopsis thaliana
MAATCSLLASFLLCFALLSAVSFAADPFVSYDFRVSYLTASPLGVPQQVIAVNGQFPGPLLNATTNYNVVVNVFNHLDEPLLLTWPGIQMRRNSWQDGVLGTNCPIPPRWNFTYQFQVKDQIGSFFYSPSLNFQRASGGFGPIVINNRDIIPIPFPQPDGELIFIIGDWYTQDHKALRRALDSGKELGMPDGVLINGKGPYKYNSSVPDGIDYLTFHVEPGKTYRIRVHNVGISTSLNFRIQNHSLLLVETEGHYTSQANFTDFDVHVGQSYSFLVTMDQDATSDYYIVASARFVNETVWQRVTGVAILHYSNSKGPVSGPLPVPKTDVSSPWSAMSQPKTIRQNTSASGARPNPQGSFHYGQINITNTYILRSLPPTIINGALRATLNGISFVNPSTPVRLADRNKVKGAYKLDFPDRPFNRPLRLDRSMINATYKGFIQVVFQNNDTKIQSFHVDGYSFFVVGMDFGIWSEDKKGSYNNWDAISRSTIEVYPGGWTAVLISLDNVGVWNIRVENLDRWYLGEETYMRITNPEEDGKTEMDPPDNVLYCGALKNLQKEQHHSAATSILNGHLKLMLLMVLLASVFRFC

SEQ ID NO: 15736 - protein, 356 aa, Arabidopsis thaliana
MSARYWCHMCSQMVNPVIGAEIKCPFCQSGFVEEMSREINGGSSSSLREVQDPEIDFGTDRALSLWGPILLGMMSNPRRRRRFRRTEFGVDNDEVNVSDDVDGNDSVDIDRHHHRRHRHRQQGREIDLDREFESILRRRRRSSATILQLLQGIRAGIASEYESSDRDLLNQSAVVQGSTSLNQNRNNTSLSAIGDYFVGSSLDHLLEHLADNDSIRHGSLPARKEVVDNLPTVKISESLQCSICLDDFDKGSEAKEMPCKHKFHIRCIVPWLELHSSCPVCRYELPPDDETKVNPVRPRTRTLEINVSNENVEDDARNSNVSERRFSFPWPFSGLFSSSSSSSASASGSSHLGENS

SEQ ID NO: 15737 - protein, 409 aa, Arabidopsis thaliana
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 15738 - protein, 821 aa, Arabidopsis thaliana
MRGVFIVIVTCLVFLPDPLRAGVASIGSITPGFGGSQMNYINNDGIFLESNNSAFGFGFVTTQDSVTLFTLSIIHKSSTKLIWSANRASPVSNSDKFVFDDNGNVVMEGTEVWRLDNSGKNASRIELRDSGNLVVVSVDGTSIWESFDHPTDTLITNQAFKEGMKLTSSPSSSNMTYALEIKSGDMVLSVNSLTPQVYWSMANARERIINKDGGVVTSSSLLGNSWRFFDQKQVLLWQFVFSDNKDDNTTWIAVLGNNGVISFSNLGSGASAADSSTKIPSDLCGTPEPCGPYYVCSGSKVCGCVSGLSRARSDCKTGITSPCKKTKDNATLPLQLVSAGDGVDYFALGYAPPFSKKTDLDSCKEFCHNNCSCLGLFFQNSSGNCFLFDYIGSFKTSGNGGSGFVSYIKIASTGSGGGDNGEDDGKHFPYVVIIVVVTVFIIAVLIFVAFRIHKRKKMILEAPQESSEEDNFLENLSGMPIRFAYKDLQSATNNFSVKLGQGGFGSVYEGTLPDGSRLAVKKLEGIGQGKKEFRAEVSIIGSIHHLHLVRLRGFCAEGAHRLLAYEFLSKGSLERWIFRKKDGDVLLDWDTRFNIALGTAKGLAYLHEDCDARIVHCDIKPENILLDDNFNAKVSDFGLAKLMTREQSHVFTTMRGTRGYLAPEWITNYAISEKSDVYSYGMVLLELIGGRKNYDPSETSEKCHFPSFAFKKMEEGKLMDIVDGKMKNVDVTDERVQRAMKTALWCIQEDMQTRPSMSKVVQMLEGVFPVVQPPSSSTMGSRLYSSFFKSISEDGGATTSSGPSDCNSENYLSAVRLSGPR

SEQ ID NO: 15739 - protein, 549 aa, Arabidopsis thaliana
MCWWLNGAVWTMMMMTISIISFVQADDPYRFFDWRVTYGNISPLGIPQRGILINGQYPGPDIYSVTNDNLIINVHNDLDEPFLLSWNGVQLRKNSYQDGVYGTTCPIPPGKNYTYAIQVKDQIGSFFYFPSLAVHKAAGGFGGFRILSRPRIPVPFPEPAGDFTFLIGDWFKHDHKVLKAILDRGHKLPLPQGVLINGQGVSYMSSITVHKGKTYRFRISNVGLQHTLNFRIQGHQMKLVEVEGTHTVQSMYTSLDIHVGQSYSVLVTMDQPDQDYDIVVSTKFVAKKLLVSSTIHYSNSRHSHSSSANSVHVQQPADELDWSIKQARSIRTNLTASGPRPNPQGSYHYGRIKISRTLILESSAALVKRKQRYAINGVSFVPGDTPLKLADYFKIKGVFKMGSIPDKPRRGRGMRMETSVMGAHHRDFLEIIFQNREKIVQSYHLDGYSFWVVGTDRGTWSKASRREYNLRDAISRSTTQVYPESWTAVYVALDNVGMWNLRSEYWARQYLGQQFYLRVYSPTHSLRDEYLLPKNALLCGRASNKHTTP

SEQ ID NO: 15740 - protein, 183 aa, Arabidopsis thaliana
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 15741 - protein, 742 aa, Arabidopsis thaliana
MAKKDSVLEAGWSVMEAGVAKLQKILEEVPDEPPFDPVQRMQLYTTVHNLCTQKPPNDYSQQIYDRYGGVYVDYNKQTVLPAIREKHGEYMLRELVKRWANQKILVRWLSHFFEYLDRFYTRRGSHPTLSAVGFISFRDLVYQELQSKAKDAVLALIHKEREGEQIDRALLKNVIDVYCGNGMGELVKYEEDFESFLLEDSASYYSRNASRWNQENSCPDYMIKAEESLRLEKERVTNYLHSTTEPKLVAKVQNELLVVVAKQLIENEHSGCRALLRDDKMDDLARMYRLYHPIPQGLDPVADLFKQHITVEGSALIKQATEAATDKAASTSGLKVQDQVLIRQLIDLHDKFMVYVDECFQKHSLFHKALKEAFEVFCNKTVAGVSSAEILATYCDNILKTGGGIEKLENEDLELTLEKVVKLLVYISDKDLFAEFFRKKQARRLLFDRNGNDYHERSLLTKFKELLGAQFTSKMEGMLTDMTLAKEHQTNFVEFLSVNKTKKLGMDFTVTVLTTGFWPSYKTTDLNLPIEMVNCVEAFKAYYGTKTNSRRLSWIYSLGTCQLAGKFDKKTIEIVVTTYQAAVLLLFNNTERLSYTEILEQLNLGHEDLARLLHSLSCLKYKILIKEPMSRNISNTDTFEFNSKFTDKMRRIRVPLPPMDERKKIVEDVDKDRRYAIDAALVRIMKSRKVLGHQQLVSECVEHLSKMFKPDIKMIKKRIEDLISRDYLERDTDNPNTFKYLA

SEQ ID NO: 15742 - protein, 1062 aa, Arabidopsis thaliana
MAGNEWINGYLEAILDSQAQGIEETQQKPQASVNLREGDGQYFNPTKYFVEEVVTGVDETDLHRTWLKVVATRNSRERNSRLENMCWRIWHLTRKKKQLEWEDSQRIANRRLEREQGRRDATEDLSEDLSEGEKGDGLGEIVQPETPRRQLQRNLSNLEIWSDDKKENRLYVVLISLHGLVRGENMELGSDSDTGGQVKYVVELARALARMPGVYRVDLFTRQICSSEVDWSYAEPTEMLTTAEDCDGDETGESSGAYIIRIPFGPRDKYLNKEILWPFVQEFVDGALAHILNMSKVLGEQIGKGKPVWPYVIHGHYADAGDSAALLSGALNVPMVLTGHSLGRNKLEQLLKQGRQSKEDINSTYKIKRRIEAEELSLDAAELVITSTRQEIDEQWGLYDGFDVKLEKVLRARARRGVNCHGRFMPRMAVIPPGMDFTNVEVQEDTPEGDGDLASLVGGTEGSSPKAVPTIWSEVMRFFTNPHKPMILALSRPDPKKNITTLLKAFGECRPLRELANLTLIMGNRDDIDELSSGNASVLTTVLKLIDKYDLYGSVAYPKHHKQSDVPDIYRLAANTKGVFINPALVEPFGLTLIEAAAHGLPMVATKNGGPVDIHRALHNGLLVDPHDQEAIANALLKLVSEKNLWHECRINGWKNIHLFSWPEHCRTYLTRIAACRMRHPQWQTDADEVAAQDDEFSLNDSLKDVQDMSLRLSMDGDKPSLNGSLEPNSADPVKQIMSRMRTPEIKSKPELQGKKQSDNLGSKYPVLRRRERLVVLAVDCYDNEGAPDEKAMVPMIQNIIKAVRSDPQMAKNSGFAISTSMPLDELTRFLKSAKIQVSEFDTLICSSGSEVYYPGGEEGKLLPDPDYSSHIDYRWGMEGLKNTVWKLMNTTAVGGEARNKGSPSLIQEDQASSNSHCVAYMIKDRSKVMRVDDLRQKLRLRGLRCHPMYCRNSTRMQIVPLLASRSQALRYLFVRWRLNVANMYVVVGDRGDTDYEELISGTHKTVIVKGLVTLGSDALLRSTDLRDDIVPSESPFIGFLKVDSPVKEITDIFKQLSKATA

SEQ ID NO: 15743 - protein, 357 aa, Arabidopsis thaliana
MSEGQKFQLGTIGALSLSVVSSVSIVICNKALISTLGFTFATTLTSWHLLVTFCSLHVALWMKMFEHKPFDPRAVMGFGILNGISIGLLNLSLGFNSVGFYQMTKLAIIPCTVLLETLFFRKKFSRKIQFSLTILLLGVGIATVTDLQLNMLGSVLSLLAVVTTCVAQIMTNTIQKKFKVSSTQLLYQSCPYQAITLFVTGPFLDGLLTNQNVFAFKYTSQVVFFIVLSCLISVSVNFSTFLVIGKTSPVTYQVLGHLKTCLVLAFGYVLLRDPFDWRNILGILVAVIGMVVYSYYCSIETQQKASETSTQLPQMKESEKDPLIAAENGSGVLSDGGGGVQQKTVAPVWNSNKDFQA

SEQ ID NO: 15744 - protein, 375 aa, Arabidopsis thaliana
MATLGDIGVAAAINILTAIIFLLAFAILRIQPFNDRVYFPKWYLKGIRSSPLHSGALVSKFVNVNLGSYLRFLNWMPAALKMPEPELIDHAGLDSAVYLRIYLIGLKIFVPIALLAWSILVPVNWTSHGLQLAKLRNVTSSDIDKLSISNIENGSDRFWTHLVMAYAFTFWTCYVLMKEYEKVAAMRLAFLQNEQRRPDQFTVLVRNVPADPDESISDSVEHFFLVNHPDHYLTHQVVYNANDLAALVEQKKSTQNWLDYYQLKYTRNQEHKPRIKTGFLGLWGKKVDAIDHYIAEIEKLNEQIMEERKKVKKDDTSVMPAAFVSFKTRWGAAVSAQTQQSSDPTEWLTEWAPEAREVFWSNLAIPYVSLTHRRH

SEQ ID NO: 15745 - protein, 251 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 15746 - protein, 494 aa, Arabidopsis thaliana
MGQRNRNVDLEMEQQQSQASLQAEPCILLGSFPQQPDNNNMPAMVAHVPNLEPHSLQDPTYDNSAMFYGLPQYHHHPHQRVPTNFYVPYVAFQAPPGQLPSSSSHGVVGVSPDHEYERNAHFMDHTRGTYKRKNAEGIPGQPQYLSTLAAPFNTPETIAPFGGARNRPGAVTVNTVLPSHAPNNFIQGNYAGHHPFPPPGSMWYDQHHGRSDGSPSFWPTPYMHGSNIFAGSIESSSRNPTSFMYPSQLNPRDHYYSHHHHPAPPPVQGMRGQNATLYPHTASSASYRVPPGSFTPQNTMNSGPLGSEMGSSHMGPVQPTGFRIYQHHQRDDSVPVATLRQHRGGVPRLRVMPDDEVALLEFGDFLGGSGNNHIDHHRDMRLDIEEMSYEELLALSERIGTVNTGLPEEDVKNHLKTRTCSGINFEKESSSPRTKDLETEPCTICQESFKNEEKIATLDCGHEYHAECLEKWLIVKNVCPICKSEALVMEKRKV

SEQ ID NO: 15747 - protein, 448 aa, Arabidopsis thaliana
MNRALVLLLYVCTVSCLASSKVILMRNNITLSFDDIEANFAPSVKGTGEIGVVYVAEPLDACQNLMNKPEQSSNETSPFVLIVRGGCSFEEKVRKAQRAGFKAAIIYDNEDRGTLIAMAGNSGGIRIHAVFVTKETGEVLKEYAGFPDTKVWLIPSFENSAWSIMAVSFISLLAMSAVLATCFFVRRHRIRRRTSRSSRVREFHGMSRRLVKAMPSLIFSSFHEDNTTAFTCAICLEDYTVGDKLRLLPCCHKFHAACVDSWLTSWRTFCPVCKRDARTSTGEPPASESTPLLSSAASSFTSSSLHSSVRSSALLIGPSLGSLPTSISFSPAYASSSYIRQSFQSSSNRRSPPISVSRSSVDLRQQAASPSPSPSQRSYISHMASPQSLGYPTISPFNTRYMSPYRPSPSNASPAMAGSSNYPLNPLRYSESAGTFSPYASANSLPDC

SEQ ID NO: 15748 - protein, 837 aa, Arabidopsis thaliana
MEGSSNSNSRGFNTSGVSDRNTEFLPVERLTTRSKPSSHVDEYVRSLFGSTSTHKSGEDDSLGIDPFVRSLEWGDVSLRQWLDKPERSVDVFECLHVFRQIVEIVNAAHSQGIVVHNVRPSCFVMSSFNHVSFIESASCSDSGSDSLEDGPISQKEIGSSRREEAVSKAIAIEEKGVYNKLLERKIEKLEEEKTQPFPMKHILAMETSWYTSPEEDFGSSSTCASDVYRLGVLLFELFCPVPSREEKSRTMSSLRHRVLPPQILLKCPKEASFCLWLLHPEPTCRPSMSDLLQSEFITEPRDNLEEREAAIELRDRIEEQESLLEFLLLIQQRKQESAYRLQDTVSLLSSDIEQVVKRQLILKKRGSSLSDFSKDDHQYTSGQPLMSFQANEEPSAFLASRKRVRQGILALENGVEVDEESQGSTLLESSRLMRNFKKLESVYFLTRRRQMKAAASGKSLTRHSPLSSENGRGSMIVSEKSSVSNPVAPKAFFNNDSRQGGWIDPFLEGLCRYLSFSQLRVKADLKQGDLLNSSNLVCALAFDREGELFATAGVNKKIKIFECNSIVNDNRDIHYPVVELAGRSKLSSLCWNSYIKSQIASSNFDGVVQIWDVARSQLVTEMKEHKKRVWSIDISSADPTLLASGSDDGTGVSIGTIKTKANVCCVQFPSDSGRSLAFGSADHKVYYYDLRNPKIPLCTMIGHSKTVSYVKFVDSSTLVSSSTDNTLKLWDLSMSASGINESPLHSFTGHTNLKNFVGLSVSDGYIATGSETNEVFVYHKAFPMPVMSYMFNNTDSMSGLEVDDASQFISSICWRGQSSTLVAANSNGNIKILEMMT

SEQ ID NO: 15749 - protein, 568 aa, Arabidopsis thaliana
MDTARAWLKKLKSKGKEKSSNKKETSRGNVKEGSKTAGGEEAVSNVTKQKAAAAKQYIENHYKKQVQSQQQRKERRDMLENKLAAAEVSEEEQKNLLKDLEKKETEYMRRQRHKMGTDDFEPLTMIGKGAFGEVRICREKTTGNVYAMKKLKKSEMLRRGQVEHVKAERNLLAEVDSNCIVKLYCSFQDEEYLYLIMEYLPGGDMMTLLMRKDTLTEDEARFYVGETVLAIESIHKHNYIHRDIKPDNLLLDRSGHMKLSDFGLCKPLDCSILQEKDFVVAHNLSGALQSDGRPVAPRRTRSQMEQLQNWQRNRRMLAYSTVGTPDYIAPEVLLKKGYGMECDWWSLGAIMYEMLVGFPPFYSDEPMTTCRKIVNWKNYLKFPDEVRLSPEAKDLICRLLCNVEQRIGTKGANEIKEHPWFSGVEWEKLYQMKAAFIPQVNDELDTQNFEKFEETDKQVPKTPKSGPWRKMLSSKDINFVGYTYKNVEIVNHDQLPGIAELKKKSTKPKRPSIKSLFEDESASSTTSHQGSFMKLLPTQIEVPEKEDKSSSSSETLSSSTTRFDNATS

SEQ ID NO: 15750 - protein, 808 aa, Arabidopsis thaliana
MANAERVITRVHSQRERLDATLVAQKNEVFALLSRVEAKGKGILQHHQIIAEFEAMPLETQKKLKGGAFFEFLRSAQEAIVLPPFVALAVRPRPGVWEYVRVNLHDLVVEELQASEYLQFKEELVDGIKNGNFTLELDFEPFNAAFPRPTLNKYIGDGVEFLNRHLSAKLFHDKESLHPLLKFLRLHSHEGKTLMLNNRIQNLNTLQHNLRKAEEYLMELKPETLYSEFEHKFQEIGLERGWGDTAERVLNMIRLLLDLLEAPDPCTLENFLGRIPMVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 15751 - protein, 437 aa, Arabidopsis thaliana
MVIMKKMKDSVLFLVVGLFSLSVLVSQSIAGRVKAPLLQSNTGGLVFSKSFNSIYDTSMYGRLQLNNGLARTPQMGWNSWNFFACNINETVIKETADALVSSGLADLGYIHVNIDDCWSNLLRDSEGQLVPHPETFPSGIKLLADYVHSKGLKLGIYSDAGVFTCEVHPGSLFHEVDDADIFASWGVDYLKYDNCFNLGIKPIERYPPMRDALNATGRSIFYSLCEWGVDDPALWAKEVGNSWRTTDDINDTWASMTTIADLNNKWAAYAGPGGWNDPDMLEIGNGGMTYEEYRGHFSIWALMKAPLLIGCDVRNMTAETLEILSNKEIIAVNQDPLGVQGRKIQANGENDCQQVWSGPLSGDRMVVALWNRCSEPATITASWDMIGLESTISVSVRDLWQHKDVTENTSGSFEAQVDAHDCHMYVLTPQTVSHSDV

SEQ ID NO: 15752 - protein, 436 aa, Arabidopsis thaliana
MGEELADTMNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 15753 - protein, 332 aa, Arabidopsis thaliana
MGFDLKEIRTKKTLIGLGLGQLLSLLATSNGFTSSELARKGINVPTSQCFLNYVLLAIVYGSIMLYRRSDIKAKWYYYFLLAFVDVEANFLVVKAYQYTSLTSVMLLDCWAIPCVLVLTWFYLKTKYRLMKISGVFICIVGVFMVVFSDVHAGDRAGGSNPVKGDFLVLAGATLYAVSNTSEEFLVKNADTVELMTFLGFFGAIISAIQVSILERDELKAIHWSTGAVFPFLRFTLTMFLFYPLVPVLLKTNGATMFNLSLLTSDMWAVLIRTFGYHEKVDWLYFLAFATTATGLIIYSMKEKDQEEHRFEEVGDEAAMQRKLLGEDDEPGT

SEQ ID NO: 15754 - protein, 339 aa, Arabidopsis thaliana
MVCFNFNEMKTKKTLIGLGLGQIISLLSTLIASIASEIARKGISAPTSQTFLGYVSLAIVYGGIMLYRRSAIKVKWYHYFLLAVVDVEANFLVVKAFQNTSMTSIMLLDCWAIPCVLVLTWVFLKTRYRLMKISGVVICIVGVVMVVFSDVHAGDRAGGSNPVKGDFLVIAGATLYAVSNVTEEFLVKNADVTELMAFLGLFGAIIAAIQISIFERGAVRAIQWSTEAILLYIGGALGLFLFYTLITILIKNNGSTMFNLSLLTSDMWAILIRTFGYHEKVDWLYFLAFATTATGLIIYSMKEKDEEEQRSGEVVSERRKLFDEEDGDSLHSNLIDAST

SEQ ID NO: 15755 - protein, 742 aa, Pisum sativum
MSERKTIDLDQGWDFMLKGIKKLKNILEGLPEPQFTSDDYMMLYTTIYNMCTQKPPHDYSQPLYDKYKESFEEYIISTVLPSLREKHDEFMLRELVRRWANHKIMVRWLSRFFHYLDRYFIARRSLPPLNEVGLTCFRDLVYKEINGKVRDAVISLIDQEREGEQIDRALLKNVLDIFVEIGMGQMDQYDNDFEAAMLKDTSAYYSRKASNWILEDSCPDYMLKAEECLKREKDRVAHYLHSSSESKLLEKVQHELLSVYANQLLEKEHSGCHSLLTDDKVEDLSRMFRLFSKIPRGLEPVSCIFKQHVTAEGTALVKLAEDAASNRKAEKRDIVGLQEQIFVRKVIELHDKYLAYVSDCFQNHTLFHKALKEAFEIFCNKGVAGSSSAELLATFCDNILKKGGSEKLSDEAIEDTFEKVVKLLAYISDKDLFAEFYRKKLARRLLFDKSANDDHERSILTKLKQQCGGQFTSKMEGMVTDLTLAKENQTSFEEYLSNNPNIDPGIDLTVTVLTTGFGPSYKSFDLNLPAEMVRCVEVFKEFYQTKTKHRKLTWIYSLGTCNVSGKFEPKTMELVVTTYQASALLLFNSSDRLSYSEIMTQLNLTDDDVVRLLHSLSCAKYKILTKEPSTKTISPTDHFEFNSKFTDKMRRIKIPLPPVDEKKKVIEDVDKDRRYAIDASIVRIMKSRKVLSYQQLVMECVEQLGRMFKPDVKAIKKRIEDLISRDYLERDRDNANLFKYLA

SEQ ID NO: 15756 - protein, 574 aa, Pisum sativum
MVPKLIIITCKQPPTSIPSFNISSIKTKEKPQTTQTQTLKTTTTKTKTSPPPPPPPTTTTNKKTETSLPGLLFNTFDDIINNFIDPPIKPALDPKHVLSQNFAPVLTELPPTQCQIIQGTLPPSLNGAYIRNGPNPQFLPRGPYHLFDGDGMLHAIKISNGEATLCSRYVKTYKYKTENEAGYPLFPNVFSGFNSLIASAARGSITAARVFTGQYNPSNGIGLANTSLALFGNRLFALGESDLPYEINLTPNGDIQTIGRYDFNGKLSMSMTAHPKIDADTGEAFAFRYGPIPPFLTYFRFDSNGVKHNDVPVFSMTTPSFLHDFAITKKYAVFADIQLGMNPLDMISGGSPVGSDPSKIPRIGILPRYANDEKKMKWFNVPGFNIVHAINAWDEEDGKTVTLIAPNILSVEHTMERLDLVHAMIEKVKINVETGIVSRQPLSARNLDFAVINSDFMGKRNRFVYAAIGNPMPKISGVVKIDVLKGEEVGCRMFGEGCYGGEPFFVAREGGVEEDDGYLVSYMHDEKKGESRFLVMDAKSPEFDIVAEVKLPRRVPYGFHGLFVRESDIRKLSL

SEQ ID NO: 15757 - protein, 383 aa, Triticum aestivum
MGSSCSRPHSVNEAEAADNTRSADIDRRILQETKADQHVHKLLLLGAGESGKSTIFKQIKLLFRTGFDEAELKGYTPVIHANVFQTIKILYDGAKELAQLETESSKNVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAAIFCAAISEYDQLLFEDGTQNRMMETKELFDWVLKQRCFEKTSFMLFLNKFDIFEREIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 15758 - protein, 390 aa, Triticum aestivum
MGSSCSRPHSVNEAEAADNTRSADIDRRILQETKADQHVHKLLLLGAGESGKSTIFKQIKLLFRTGFDEAELKGYTPVIHANVFQTIKVCQYWERILYDGAKELAQLETESLKHVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDLVLKQRCFEKTSFMLFLNKFDIFERKIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 15759 - protein, 168 aa, Zea mays
EGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 15760 - protein, 816 aa, Oncidium cv. 'Goldiana'
  unsure (1)..(816): unsure at all Xaa locations
MADNRFLSRVHSARERLGDTLSAHKNELLALFSRFVKQGKVMLLPHQILAEYESVIPEADRQKLKDGVFEDVLKAAQEAIVVPPWVALAIRPRPGVWEYVRVNVSELAVEELSVPGYLQFKEELVDGRSQSNFTLELDFEPFNASFPRPLLSKSIGNGVQFLNRHLSSKLFHDKESMYPLLNFLRHHHYNGMSMMLNDRIQSLSALQASLRKAEAHLLGIPQDTPYSEFNHRFQELGLEKGWGDTAGRVHEAIHLLLDLLEAPDPSTLENFLGRVPMMFNVVILSPHGYFAQANVLGYPDTGGQVVYILDQVRALENEMLLRIKKQGLDITPRILIVTRLLPDAVGTTCGQHLEKVIGTEHTHILRVPFRXEKGXIRKWISRFEVWPYLETYADDVANELARELQATPDLIVGNYSDGNLVASLLAHKLGVTQCTIAHALEKTKYPNSDIYWKKFEDQYHFSCQFTADLIAMNHADFIITSTFQEIAGSKDTVGQYESHTAFTLPGLYRVVHGIDVFDPKFNIVSPGADMSIYFSYAEESQRLTALHPEIEELLFSEVENSEHKCVLKDKNKPIIFSMARLDRVKNITGLVELYGKNPRLRELVNLVVVAGDHAKASKDLEEQEEMKKMYRFIEEYKLDGHIRWISAQMNRVRNGELYRYIADKRGVFVQPAFYEAFGLTVVESMTCGLPTFATVHGGPGEIIVDGVSGFHIDPYQGDKAAELLVNFFEKCNEDPGYWEKISSGAIKRIEEKYTWKLYSERLMTLSGVYGFWKYVSNLDRRETKRYLEMFYALKYRNLAQSVPLHSDEEVVVNGAK

SEQ ID NO: 15761 - protein, 816 aa, x Mokara cv. 'Yellow'
MADHRTLTRIHSIRERLADTLSSHPNELLALFSRFVKQGKGMLLPHQILAEYESVIPEADREKLKGGVFEDVVKAAQEAIVIPPWVALAIRPRPGVWEYVRINVSELAVEELSVPRYLQFKEDLVNGRSESNFVLELDFEPFNASFPRPSLSKSIGNGVQFLNRHLSSKLFQDKESMYPLLNFLKTHNYNGMSIMLNDRIQSLSALRSALRKAEQYLMSVPQDTPYSEFNHRFQELGLEKGWGDTAGRVQETIHLLLDLLEAPDPNTLENFLGAVPMVFNVVILSPHGYFAQDNVLGYPDTGGQVVYILDQVRALENEMLLRIKKQGLDITPHILIVTRLLPDAVGTTCGQRLEKVIGTEHTNILRVPFRTEKGILRKWISRFEVWPYLETYADDVAKELVMELQATPDLIIGNYSDGNLVASLLAQKLGITQCTIAHALEKTKYPNSDIYWKKSDEQYHFSCQFTADLIAMNHADFIITSTFQEIAGSKDTVGQYESHTAFTMPGLYRVVHGIDVFDPKFNIVSPGADMSIYFSYSEKNKRLTALHPELEELLFSDVENSEHKCVLNDKSKPIIFSMARLDRVKNITGLVEFYGKNPRLRELVNLVVVAGDHAKASKDLEEQAEMNKMYSLIEQYKLDGHIRWISAQMNRVRNGELYRYIADKKGVFVQPAFYEAFGLTVVESMTCGLPTFATVNGGPAEIIVHGVSGFHIDPYQGDKAAELLVNFFEKCEEDPTYWEKISKGAMKRIEEKYTWKLYSERLMTLAGVYGFWKYVSNLDRRETKRYLEMFYALKYRKLAESVPLHHDEEVVPNSTG

SEQ ID NO: 15762 - protein, 509 aa, Equus caballus
  unsure (1)..(509): unsure at all Xaa locations
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNALAVLGGSLMGLADTAASYEMLILGRFLIGAYSGLTSGLVPMYVGEIAPTHLRGALGTLNQLAIVIGILIAQVLGLESMLGTATLWPLLLGITVLPALLQLVLLPFCPESPRYLYISRNLEGPARKSLKRLTGWADVSGVLAELKEEKRKLERERPLSLLQLLGSRVHRQPLVIAVVLQLSQQLSGINAVFYYSTSIFEKAGVGQPAYATIGAGVVNTVFTLVSVFLVERAGRRTLHLLGLAGMCGCAILMTVALLLLERVPAMSYVSIVAIFGFVAFFEIGPGPIPWFIVAELFSQGPRPAAMAVAGFSNWTCNFIIGMGFQYVADAMGPYVFLLFAVLLLGFFIFTFLRVPETRGRTFDQISAAFHRTPSLLEQEVKPSTELEYLGPDEXD

SEQ ID NO: 15763 - protein, 1041 aa, Catharanthus roseus
MQDLRKTTRDQCDNFWLRTLKMCWCVHFGVALSCQVPKCCGKVWRYQKQKSVEEQPLNQQPQLLQHFHQQQIQNTSRSTGKWWKTLLVVFVLAGIFGSMWLFWYLSEDSKLRRKETLASMCDERARMLQDQFNVSLNHVHALAILVSTFYHGKEPWALDQQTFEDYTEKTAFERPLTSGVAYALRVLHSEREKFEKQQGWIIRKMDTEVQTLGQDLVPEKLEPAPVQTEYAPVIFAQKTVSHIVSIDMMSGKEDRENILRARASGKGVLTSPFKLLKSNHLGVVLTFAVYNTDLPPEATREQRINATVGYLGASYDVPSLVEKLLHQLASKQTIAVNVYDTTDKSAPIKMYGDAANDTGLPRISQLDFGDPSRKHEMHCRFKQKPPPPWTAIIASVGVLVITLLLGHIFHAAINRIAKVERDYREMMALKHRAEAADIAKSQFLATVSHEIRTPMVGVLGMLQMLMGTNLDVKQLDYAETAHASGKDLISLINEVLDQAKIESGRLELEAVPFDLRADLDKVVSLLSGKSHEKDIELAVYVSDQVPEVVIGDPGRFRQIITNLVGNSIKFTKDKGHIFVSVHLADEVKSPLDIKDEVLKQSLTLIQDRSTASFNTLSGFPVVDRWRSWEKFKNLSGMPEESKKIKLLVTVEDTGDGIVYDAQDRIFTPFVQADSSTSRKYGGTGIGLSISKRLVDLVGGEIGFVSEPGTGSTFSFTAAFTKAETITGITKWEQYDLAVSEFRGLKALVVDEKSIRAEVTRYQLKRLEVSVDIASTVEAAYSHLSADVNSSASERVSMVLIDEDSWDNEIMARYVGCLKKSDQTASRPSMGMNPKIFLLANPKSFSDCIELKSTGLVDNVLTKPLRLSILISCLQESIGFGRTRQVTRSNPSTIGNLLKGKRMLVVDDNPVNRKVAELALRKYGAVVTCEASGEAALQRLKPPHDFDACFMDLQMPEMDGFEATQKIRHLEREYNENVKSGEIGTDKSTDEAYWHTPILAMTADLIQATNEKCRKCGMDGYVSKPFDDEQLYSAVAPFFKSG

SEQ ID NO: 15764 - protein, 420 aa, Saccharomycetales
  unsure (1)..(420): unsure at all Xaa locations
KIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTXAXKDVYNFLELFFDXFPEYVNKGQDFHIAGESYAHGYIPVFAXEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDELNQDYVKEAVGAEVDHYESCNFDINRNFLFAGDWMKPYHTAVTDLLNQDLPILVYAGDKDFINNTLGNKAWTDVLPWKYDEEFASQKVRCWTASITDEVAGEVKSYKHFTYLRVFNGGHMVPFDVPENALSMVNEWIHGDFSL

SEQ ID NO: 15765 - protein, 102 aa, Homo sapiens [sequence omitted]

SEQ ID NO: 15766 - protein, 102 aa, Physarum polycephalum
SGRGKGGKGLGKGGAKRHRKVLRDBIZGITKPAIRRLARRGGVKRISBTIYZZTRGVLKVFLENVIRDAVTYTEHARRKTVTAMDVVYALKRQGRTLYGFGG

SEQ ID NO: 15767 - protein, 355 aa, Homo sapiens [sequence omitted]

SEQ ID NO: 15768 - protein, 270 aa, Ferroplasma acidarmanus
MGINMVKLGNKEVSSIGLGTYGMGGKNSPDYKNDAKEVEAIKYAITNGMNLIDTAEYYGHGHSEELVGKAIKDFEREDLFIISKVWPVNLHYKDVINSAKESLKRLDTDYIDLYLIHWPNPKIPVKETLGAMGELLDSHLIRNIGVSNFDIANLTEAIDQLKHGKIIANEVEYNLENYYIEDDLIPFCEKNNIKIIGYSPLNQGRISSKINHVAKSLGMSSIQCTLGYLKKKSIPIPKASSISHINELVECMNIDLDENEYNRIKEAVRR

SEQ ID NO: 15769 - protein, 258 aa, Ferroplasma acidarmanus
MYNDLKGKNVLVTGGTKGIGKAISLGFAVEGARVISISRHTPEDTDDRITYYNCDVSSSNDVKSTIENILSKFNTIDILVNNAGIEEYASLDKTDEGMWDRIMDINVKGVYNVSKYCIQEMIKNHGGNIINISSVQANIITKNAAAYVTSKHAIIGLTKSIALDYAPEIRCNAVLPATIDTPLVRKAAILEVGNNEEKIKEKIREWGLQHPLGRIGKPEEVANTVLFLASNQSSFITGASIMVDGGLSIKAPISTPDE

SEQ ID NO: 15770 - protein, 277 aa, Ferroplasma acidarmanus
MFKENLLKDKNILITGGGTGLGKQMTETFLKLGATVSIISRKEEHLTAAKEYFNNMGYKIEAVKCDIRNPDEIKNAVDLIESKTGKINVLINNAAGNFISRTEDLTPKAFDTVMGIVLHGTAYASLEMGKRWLSNSMKGTILSIVATYAWTGSGYVVPSAISKAGVLALTRSLAAEWGHKGIRTVAIAPGAFKTEGAWSRLLPGDDYEKQIISGNPERRLATKEEIANIAAFLISDMAAYINGEVVTADGGQALYGSSMFNMMESLPDDIWKMMRQR

SEQ ID NO: 15771 - protein, 257 aa, Ferroplasma acidarmanus
MMVEMYDIKDKVCIVTGSGRGIGKAIAIKLAQAGGKIVVNVRTHEDEGMQTLEEVNKASSGILSMADVSTEEGRKKLFRDAIEKLGKPDILINNAGVGILEPFENIDEKHMQLMFNTNLYSPVWLSREFVSKYDNGVIINMASLAGISPFPGLSVYGMTKAALISMTKYLSLEAAGHHIRVNAVAPGVVKTRMGDSLLKIMNLDEKNFSKKFTLTGKLIDPDEVADTVLYLIRNESMTGQVITIDSGGEQMATDYFR

SEQ ID NO: 15772 - protein, 493 aa, Ferroplasma acidarmanus
MKIYIDGTWKESSNGNTLNKYNPSTGEVLDTFPAATKDDIDAAMDSAESAFPSWSDMGTQERAKILYKAVELISQKRGELENLLTLEVGKIKREAIDEVDGVIDQIQYYAEFERKLTGDIVEGSSSKRKIFQYKVPYGIVVAITPWNFPAAMVVRKLAPALLTGNTVILKPSSDTPLTANWIVNKFIEAGIPKGVLNFVTGRGSEIGDYIVNHKKVGLVTMTGSTSTGQKIMQNASSNMAKLILELGGKAPFIVWKDADMIRALKSLIWAKYLNVGQSCIAAERLYIHEDIYDKFMSKFVAITKKLTTGDPDTSDVGPLINKNALAGMVQTVNNAKDSGYKILTGGNTPDLQGKYKNGYFFAPTIIENVPQDSGLFQDEIFGPIIGTEKISGVDEMYRKANDSKFGLASYLFTEDPELMLEASEKIRFGELYINMPGPEASQGYHTGFRMTGQAGEGSKYGINEYLKLKNVYVDYSKKALYINTINNSLFDNL

SEQ ID NO: 15773 - protein, 318 aa, Ferroplasma acidarmanus
MIEPAQWKVDKVNALTEELNESPVSAVISIKGLRNKEFQKIRSDIRGKVKIEVLRARLLRLALQKSNKKNIAGMTEHATGQIALITTSETPKTVYDMLVSKRTKAAARGGEIAEEDIIIEPKETSFPPGPMISVFQKAGIPAGIEKGKIVIKSEVTLVKKGEVISKEKAQVLEKLEILPVTVGLEMIAAYSDRLVYSRDALSITIEQIVSDMAGAFLKAKALALKADFLVPEIMPELLSKAYLQAQGLALAANFVDEKNIDIFIRKAVINATTLNSLINKDLNNENIENENPEESQTEDKKDEGSGDDAAAGLGSLFG

SEQ ID NO: 15774 - protein, 307 aa, Ferroplasma acidarmanus
MVKQMEHDFKIIDYIIKGNETHDGAGVKLKRIFGGPNTVQLTDPFLLLDHFGSDRIEDYIAGFPWHPHRGIETITYLLSGKVEHRDSTDHRGTIYPDELQWMTAGSGIFHEEMPKPLDEKNPEELIKAYGMPTLVSGFQLWLNLPAKYKMSTPAYRSIKGSEVPKIEIDGATLKIIAGEYNKVSGMYNSQYGIDPLYLDITMDEDSDFVYRVKDGYTSLIFSITGEGISNGQKLEPDTAAIMSRNGNFIKIHTGNSKYRFILLSGKPLNEPIKWYGPIVMNTDEQIREAISDLNNNNFVREKNPIVE

SEQ ID NO: 15775 - protein, 659 aa, Ferroplasma acidarmanus
MIKIRKYEEKLRDIYLSDKKPLFNIAAGKIPGEMHLSAGQEPSAAWMSVLLRNDDFVYSTHRPHHTAIAKGVDLNRMTAEIMGKHGGLSKGKGGHMHIFDKKVNFACAGIVGSSFPSALGAALASKLDGKDSIAVAFGGDGSLNQGMFLESLNLASLWKLPVIFVIENNDWAISVETKDSTPLKNDAIRADGFGMPGVYIENNDPVKMYKAAEKAVKRARSGEGPTLIAIDTYRYYGHFEGDPEVYRPKDQVKELLAKDPIKIMESDLLKKGIISKDEDDRINNSAMEEISQAFAFAEDSPLPVGSDSMDDVYAPVDYSIEPTTKGRKLPVYMAISEAISQEMEGNKDVLYMGEDVGKYGGIFGATTGLFKKFGAERIRDTPISESAFIGSAAGLAAAGKRPIVELMFSDFVGVTLDPIMNQIAKNHYMSGGTVNMPVVITTAVGGGYGDAAQHSQTLYSLFGHLPGLKVVVPSNSYDAKGLMVSAIKDNNPVVYMFHKGLLGLPWMPYPQSTVTEVPEEEYTVPIGKARIAREGKDITIIGIGATVHMAMEAAMELEENGINAEVIDLRSIKPLDTDTVIRSVGKTGSLLVADEDYAAFGLASEITSAVSHALFGKLDKAPESIVSPDVPVPYSQPMEKYWLPDTQKIVNRVMEMFKK

SEQ ID NO: 15776 - protein, 278 aa, Ferroplasma acidarmanus
MIYREFGNTSFKTSTIGMGTYYDMRWIFKTYLGIYSGRDQKIDAYRAGIDNGINLIDTAELYRTEKLVGTAIKSYKRDELFLASKVFPTHLSPKSLEKALNRSLKNLDTDYIDLYQIHFPNPTVDIKKTLRTMEKMVDKGKIRHIGVSNFTLNLLKRAQGILSKYEITSIQINYNVFHRNSQKGMIDYCNKNHIAVMAYFPLGHGKVTQPQFNKYFDHVRKTIGDVPNANIALAYLISRNQNVFPIPRASNRAHVLQNAKNSDILLNEDDIKYLEKNL

SEQ ID NO: 15777 - protein, 417 aa, Ferroplasma acidarmanus
MNEHSLKSFRYIFGMNSVYLGNNYLWTSFESLFLPYVIELLVPSRLQTIYLGIIAFAGIIIGIAFNFLSGSFSDKFHSRYGRRRPMILIGSIIVIFSLLLFIIIKETIVTIFIIYILIEIGSNIAYGSYQPLIRDIIPESQRSTSSGVGGFFTLIGSAFGFGLSGVLIGTGRIELATVLILITIAAGSIITIFTIKREDYISNSEIIRRKLSGVIKNFKQSTKFKWMAIANFFITTGSSGLVFFEYYYFEYSLDLKDTAIYVAIAGVTILLISALSTVGIGILADKINKEIFLLIFPLISGFSILFISFIHAFYLFLVLGSLIGIAYGNYFTITNSYMSFIVPHGSAGKYLSIFLVSTEIGAAFSPLIYGLVLFLFRGMGSAEYSRLFELSSIFYFIGFALILLKVVNIQGTANGRA

SEQ ID NO: 15778 - protein, 372 aa, Ferroplasma acidarmanus
MKVAVVGWELPPAFSGGLGIHTSNIFSIIGKIVPTEIYLPDMGYSFPYYPFSIITVKITKGVAGGSYSQVTNFIDAVEDYNRNVIENFRPDGVSVIHCHDWITFRAGIDIKEKFGIPLVVTFHSTEYDRSAYFNPQGNIMKIEKEGAEKADAIITVSNSTKGVLVEKYGIDADKITTVYNGVKSSAYTQGVSYKRERMLLYFGRVTSQKGPKFFMEMADKVNQYEKNVKFVMAGTGDMIGEMESYAVNHGFREKVFFPGFVDFHKAIEYYKRSGVFVIPAVSEPFGITVLESMVSGSPVIMSKTTGVGEALNNVLKVDYWDTDVMSSYAISILNHKSLRETLSLYGKYEGMSFTWEKSAIKTMEVYRSIWKI

SEQ ID NO: 15779 - protein, 402 aa, Ferroplasma acidarmanus
MVESIEITDSRITKIFDSRGNPAIEATIILNYATGTSSAPAGASTGKTEVIAYPKNNIDNSVDFYNKHVRNALKGFNALNQSGFDTLLHELDGTDNFSEMGGNLATALSIANAKAVSNYLEIPLYRYVGGLHPQIPRPMGNIIGGGKHSKNGTTIQEFLVSSQGKTFYDSVYYNILVHRRVGEKLSEKLKGQSVGLGDEKAWTADVSDEEAIEIMKEAAGEISSENKVKIYLGVDFAADSFYNNGKYDYKTSKKTQDEQIDYAVSLNKEHGFYFIEDPLYDNDFEGFAEITKKIGEDSLIVGDDLYTTNSARIQKGIDMKSTNAVLIKVNQIGTLSDTVKSVKLATKNSMDTVVSHRSGETTDDFIAHLAVAFNSKFIKTGTIGGERLAKLNEVIRLEEDLI

SEQ ID NO: 15780 - protein, 318 aa, Ferroplasma acidarmanus
MMEKMDRMESLRDAYGKELASLGEKNKDIVVLDADLSSSTKTGVFGKKFPERFFNMGISEQSMVSAAAGLSLAGKTVFASTFAVFLSNTYNVIRQSICYNEAPVNFVVTHSGISLGEDGPTHQILEDVGIMSGLPNMKVIVPVDSIETVSVIDYLAARKTSPYYVRLTREKFPVLNDENYEFKEGKSVTFRDGSDVTIMGYGIMVSFALKAAEQLKNRGIDARVINMSSIKPLDRPAIIKAARETGKIVTAEEHSIYNGLGSRVAEVTSEEYPVPVMRIGMPDIFGKSGKGMELFDYFHIGVNDIVEKTDRFFKGDFK

SEQ ID NO: 15781 - protein, 459 aa, Ferroplasma acidarmanus
MVSRKMNPERKIYGTYSNRDFNNPVPEFEFPEEGMASRAAYEMIHEELKLDGIPELNLATFVTTYMEPEAKNLYMENAHKNFIDSFEYPQIKKEETRIVNILSRLYNAPEGKDFTGTSTIGSSESIMLALLAHKWNWKSKMEALKKDASKPNIVFGADTHVVWDKFAKYFDVEARVVPLDAKTRVVDPDKLIENVDENTIAVGAVLGTTFTGAFDDVKRINSLLEELKSKKGLDIPIHVDAASAGFITPFIEPELEWDFRLSHVKSINVSGHKFGLVYPGLGWLLFKDKADLPDDLVFYVNYLGDDMPTYTLNFSKSAANIAPQYYNIIRLGKSGYRNIAENIMKNAKYLADKISEFPELEVVSRAEHIPVVTFRQKTSSSYTLFDLSAAIRSYGWIVPAYSLPDNANDTVLMRVVVREGFSRDLADIFLENLKQSMEKLSGKGIEKSKISSRRGHAVS

SEQ ID NO: 15782 - protein, 497 aa, Ferroplasma acidarmanus
METYKMFIGGEWVESSENQVLKVLNPSTGLPVASVQSASRDDVGKAIDAARNSFDSGIWSRATPGDRSNVLLKVADLIEKNQDKFIKVETENSGKSIKQISGYDIPYTVDNIRFLAGACRTLEGKAMNEYVADGTSAIRREPIGAIGIITPWNYPLMMVVWRAFPALAMGNSVVVKPASYTPLTTLMLADILKEAGVPDGVFNVITGPGSSVGEEMAKSEKLDMIAFTGSTEVGKRLSVLAASNLKKVSLELGGKAPFIVFKDANIDAAVESAIVGGLVNNGQDCANSTRYYIQEEVFDKFVSLLKKRIQKLRIGDPMDPSTDMGPLISETQRERVEGYIEKGIKEGGKLLSGGERPEIPGHKKGYYINPALIYTENEDSAIVKEEIFGPVFTILKFKDYNDAIRRSNDVTYGLGSSVWTSDITTAMRATRDLRFGTVWVNEHVVVPSEMPWAGYKESGHGASLSPYSLEEFTYIKHVYFDLTGKVRKDWYDQIFKG

SEQ ID NO: 15783 - protein, 421 aa, Ferroplasma acidarmanus
MVNIKKLYPGLSPDVSEFAGKSIKNISDAYGTPVIVYNMARVRENIRRIRDAFNGINIKVHFAVKSNYNPYIVSQIIKEGTGIDAANYNEVKLAIMCGLGSRDIIATPNNLSGTELRTIKEEGVAINFDHEGQMGLLKGSLPETVSFRINPGIGKGEFPGITTGGKNVKFGISVDDAISAYSAAIKAGVKHFGIHMMTGSNVLEPEFFNESSGLFFKIAETISDRTGIDFDFIDIGGGFGVPYTSDEHALDIGKTAGYISDNFRASNNRGYFKDSRLIIEPGRYIVADSAILLSKVTSIKHSDRELIGIDASMNTLIRIPLYGARHGILLSGHGENTSSSRFDIVGQVCENTDYIAKDISIPEPAVGDIVVIADAGAYVASMASNYNLLSRPAELVLEGDREILTKGHDGLESMLAGYKMS

SEQ ID NO: 15784 - protein, 295 aa, Ferroplasma acidarmanus
MQGKVLYFMLLISVVVIWGATFPIMKLSLQYISPVMLLSFRFILSAALMLPIVFKNKMLIERKNVILGIVGGILLFLAYYTQTVGLEYTTSSQSGLITGMYVVLLPIISLLYLKIKLNKVDVIAVSIGFIGLILMSSLKFSSAYTFGDILTFFCAIFYGLQTAYVFKYTKYLDSMVFTFYQLLMVGVLSSIFVPFSWEPSGLLKPIVIFTIVFTALFASFFAILINTRVLQYIEPTAAGVIYVGEPVFAVISSILILKEIPTMDIILGGIIIVVAMLIETLHKYVETKNSINIPQ

SEQ ID NO: 15785 - protein, 299 aa, Ferroplasma acidarmanus
MWNMGKQGDILLFAIMVISWSINYPVIKIALNYTGPFTLLFYRILFSFIFIYIIFRPKLHLRITKDEIVPLFILSLLNVLIWMELWFLAETTISSSLTSIIIYTYPIISTLMAIIFLKEQYNKYVFLGIGIGFAGLLVIFSNSLLSGFKPGIIIALLGAIVWSVGTIYFMKYHVKKDRETTNFFQFGFALLPSLLIAGIATPSISIFEPSLLLILLVLIISIPGTAVAYFAFLHLNRKYGVSTISSFLFLVPALSVVFGVIILDEIPSSYEIIGLALVGIGIYFSARGTKIKASAKPVS

SEQ ID NO: 15786 - protein, 485 aa, Ferroplasma acidarmanus
MFREKFQNITEGYTFDDVLLKPLHSSIEPKNANVSSKFSRHISIGIPIVSSPMDTVTEESMAIAMARYGAIGVIHRNMSANEQVEMVKKVKKEESIIIRDVFSIASDTPVNVARTLMKTKNIAGLPVVASGKLIGILTKRDLEFSESEGTVKDIMTKDVITADENVSIEDAKFILYKNRVEKLPLVDSKGRLVGLITAKDIKTREKFPNASRDEQGQLMVGAAIGAYDIDRAINLENAGSDFLVIDTAHAHNKNVLSSLKKIRNAIHIDIIAGNIATAEAAEDLISLGVDGLRVGIGPGSICTTRIVAGVGIPQLTAISDVADVASEHGIPVIADGGIRYSGDMIKALAAGASTVMLGSLLAGTEESPGTEMIINGRKYKAYRGMGSIGAIKAGKSDRYEKLGTNEFIAEGVEGSVPYRGKVSENLFQFVGGIKTGMGYLGAENLEELKKKAVFIKITNSGLRESHPHDIRIVSEPPNYQNSGIY

SEQ ID NO: 15787 - protein, 787 aa, Ferroplasma acidarmanus
MTDRTSARILWFSEISKEDLPLVGGKSANLGEMVKMKTVPVPNGFSTTSYAYKEFIIENDLDDKIINIIKHTDIENSRKLKEASEEIRQLFLNAHFNASLGKEIREYYRKLIEKEKNVYVAVRSSATSEDLPDASFAGEQDTYLNIHGEDDVVQNIKACYASLFSPRAIYYREKKNFGHFNIYLAVAVQKQLFSEVSGVMFTVDVSTGDNSKIIIESSYGLGEYIVGGVVTPDTYYVDKSTMKITNKIITNKNKMLKCLETGGTEELVVEKEMANKQSLSDEEVIHLANYGLQLEKHYGNSMDVEWAKDSFDHKIYILQARFETVWNGNRVGEDKMQQEKEANENEVILKGLPASPGKVAGVAKVLLSVEEMDKFKEGDILVTKMTAPDWVPIMGKAKAIVTDEGGLTCHAAIISRELGVPCIVGTSSYGKKATEVLKDGETITIDAKNGLIYLGGITTGTEEKTPEQNVSYESDIITGTKVLVNMGEPQLSEKVSKLPSDGIGLMREEFIWAEIGEHPLSLIKNGRGEYFVDRLSSELAKVCRDFAPRPVVLRFSDFKSDEYKSLKGGKEFEPEEDNPLLGWRGASRYYDDRYKEAFKLELQGIKKARDDYLLKNLWVMIPFTRTVEELKRVVKIMEDNGLERTKDFKLFLMAEIPSNILLADKFNQYVDGYSIGSNDLTMLLLGSDRNNGKMSSMFDERDLAIKRAIRYLIKIAHRDGKIVSICGQAPSQYDEIVDFLVRSGIDDISVNPDAVTHVRKMVASVEKRIQLEAALGKVYSDPDWDLP

SEQ ID NO: 15788 - protein, 499 aa, Ferroplasma acidarmanus
MEKMEKIFGNIINGIEETGGERIELKSPVDGSLIGYIIDTDKDTVERAIQSSREAFNKFYLESTIKSRQELIGKLTDIVQEKATIYADLESKNTGKTIRQSTFMDIPLAISHIRYFAETDEFKFQRKITHPEYPGTEGIVQNAPMGVVASIAPWNVPFLMAVWKIIPPVLAGNAVVIKPSHYTPLTAIELVKDMKAAGFPDGLVNLVNGTGRTTGNLLVNSDHVDMVSFTGSTPTGSRIMEQAAKNIKKVSLELGGKSPNIVFADADLDHAVKGVIFGIFLNAGQLCESASRLIIEESIMDKFLQKVKTYLDSMKSGNPMDFETDISAITTKEQKEKIESLISQTVKSGGNIFYSKNMQGTPDKGTYFPPTLLTGLTPGQQISDEEIFGPVLTVYPFKSEKEAIDLANSTKYGLAAGIWTKDIEKAGRVASMIEAGTVWVNEYHLLSAAAPRGGFKKSGIGRELGLEGILEYTQTRHIFYGNNESGMSDVAYGILIKTE

SEQ ID NO: 15789 - protein, 261 aa, Ferroplasma acidarmanus
MHDLKNKNAIVCAGSTGIGKGVISVLAKYGANITTFSRTKENVESLKEEIRKETGVTVNAMCADLSKKDDLMRVVDSAHEQYGKIDFLVMNYGDPRVDPFMQLNESDWDYNIDMIFKSTIRMVDMCATDMIKSNSGRIIFITSMTTKNPLENFAISNSLRSGVVALGKTLSIELGKYNINVNSISQGYFYTRRLENIIKKNSVSSGKPVEEVESQLMKEIPLGRFGKPEEVGNLVAFLCSGMSSYITGINIPIDGGVIKSI

SEQ ID NO: 15790 - protein, 430 aa, Ferroplasma acidarmanus
MHRYPFQHRNFFKAKYYIHIIMTDNNGFLRLKWARDHMPVCANIRERFLKEKPFKGIKIAMALHVEAKTGIFALLLTEGGAEVRLASCNPLSSDDSVVQSLSKDYNYMVYAKKGESEKEYYENINKTIEAAPDIIIDDGGDLTNLVASKPELVKKVIGGNEETTTGVVRLKAMEKAGALKFPMFDVNDAQMKHFFDNRYGSGQSALDGFMNATNILIAGKNALVAGYGYVGKGVAMRLKGMGARVTVTEVDPVKAIEAVMDGFTVDTMNSAIRYCDLIFTATGMKNVVSYDDMLVAKKGIIMGNVGHFNNEIDYSSLEKKNIGKTPVRNLVTEYKLENGNTVNLISDGRLLNLAAGQGHPVEIMDLSFALQALTAEYIVKNKGKLSNKVYPVPAEIDTEVAKIALESLNFKIDTYTEEQLKYLDSYQEGT

SEQ ID NO: 15791 - protein, 225 aa, Rana temporaria
LERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKVAAKYNRTSADIAMRFILQKGIVVLAKSFTPARIKQNLGVFEFELKPEDMKSLESLDRNLHYGPFREVKQHPEYPFHDEY

SEQ ID NO: 15792 - protein, 402 aa, Vitis vinifera
MDPDAFTASLFKWDPRGAVAPPNRLLEAVAPPPPGAAAPAPVAAAYAIRPRELGGLEDLFQEYGVRYYTAAKIAELGFTVSTLLDMKDEELDDMMNSLCQIFRWDLLVGERYGIKAAVRAERRRLDEEESRRRHLLSADTANAIDALSQEGLSEEPVQQEKEAGGSGGVGTWEVVVAGERKKQQRRKKGKTRMGSADDNMNEDDNEGGDEDDDKGSGERGSERQREHPFIVTEPGEVARGKKNGLDYLFHLYEQCRDFLIQVQNIAKERGEKCPTKVTNQVFRYAKKAGASYINKPKMRHYVHCYALHCLDEEASNALRRAFKERGENVGAWRQACYKPLVALAARQGWDIDAIFNAHPRLAIWYVPTRLRQLCHSERSNAAAAAAAAASSCISGGADHLPF

SEQ ID NO: 15793 - protein, 628 aa, Rumex palustris
MNTCDCVDTQWFADDLLIKSQYISDLFIVLAYFSIPLELIYFVQKSALFPYRWVLIQFGAFIVLCGTTHLINLFTFSMHSKTLAVVMAIAKMSTAAVSCITALMLVHIIPDLLSVKMRESILRRRADELDREMGLILSQEETGRHVRMLTHEIRSTLDRHTILKTTLVELGRTLGLEECSLWMPSQTGMTLKLSHALQNLTPVGSCVSLNLPVITEIFNNPGVVRISHTCPLVSTRPISGRYLAPEVAAIRVPLLNLSNFQINDWPDVSGRTYAVMVLVLPCDGLRKFRKHELELIEVVADQVAVALSHAAILEESMRAHDQLLEKNVALDLARQEAELAIRARNDFLAVMNHEMRSAMHAIITLSSFLLETELTPEQRVMIEIILRSSNILATLINDVLDLSRLEDGSLELDSLTFNLHAVFKKVINLLKPITCVKKLSLTLAVAPEAICVVGDEKRLVQTILNVVGNAVKFTKVGKISIIVSVAKPDSLSSWQPADVIYAAVSKGQFYLRVQVKDTGCGINPQEIPHIFDKFYQSQNCRRNSTDSGLGLAICKRFVNLMGGQIWVESEGLDKGSLVTFVVKMGICRNPDERSINQAASTGHMNQSSTDLLGDSSMSFSLKRFEKSC

SEQ ID NO: 15794 - protein, 155 aa, Parasponia andersonii
VNKVFTEEQEALVVKAWAVMKKNSAELGLQFLKIFEIAPSAKNLFSYLKDSPVPLEQNPKLKPHATTFVMTTESAVQLRKAGKVTVKESDLKRIGAIHFKTGVVNEHFEVTRFALLETIKEAVPEMWSPEMKNAWGVAYDQLVAAIKFEMKPSST

SEQ ID NO: 15795 - protein, 491 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPPLAGRAGC

SEQ ID NO: 15796 - protein, 509 aa, Bos taurus
MPSGFQQIGSEDGEPPRQRVTGTLVLGVFSAVLGSLQFGYNIGVINAPQKVIEQSYNETWLGRQGPEGPGSIPPGTLTTLWALSVAIFSVGGMISSFLIGIISQWLGRKRAMLFSNALAVLGGTLMGLAKAAASYEMLILGRFFIGAYSGLTSGLVPMYVGEIAPTHLRGALGTLNQLAIVTGILIAQVLGLESMLGTATLWPLLLGITVLPALLQMVLLPLCPESPRYLYIIRNLEGPARKSLKRLTGWADVSEVLAELKEEKRKLERERSLSLLQLLGSHTHRQPLVIAIVLQLSQQLSGINAVFYYSTSIFESAGVEKPAYATIGAGVVNTVFTLVSVFLVERAGHRTLHLLGLAGMCACAILMTVALLLLERVPAMSYVSIVAIFGFVAFFEIGPGPIPCFIVAELFSQGPRPAAMAVAGFSNWTCNFIIGMGFQYVADAMGPYVFLLFAVLLLGFFIFTFLKVPETRGRTFDQISAVFHRTPSLLEQEVKPSTELEYLGPDEHD

SEQ ID NO: 15797 - protein, 96 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTD

SEQ ID NO: 15798 - protein, 384 aa, Pisum sativum
MGLVCSRNRRYRDSDPGENAQAAEIERRIESETKAEKHIQKLLLLGAGESGKSTIFKQIKLLFQTGFDEAELRSYTPVIFANVYQTIKVLHDGAKELAQNDLNSAKYVISDESKDVGEKLSEIGSRLDYPHLTKDLAKEIETLWEDAAIQETYARGNELQVPDCTKYFMENLQRLSDANYVPTKGDVLYARVRTTGVVEIQFSPVGENKGSGEVYRLFDVGGQRNERRKWIHLFEGVTAVIFCAAISEYDQTLFEDESKNRLMETKELFEWILKQPCFEKTSFMLFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 15799 - protein, 384 aa, Pisum sativum
MGLVCSRNRRYRDSDPEENAQAAEIERRIEPEPKAEKHIQKLLLLGAGESGKSTIFKQIKLLFQTGFDEAELRSYTPVIFANVYQTIKVLHDGAKELAQNDLNSAKYVISDESKDIGEKLSEIGSRLDYPHLTKDLAKEIETLWEDAAIQETYARGNELQVPDCTKYFMENLQRLSDANYVPTKGDVLYARVRTTGVVEIQFSPVGENKRSGEVYRLFDVGGQRNERRKWIHLFEGVTAVIFCAAISEYDQTLFEDESKNRLMETKELFEWILKQPCFEKTSFILFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 15800 - protein, 377 aa, Pisum sativum
MSVADVKERHIAATETVNNLRERLKQRRLSLLDTDIAGYARSQGRAPVTLGPTDILCCRTLQGHTGKVYSLDWTSEKNRIVSASQDGRLIVWNALTSQKTHAIKLPCAWVMTCAFSPTGQSVACGGLDSVCSIFNLNSPTDRDGNLNVSRMLSGHKGYVSSCQYVPGEDTHLITGSGDQTCVLWDITTGLRTSVFGGEFQSGHTADVLSISINGSNSKLFVSGSCDATARLWDTRVASRAVRTFHGHEGDVNPVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 15801 - protein, 398 aa, Streptomyces collinus
MAGHTDNGIVVEAPMDLVWTMTNDVAAWPRLFNEYASAEILGRDGDTVTFRLALHPDENGTVWSWVSERTPDPATRTVVARRVETGPFAHMNIRWEYEEVPGGVRMRWIQDFAMKPDAPIDDAGMTARLNRNTAVQMRLIKAKVETAARAGRQLQGKRILVTGGSRGIGRGIVLAAARAGADVVTCYRTPGEAVATLEEELAGTPGKHQVLRADAADATDVDRLAAACEASPGGLDAVVNNAGTFRPQPYTDLGPTEWADTLQGNLTATHLVTRRTLPLLSAGSSVVNIGSTVAFIGMAGGVHYTAVKSALVGMTRSLARELGPRGIRVNTVSPGRIATEALDELPPEEAERQRATFASFTALGRLGTVDDIARTVLFLISDHAGYVTGQNIHVDGCV

SEQ ID NO: 15802 - protein, 585 aa, Mus musculus
MAAAAATAVGPGAGSAGVAGPGGAGPCATVSVFPGARLLTIGDANGEIQRHAEQQALRLEVRAGPDAAGIALYSHEDVCVFKCSVSRETECSRVGRQSFIITLGCNSVLIQFATPHDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGVAVAGMPTAYDLSSVIAGGSSVGHNNLIPLGSSGAQGGGGSSSAHYAVNNQFTMGGPAISMASPMSIPTNTMHYGS

SEQ ID NO: 15803 - protein, 625 aa, Candida albicans
MRATLTSLLVSITFLVSLVAAETHTWYFKTGWVNANPDGVYERPMIGFNDTWPLPTLRVKKGDRVQLYLINGFDNLNTTLHFHGLFQNGTNQMDGPEMVTQCPIPPGETYLYNFTVDQVGTYWYHSHTAGQYGDGMRGVFVIDDDDFPYDYDEDVVLTVGDHYHKYSSDIIPSFLSRFNPTGAEPIPQNFLFNETRNLTWKVEPGKTYLVRIVNVGGFVSQYLWMEDHEFTVVEVDGIYVEKNTTDMLYITTAQRYSVLINTKNSTDKNYAFMQRVDTDMLDVIPSDLQLNGTNYIVYNEDASLPEAYDVDSLDNYLDDFYLKPLSKEKLLDDADYTITVDVQMDNLGNGVNYAFFNNITYTTPKVPTLLTVLSAGDAATNELVYGTNTNSFVLQGGDVVDIVLNNLDTGKHPFHLHGHAFQLIERHKEIPEGEDPVTYNATDHADWPEYPMVRDTVYVRPQSYIVMRFKADNPGVWFFHCHIEWHLEQGLAFQLIEDPQGIQKNEKITDNHKQICEKVGVPWEGNAAANSKDYLNLVGENVQVKRLPTGFTAKGIVALVFSCISAFLGLAAISYYDMNDIENMEKRVARDLDVYFDDDDDEEEEEEQSITEQAATGSSSSPSNK

SEQ ID NO: 15804 - protein, 308 aa, Nyctotherus ovalis
MSSHGKSGKTKKHGKDFVKDFLVGGVSAAVSKTAVAPIERIKILLQVQDISQQIAADKKYKGIIDCFVRVCREQGPITLWRGNLVNVIRYFPTQALNFAFKDTFRKYLCPFDPKKEMGKFFLGSLASGGAAGATSLLFVYPLDFSRTRLAADVGKAKHEREFTGLGNCLATIFKKDGMLGLYRGFSVSVVGIIVYRACYFGGYDWGKQYLFKDFRNANALFLFLFAEVNTTLSGLASYPLDTVRRRLMMQSGRAKRAYTGTFDCMRKIYAEKGLRAFYKGALSNVFRGTGGALVLVLYEKIQKLFLKH

SEQ ID NO: 15805 - protein, 305 aa, Nyctotherus ovalis
MSSHGKPKKHGKDFAKDFLVGGVSAAVSKTAVAPIERIKILLQVQDISQQIAADKKYKGIIDCFVRVCREQGPITLWRGNLVNVIRYFPTQALNFAFKDTFRKYLCPFDPKKEMGKFFLGSLASGGAAGATSLLFVYPLDFSRTRLAADVGKAKHEREFTGLGNCLATIFKKDGMLGLYRGFSVSVVGIIVYRACYFGGYDWGKQYLFKDFRNANALFLFLFAEVNTTLSGLASYPLDTVRRRLMMQSGRAKRAYTGTFDCMRKIYAEKGLRAFYKGALSNVFRGTGGALVLVLYEKIQKLFLKH

SEQ ID NO: 15806 - protein, 308 aa, Nyctotherus ovalis
MSSHGKSGKTKKHGKDFVKDFLVGGVSAAVSKTAVAPIERIKILLQVQDISQQIAADKKYKGIVDCFLRVCREQGPITLWRGNLVNVIRYFPTQALNFAFKDTFRKYLCPFDPKKEMGKFFLGSLASGGAAGATSLLFVYPLDFSRTRLAADVGKAKHEREFTGLGNCLATIFKKDGMLGLYRGFSVSVVGIIVYRACYFGGYDWGKQYLFKDFRNANALFLFLFAEVNTTLSGLASYPLDTVRRRLMMQSGRAKRAYTGTFDCMSKIYAEKGLRAFYKGALSNVFRGTGGALVLVLYEKIQKLFLKH

SEQ ID NO: 15807 - protein, 306 aa, Nyctotherus ovalis
MSSHGKPKKHGKDFIKDFLVGGVSAAVSKTAVAPIERIKILLQVQDISQQIAADKKYKGIVDCFVRVCREQGPITLWRGNLVNVIRYFPTQALNFAFKDTFRKYLCPFDPKKEMGKFFLGSLASGGAAGATSLPFVYPLDFSRTRLAADVGKAKHEREFTGLGNCLATIFKKDGLLGLYRGFSVSVVGIIVYRACYFGGYDFGKQYLFKDFRNANALFLFLFAEVNTTLSGLASYPLDTVRRRLMMQSGRAKRAYTGTFDCMSKIYAEKGLRAFYKGALSNVFRGTGGALVLVLYEKIQKFFLQKH

SEQ ID NO: 15808 - protein, 301 aa, Euplotes sp.
MSQPKPKKNFLQDFLIGGVSAAISKTCVAPIERVKLLLQNQDASSQIKADQRYKGISDCFVRVAREQGIPSMWRGNMANVIRYFPTQALNFAFKDTFKRYLNPYNKKTQPGMFFVGNILSGGAAGAASLCVVYPLDFARTRLAVDVGKGEGSRQFNGLVDCIAKIAKSDGPLGLYRGFGISVMGIIVYRGAYFGLFDTGNAIIFGDSKNANFFAMWGFAQLTTTAAGIISYPMDTVRRRLMMQSGRADKMYSGTIDCFNKILANEESGAFFKGAASNIIRGTGGALVLVLYNKIQKFLIQS

SEQ ID NO: 15809 - protein, 508 aa, Gallus gallus
MSSFAKDFSKAMSQAGPSQFQEVIRQELEYSMKVELDKILATAPSNELEHTKKDLEGFKKLFHRFLQEKGPSVDWGKIQRPPEDSIHPYEKIKARGLPDNIASVLNKLVVVKLNGGLGTSMGCKGPKSLIGVRNENTFLDLPVQQIEHLNKTYNTDVPLVLMNSFNTDEDTKKILQKYSLSRVKIYTFNQSRYPRINKETLLPIAKDVSYSGENTECWYPPGHGDIYGSFYNSGLLDNLIAEGKEYIFVSNIDNLGATVDLYILNHLMNPPNGKRCEFVMEVTNKTRADVKGGTLTQYENKLRLVEIAQVPKAHVDEFKSVSKFKIFNTNNLWIALSAIKRLQEKNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPAGAVLENKIVSGNLRILDH

SEQ ID NO: 15810 - protein, 576 aa, Mus musculus
MAEEEFSNTTHETFNFTLHTTLGVTTKLVLPTPAKPILPVQTGEQAQQEEQSSGMTIFFSLLVLAICIILVHLLIRYRLHFLPESVAVVSLGILMGAVIKVIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKHMSDVSGWQTFSQALGYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLGLEPMEKRQLIGTTTIVIVLFTILLLGGSTMPLIRLVDIEDARARRRSKKDVNLSKTEKMGNAIESEHLSELTEEEYEAHYIRQQDLKGFMWLDAKYLNPFFTRRLTQEDLHHGRIQMKSLTNKWYEEVRQGPSGSEDDEQELF

SEQ ID NO: 15811 - protein, 807 aa, Mus musculus
MTSQIQDLLATDQDLLLMQEGTMMRKVRTKSWKKLRYFRLQNDGMTVWHGSQPESMPKPTFSISDVERIRKGQDSELLRYLVEEFPLEQGFTVVFHGRRPNLDLVANSVEEAQIWMRGLQLLVDLVASMDHQEQMDQMLNEWFQQADRNQDGRMSFREAQRLLLLMNVEMDEEYAFSLFQEADVTQSDDLGSEEFVQFYKALTKRTEIEEIFEDFSSDKQKLTLLEFVDFLRKEQKEKDHAPDLALELIDRYEPSENGRLLHVLSKDGFLKYLCSKDGNIFNSDCLPIYQDMTQPLSHYYINSSHNTYLVGDQLCGQSSVEGYIRALKRGCRCVEVDTWDGPDGEPVVYHGHTLTSRILFKDVLATLAQYAFQSSDYPLILSLENHCTWEQQRTMAHHLTEILGEQLLRNTLEGLLVDSMPSPEQLRGKILVKGKKLRTIEVDKEEEEEEEEEELEKDEGPDLDPASPEFDTQPQPETQGQAAGNKKERKKKVMKCPMSCLLICGHVMAQAPSSIPESILLSKQFLLLSSTTIMCPDLSALVVYLRTVPFCSFTHSKENYHIYDISSFSESKAKNLIKEAGNEFVQHNARQLCRVYPSGLRTDSSNFNPQEHWNVGCQMVAMNMQTAGSAMDICDGLFRQNGGSGYVLKPEFVRDTQSSFNPERPISLYKAQILVVQVISGQQLPKVDKTKETTVVDPLVKVELYGVPEDTKEQETSHVENNGINPYWGETFYFRLQVPELAMLRFVVKDYSRKSRNNFIGQYTLPWTCMKQGYRHVSLLSRDGTSLNPASIFVYTCMQEDLDMDEP

SEQ ID NO: 15812 - protein, 526 aa, Mus musculus
MANQLYNGHQNSLSNIYNPSTRSAINTTYPAEPPSLLSSSRYLSSFPDPHSLSSDSPSESVRRSLSYSDTHGLTAASRSIVPTATSTSLWPSFDVFSAYRKRPSEALYNHSVLGAHMVGQNEAWFSSDSLAKRPRFQSASNLPVYPQRPGEKDCTHYMLTRTCKFGDNCKFDHPIWVPAGGIPDWKEPPAVPSEIYPERPGEPDCPYFLKTQKCKFGLKCKFNHPKDKLILAQDTSAETDASDLPERPTEPLCSFYTKTGKCKFGAACKFHHPKDIQVPSDGQEADDEEQTHSIDHLGTTSDGNSLKALTSNPASSYNSKGLPVRMGEVDCPFYLKTGSCKYGANCRYNHPDRNELSSPFSVINPSSAVVGHAVLPALASVSAGLINPAASIFQSLQPGLPQTTFGQVPVIYPQRPGQIECDYYMKRGECKFGERCKFHHPIDRSAPARNQTLEQNVKFTLAGLPRREGVQHCPFYMKTGTCSYAVNCKFDHPPPGEVMAAAGKETLTKAEEEGKESEEGAATAEK

SEQ ID NO: 15813 - protein, 448 aa, Mus musculus
MKGFIDDANYSVGLLDEGTNLGNVIDNYVYEHTLTEKNAFFVGDLGKIVKKHSQWQTVVAQIKPFYTVKCNSTPAVLEILAALGTGFACSSKNEMALVQELGVSPENIIFTSPCKQVSQIKYAAKVGVNIMTCDNEIELKKIARNHPNAKVLLHIATEDNIGGEDGNMKFGTTLKNCRHLLECAKELDVQIIGVKFHVSSACKEYQVYVHALSDARCVFDMAGEFGFTMNMLDIGGGFTGTEIQLEEVNHVISPLLDIYFPEGSGIQIISEPGSYYVSSAFTLAVNIIAKKVVENDKFSSGVEKNGSDEPAFVYYMNDGVYGSFASKLSEDLNTIPEVHKKYKEDEPLFTSSLWGPSCDELDQIVESCLLPELNVGDWLIFDNMGADSFHEPSAFNDFQRPAIYFMMSFSDWYEMQDAGITSDAMMKNFFFAPSCIQLSQEDSFSTEA

SEQ ID NO: 15814 - protein, 461 aa, Pyrococcus sp.
MKKFVALLITMFFVVSMAAVAQPASAAKYSELEEGGVIMQAFYWDVPAGGIWWDTIRSKIPEWYEAGISAIWIPPASKGMGGAYSMGYDPYDFFDLGEYNQKGTVETRFGSKQELINMINTAHAYGIKVIADIVINHRAGGDLEWNPFVGDYTWTDFSKVASGKYTANYLDFHPNEVKCCDEGTFGGFPDIAHEKEWDQHWLWASDESYAAYLRSIGVDAWRFDYVKGYGAWVVKDWLNWWGGWAVGEYWDTNVDALLNWAYSSGAKVFDFPLYYKMDEAFDNTNIPALVDALQNGGTVVSRDPFKAVTFVANHDTDIIWNKYPAYAFILTYEGQPVIFYRDYEEWLNKDKLNNLIWIHDHLAGGSTSIVYYDSDELIFVRNGDSKRPGLITYINLGSSKVGRWVYVPKFAGACIHEYTGNLGGWVDKYVESSGWVYLEAPAYDPASGQYGYTVWSYCGVG

SEQ ID NO: 15815 - protein, 199 aa, Ceratopteris pteridoides
RNGLLKKAHELSVLCDAEIALIIFSSTGKLFEHSSSRGIKKILERYKRCSGILQDVGGTVIRDVEYWKQEAERLKERLTYMEEIQRNMLGESLGSLQIKDLQNLEAKLDSGLYKIRGAKTQLMVRQVQELQKKEQILLQQNEALRTKLAELSRLQAPVSGLTTATTSQDVQESSSGSGSRQHETSLSAAETTLQLGFAQ

SEQ ID NO: 15816 - protein, 193 aa, Ceratopteris pteridoides
RTGLLKKAYELSVLCDAEVAVIVFSSTGRLSEFATPSMPKMLEKYHRAIQRSQGNEHSLQNIEHWQHEAINLRKRIQLLQLRQSHLMGENLTCFQLKDLDILESRLSVTVEKIREEKMRRFHVHAEEMHKQECLLHQENTLLKLKIENVESMKHSAHVIDLLSDDDCMLESPKISQESGLKDSRFSLQLGLKP

SEQ ID NO: 15817 - protein, 216 aa, Ophioglossum pedunculosum
SKRRNGLLKKAYELSVLCDAEVAVIVFSGTGKLSEFASSSMMRRILEKHRQVVEGSQSIKPTSQDVVEYWRHEATRLKHQLGVVQETQRHMLGESLETLTYRDLQKLESKLNGALNQVRGRKNQIISERLVYLQEKEDLLNAENIMMRAKLAEIMAGGVPLMSQSMQDPAARESFLNESSTQPNPPIMKNQNGEETNLQLGLELFPTTSFGDGAST

SEQ ID NO: 15818 - protein, 487 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWAEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 15819 - protein, 376 aa, Arabidopsis thaliana
MAHSHTNGAISPSFSKDLCEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQV

SEQ ID NO: 15820 - protein, 208 aa, Gossypium hirsutum
MSSENGKRLLETDAGGLNFEATELTLGLPGEPRVTSDGGAKLGSKRGFSETVDLKLGDNNQEVKLGHSLQEAAKSPVSKTQVVGWPPVRGFAKRGKKSCKYVKVAVDGAPYLRKVDLEIYNSYQQLLTSLEDMFSCFTIRNYLNEKKIDQVNGIEYMPTYEDKDGDWMLVGDVPWQMFVESCKRLRLMKSSEAVGLGLKTAPKYSSTN

SEQ ID NO: 15821 - protein, 764 aa, Chenopodium rubrum
MGVVLLPDLGTEILIPVCAVIGIVFSLIQWYVVSQVKLSPDSGRSNNNKNGFSENLIEEEEGINDQSVVAKCAEIQNAISEGSTSFLYTMYQYVGIFMIAFAVLIFVFLGSVEGFSTKSQECTYDKSKTCKPALATAIFSTVSFLLGAVTSLASGFLGMKIATYANARTTLEARKGVGKAFIVAFRSGAVMGFLLAANGLLVLYITILLFKLYYGDDWEGLFEAITGYGLGGSSMALFGRVGGGIYTKAADVGADLVGKIERNIPEDDPRNPAVIADNVGDNVGDIAGMGSDLFGSYAESSCAALVVASISSFGINHELTAILYPLLISSVGIVICLITTLFATDFFEIKAVKEIEPALKKQLVISTALMTVAVAVISWVALPSSFTIFDFGSQREVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNEIPGLMEGTAKPDYANCVKISTDASIKEMIPPGALVMLTPLIVGTLFGVETLSGVLAGSLVSGVQIAISASNTGGAWDNAKKYIEAGASEHARQLGPKGSDAHKAAVIGDTIGDPLKDTSGPSLNILIKLMAVESLVFAPFFATHGGLLFKIF

SEQ ID NO: 15822 - protein, 309 aa, Caenorhabditis elegans
MREFYSQFGEITDIIVMRDPTTKRSRGFGFVTFSGKTEVDAAMKQRPHIIDGKTVDPKRAVPRDDKNRSESNVSTKRLYVSGVREDHTEDMLTEYFTKYGTVTKSEIILDKATQKPRGFGFVTFDDHDSVDQCVLQKSHMVNGHRCDVRKGLSKDEMSKAQMNRDRETRGGRSRDGQRGGYNGGGGGGGGWGGPAQRGGPGAYGGPGGGGQGGYGGGNYGGGWGQQGGGGQGGWGGPQQQQGGGGWGQQGGGGQGGWGGPQQQQQGGWGGPQQGGGGGGWGGQGQQQGGWGGQSGAQQWAHAQGGNRNY

SEQ ID NO: 15823 - protein, 216 aa, Phaseolus coccineus
MESGGFHGYRKLPNTTSPGLKLSVSDMNNVNTSRQVAGDNNHTADESNECTVREQDRFMPIANVIRIMRKILPPHAKISGDAKETIQECVSEYISFITGEANERCQREQRKTITAEDVLWAMSKLGFDDYMEPLTMYLHRYRELEGDRTSMRGESLGKRTIEYAPMGVGVATAFVPPQFHPNGYYGPAMGAYVAPPNAASSHHHGMPNTEPNARSM

SEQ ID NO: 15824 - protein, 412 aa, Streptococcus agalactiae 2603V/R
MIENILQMLMGVVDNYLVAQLGVVAVSGVSVANNIITIYQAIFIALGASIASLLAKSLAGSKKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 15825 - protein, 214 aa, Streptococcus agalactiae 2603V/R
MEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 15826 - protein, 309 aa, Streptococcus agalactiae 2603V/R
MRCSTKEMRLVYRDFLLQANQENKQITVLEADLSSSMSTNALASEFGKRYINLGIMEAEMVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 15827 - protein, 194 aa, Streptococcus agalactiae 2603V/R
MGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 15828 - protein, 244 aa, Streptococcus agalactiae 2603V/R
MQLKDKNIFITGSSRGIGLAIAHQFAQLGANIVLNGRSEISEDLIAEFADYGVKVIAISGDVSSFEDANRMIKEAIASLGSVDVLVNNAGITNDKLMLKMTVEDFESVLKINLTGAFNMTQSVLKPMTKARQGAIINISSVVGLTGNVGQANYAASKAGLIGFTKSVAREVAARGIRVNAIAPGFIESDMTDVIPEKMQEAILAQIPMKRIGKGKEVAQVASFLAEQEYLTGQVIAIDGGMTMQ

SEQ ID NO: 15829 - protein, 284 aa, Streptococcus agalactiae 2603V/R
MTDTMILNDNHKIPTLGLGTWMIDNDRVAQVVKDAIELGYRHIDTAQAYNNEKGVGVGIKESGITRESLFVTTKIAAEHKDYESATKSIDQSLEALGLDYIDLMIIHSPQPWKEWRETDKHFDQGNLEAWRALEDAQKSGKMKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSGK

SEQ ID NO: 15830 - protein, 435 aa, Streptococcus agalactiae 2603V/R
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 15831 - protein, 240 aa, Streptococcus agalactiae 2603V/R
MKVAIVTGGTRGIGRAITKELYKEGYKVIAIYNSNDAKARALQEELPKLDVYKCNISDAKAVQKLVTKIFREYGGIDCLVNNAGIVRDGFFLMMSKEKWMDVININIMGLVNMSKAVLKIMKAKRIQGKVINISSTSGIAGQIGQANYSATKGAIISITKTLAKEFASDGITINCVSPGFIETDMTNELQNKEELKEHLIPLKRFGQPEEVAWLVSFLASEKANYITGKNIVIDGGMIND

SEQ ID NO: 15832 - protein, 444 aa, Streptococcus agalactiae 2603V/R
MRIGLFTDTYFPQVSGVSTSIRTLKEGLEKEGHEVYIFTTTDRNVKRFEDPTIIRLPSVPFISFTDRRVVYRGLISAYRIAKDYELDIIHTQTEFSLGLLGKLVAKALRIPVVHTYHTQYEDYVGYIAKGKLIKPSMVKYIMRTYLSDLDGVICPSRIVLNLLDGYGVKIPKQVIPTGIPVENYRREDISEETIKNLRTELGLADNDTMLLSLSRVSFEKNIQAILMHLSAVVDENPHVKLVIVGDGPYLSDLKELVHSLELENSVIFTGMVEHSQVAIYYKACDFFISASTSETQGLTYIESLASGRPIIAQSNPYLDDVISDKMFGTLYKKESDLADAILDAIAETPKMTQEAYEQKLYEISAENFSKSVYAFYLDFLISQKASVKEKVSLTIGNKDSHSTLRFVRKAVYLPKKVFTFTGRASKKVVKAPKRRISSIRDFLD

SEQ ID NO: 15833 - protein, 449 aa, Streptococcus agalactiae 2603V/R
MNNSAANIRSFELALLFLLVFVAVYFVYLAVRDFKMSKNIRLLNWKVRDLIAGNYSDSILIQGDADLVELGESLNDLSDVFRMAHDNLEQEKNRLASILTYMTDGVLATDRSGKIVMINETAQQQFNLAYDEALSMNIVDMLGSGSPYSFQDLVSKTPEVVLNRRDENGEFVTLRIRFALNRRESGFISGLVAVSHDATEQEKEERERRLFVSNVSHELRTPLTSVKSYLEALDEGALNEEVAPSFIKVSLDETNRMMRMISDLLSLSRIDNEVTHLDVEMTNFTAFMTSILNRFDQIRNQKTVTGKVYEIVRDYPLKSIWVEIDTDKMTQVIDNILNNAVKYSPDGGKITVNLRTTKTQMILSISDQGLGIPKKDLPLIFDRFYRVDKARSRKQGGTGLGLSIAKEIVKQHKGFIWAKSEYGKGSTFTIVLPYDKDAVTYEEWEDVED

SEQ ID NO: 15834 - protein, 577 aa, Streptococcus agalactiae 2603V/R
MTEMLKGIAASDGVAVAKAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 15835 - protein, 332 aa, Streptococcus agalactiae 2603V/R
MSETKVMALREAINVAMSEEMRKDEKVFLMGEDVGVYGGDFGTSVGMLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 15836 - protein, 180 aa, Streptococcus agalactiae 2603V/R
MIKRITLAVTGSISAYKAADLTSQLTKIGYDVHIIMTQAATEFITPLTLQVLSKNPIHLDVMDEHNPKIINHIELAKRTDLFIVAPASANTIAHLAYGFADNIVTSVALAMPDETPKLIAPAMNTKMYHNTITQRNIDILKKIGYQEIEPRISLLACGDTGQGALADISTILKCIQEVAN

SEQ ID NO: 15837 - protein, 327 aa, Streptococcus agalactiae 2603V/R
MFNDIPVFDYEDIQLIPNKCIISSRSQADTSVKLGNYTFKLPVIPANMQTIIDEEVAETLACEGYFYIMHRFNEEERKPFIKRMHDKGLIASISVGVKDYEYDFVTSLKEDAPEFITIDIAHGHSNSVIEMIQHIKQELPETFVIAGNVGTPEAVRELENAGADATKVGIGPGKVCITKVKTGFGTGGWQLAALRWCSKAARKPIIADGGIRTHGDIAKSIRFGASMVMIGSLFAGHLESPGKLVEVEGQQFKEYYGSASEYQKGEHKNVEGKKILLPVKGRLEDTLTEMQQDLQSSISYAGGKELDSLRHVDYVIVKNSIWNGDSI

SEQ ID NO: 15838 - protein, 515 aa, Streptococcus agalactiae 2603V/R
MSKKHITPVFTGSLIVSLILVLLGIIVPRGFQSWTQILREQVSTNFGWLYLLLVTSILALCVFFIMSPLGQIRLGQPHSRPEYSTVSWIAMMFSAGMGIGLVFYGAAEPLSHFAISTPGAPKESQTALADAFRFTFFHWGIHAWAVYALVALALAYFGFRKQEKYLLSVTLKPLFGDKTDGWLGKIVDITTVVATVIGVATTLGFGAAQINGGLSFLLGVPNNAFVQIVIILITTALFVMSALSGLGKGVKILSNLNLILAVALLALVIVLGPTVRIFDTLTESLGSYLQNFFGMSFRAAAFDNTKRSWIDNWTIFYWAWWISWSPFVGVFIARISKGRSIREFLTVVLLIPTLLSFVWFAAFGTLSTQVQQLGTNLTKFATEEVLFATFNHYTLGWLLSIIAIILIFSFFITSADSATYVLAMLTEDGNLNPKNRTKVIWGLVLAVIAIVLLLSGGLLALQNVLIIVALPFSFVMILMMLALLVELFHEKKEMGLSISPDRYPRKNEPFKSYEE

SEQ ID NO: 15839 - protein, 458 aa, Streptococcus agalactiae 2603V/R
MAYKTIYPYTNEVLHEFDNISDSDLEQSLDIAHALYKTWRKEDNVEERQNQLHKVADLLRKDRDKYAEVMTKDMGKLFTEAQGEVDLCADIADYYADNGQKFLKPVPLESPNGEAYYLKQAVGVLLAVEPWNFPFYQIMRVFAPNFIVGNTMLLKHASICPASAQAFEDLVREAGAPEGAFKNIFASYDQVSNLISDPRVAGVCLTGSERGGASIAAEAGKNLKKSSMELGGNDAFLILDDADFDLLSKTIFFARLYNAGQVCTSSKRFIVMADKYDEFVNMVVETFKSAKWGDPMDSETTLAPLSSAGAKDDVLKQIKLAVDHGAEVVFGNDTIDHPGNFVMPTVLTNITKANPIYNQEIFGPVASIYKVDTEEEAIALANDSSYGLGSTVFSSDPEHAKKVAAQIETGMTFINSGWTSLPELPFGGIKNSGYGRELSQLGFDAFVNEHLVFTPNSD

SEQ ID NO: 15840 - protein, 314 aa, Streptococcus agalactiae 2603V/R
MGRFKELLESKKTLILHGALGTELESRGCDVSGKLWSAKYLIEDPAAIQTIHEDYIRAGADIVTTSTYQATLQGLAQVGVSESQTEDLIRLTVQLAKAAREQVWKSLTKEEKSERIYPLISGDVGPYAAFLADGSEYTGLYDIDKQGLKNFHRHRIELLLDEGVDILALETIPNAQEAEALIELLAEDFPQVEAYMSFTSQDGKTISDGSAVADLAKAIDVSPQVVALGINCSSPSLVADFLQAIAEQTNKPLVTYPNSGEVYDGASQSWQSSPDHSHTLLENTSDWQKLGAQVVGGCCRTRPADIADLSAHLK

SEQ ID NO: 15841 - protein, 369 aa, Streptococcus agalactiae 2603V/R
MAEKKGNTTFNVQVADFIRNHKKQGTAIDDEVTEKLVIPFVLDADQIDDLLERLTDGGISITDKEGNPSTKYVVEGPKPEELTDEELIGSNSAKVNDPVRMYLKEIGVVPLLTNEEEKELAVAVAEGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLKDFMED

SEQ ID NO: 15842 - protein, 490 aa, Streptococcus agalactiae 2603V/R
MEKTKSFFGHPRGLSTLFFTEMWERFSYYGMRAILLYYMYYSVSQGGLGMDKTVAASIMAVYGSLVYLSSVIGGFVSDRILGSRKTVLYGGILIMLGHIALATPFGQTALFISIALIILGTGLLKPNVSEMVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQTLYYGVVGGITVVFGFILLFYVPRIEKLMSGVK

SEQ ID NO: 15843 - protein, 280 aa, Streptococcus agalactiae 2603V/R
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 15844 - protein, 881 aa, Streptococcus agalactiae 2603V/R
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIGQAVRLGKEVKPNLKIGICGEHGGEPSSIEFCYQLGLHYVSCSPFRIPIAKLAAAQAKIKQSRNDITIDK

SEQ ID NO: 15845 - protein, 270 aa, Streptococcus agalactiae 2603V/R
MTEQFLKDNFSLEGKVALITGASYGIGFSIATAFARAGATIVFNDIKQELVDKGISAYKKLGIKAHGYVCDVTDEDGINEMVDKISQDVGVIDILVNNAGIIKRTPMLEMSAADFRQVIDIDLNAPFIVSKAVLPGMIQKGHGKIINICSMMSELGRETVAAYAAAKGGLKMLTKNIASEYGSANIQCNGIGPGYIATPQTAPLRERQDDGSRHPFDQFIIAKTPAARWGEAEDLGAPAIFLASDASNFINGHILYVDGGILAYIGKQPQ

SEQ ID NO: 15846 - protein, 614 aa, Streptococcus agalactiae 2603V/R
MSKFLEKLKTDILVADGAMGTLLYTYGLDTCHESYNVTHPEKVLAIHQAYIEAGADVIQTNTYGAQRHRLKNYGLEDQVVSINQAAVNIAHQATLGKETFILGTVGGFRSQRQCDLTLDNIVEETLEQVEALLATGQLDGLLFETYYDIEEITTVLKIVREMTDLPIITNISLHEAGVTSNGKPIVEALSQLVMLGADVIGLNCHLGPYHMIQSLKQVPLFAQSYLSVYPNASQLSLDGENSQYQFSQNSEYFGKSAELLVAEGVRLIGGCCGTTPDHIRAVKRSIRGLKPIERKVVTPIIPVKDFVRRIRRTDTLVDKVKKEVTIIAELDPPKHLDIVQFQKAIRAIDQKGIAAITLADNSLSNTRICNLSIASLLKDEISTPFLLHIACRDHNLIGLQSRLLGMELLGFNHILAITGDPTKLGDFPGATSVYDVTSFKLLSLIKQLNQGLSYSGASLRRPTDFTVAAAFNPNVKNLTRTVKLIEKKVASGADYFMTQPIFDHSVLKELADLTKTVEQPFFIGIMPITSYNNAVFLHNEVPGIKLSESFLSALEKVKDDKEACLTLALNESKSLIDEALNYFNGIYLITPFLRYDLTLELIDYIQKKQVRKSS

SEQ ID NO: 15847 - protein, 493 aa, Streptococcus agalactiae 2603V/R
MSNWDTKFLKKGFTFDDVLLIPAESHVLPNEVDMKTKLADNLTLNIPIITAAMDTVTDSKMAIAIARAGGLGIIHKNMSIVDQAEEVRKVKRSENGVIIDPFFLTPDNTVSEAEELMQNYRISGVPIVETLENRKLVGIITNRDMRFISDYKQLISEHMTSQNLVTAPIGTDLETAERILHEHRIEKLPLVDDEGRLSGLITIKDIEKVIEFPKAAKDEFGRLLVAGAVGVTSDTFERAEALFEAGADAIVIDTAHGHSAGVLRKIAEIRAHFPNRTLIAGNIATAEGARALYDAGVDVVKVGIGPGSICTTRVVAGVGVPQITAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGSVADIVFQMLGGIRSGMGYVGAANIKELHDNAQFVEMSGAGLKESHPHDVQITNEAPNYSVH

SEQ ID NO: 15848 - protein, 236 aa, Homo sapiens
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 15849 - protein, 199 aa, Homo sapiens
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 15850 - protein, 253 aa, Pectobacterium atrosepticum
MILNSFDLQGKVALITGCDTGLGQGMAIGLAQAGCDIVGVNIVEPKDTIEKVTALGRRFLSLTADMSNVSGHAELVEKAVAEFGHVDILVNNAGIIRREDAIEFSEKNWDDVMNLNIKSVFFMSQTVARQFIKQGKGGKIINIASMLSFQGGIRVPSYTASKSAVMGVTRLMANEWAKHGINVNAIAPGYMATNNTQQLRADEERSKEILDRIPAGRWGLPQDLMGPSVFLASSASDYINGYTIAVDGGWLAR

SEQ ID NO: 15851 - protein, 647 aa, Mus musculus
MESQLHELAEARWFLSKVQDDFRGGKINVEITHKLLEKLDFPCHFAHVKHIFKENDRQNQGRITIEEFRAIYRCIVHREEITEIFNTYTENRKILSENSLIEFLTQEQYEMEIDHSDSVEIINKYEPIEEVKGERQMSIEGFARYMFSSECLLFKENCKTVYQDMNHPLSDYFISSSHNTYLISDQILGPSDIWGYVSALVKGCRCLEIDCWDGSQNEPIVYHGYTFTSKLLFKTVVQAINKYAFVTSDYPVVLSLENHCSPGQQEVMASILQSTFGDFLLSDMLEEFPDTLPSPEALKFKILVKNRKVGTLSETHERIGTDKSGQVLEWKEVIYEDGDEDSGMDPETWDVFLSRIKEEREADPSTLSGIAGVKKRKRKMKIAMALSDLVIYTKAEKFRNFQYSRVYQQFNETNSIGESRARKLSKLRVHEFIFHTAAFITRVYPKMMRADSSNFNPQEFWNVGCQMVALNFQTPGLPMDLQNGKFLDNGGSGYILKPDILRDTTLGFNPNEPEYDDHPVTLTIRIISGIQLPVSSSSNTPDIVVIIEVYGVPNDHVKQQTRVVKNNAFSPKWNETFTFLIQVPELALIRFVVETQQGLLSGNELLGQYTLPVLCMNKGYRRVPLFSKSGANLEPSSLFIYVWYFRE

SEQ ID NO: 15852 - protein, 147 aa, Sesbania rostrata
GFTDKQEALVNASYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 15853 - protein, 165 aa, Desulfovibrio vulgaris
MSTIVSVWAREILDSRGNPTVEVEVSLESGHTGGAAVPSGASTGSREALEMRDGDKGRYKGKGVEKAVDNVMGEIAEAIVGLNSLRQVQVDNTLLDLDGTDNKSRLGANAMLAVSLAHRAAASSFLGLPLYQYLGGVNAKVLPVPLMNIINGGAHAPNNLDIQEF

SEQ ID NO: 15854 - protein, 319 aa, Bombyx mori
MDDFLKIEKIGEGTYGVVYKGKNKITGQFVAMKKIRLESEDEGIPSTAIREISLLKELNHPNIVKLEDVLMEESRLYLIFEFLSMDLKKYMDSLGSGKFMDPSVVKSYLYQINNAILYCHQRRILHRDLKPQNLLIDKTGIIKVADFGLGRAFGVPVRVYTHEVVTLWYRAPEVLLGSQRYSCPIDIWSVGCIFSEMSSKKPLFQGDSEIDQLFRIFRMLRTPTEEIWPGVSLLPDYKPTFPNWNTYNLHNHVQNLDEVGMDLLQKMLVYDPVKRISAKDARRHKYFRDVKLPPGLTVHDAYIRVTPEYPYDTDSVQSV

SEQ ID NO: 15855 - protein, 404 aa, Bombyx mori
MSQGSEKSASNHDVVDPTGPGTRKGVLISFRTGKTMEIPEKDILGKCRFVGEFEKLNRIGEGTYGIVYRAKNKANGSIVALKKVRMDVEKDGLPLSGLREIQVLMSCRHENIVQLKEVLVGRSLESIFLSMEYCEQDLASLLDNMSSPFTESQVKCLMLQVLKGLKYLHSNFIVHRDLKVSNLLLTDKGCVKIADFGLARWLGAPARSATPRVVTLWYRAPELLLQSPRQTPALDMWAAGCILGELLANKPLLPGRTEIEQLELIVDLLGTPSDAIWPEFSALPALQNFTLKQQPYNNLKQRFPWLSAAGLRLLNFLFMYDPNKRATAEECLQSSYFKEEPLPCDPKLMPSFPQHRNMKGQTKATSNQLNIPLSNLNTGANDQTNNLPAISDLLGSLVKKRRLE

SEQ ID NO: 15856 - protein, 438 aa, Rattus norvegicus
  unsure (1)..(438): unsure at all Xaa locations
ATXTCTRFTEEYQXFEEXGKGAFSVVRRVXAGQEYAAKXXNTKKXSARDHQKXRXXKHPNXVRXHDSXSEEGHHYXXFDXVTGGEXFEDXVAREYYSEADASHCXQQXXEAVXHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKNDGVKQEXXKVTEQXXEANGDFEYKCDPGTAFEPEAXGNXVEGXDFHRFTFENXWSRNSKPVHTTXXNPHXHXMGDESACIAYIRITQYXDAGGXPRTAQSEETRVWHRWQXVHFHRSGAPSVXPH

SEQ ID NO: 15857 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 15858 - protein, 80 aa, Metrosideros excelsa
KKAGASYINKPKMRHYVHCYALHCMDEHASNALRKSFKERGENVGAWRQACYHPLVTIAGRRAGWDIDAIFNAHPRLCIW

SEQ ID NO: 15859 - protein, 323 aa, Homo sapiens
AASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 15860 - protein, 222 aa, Glycine max
MEAIHLKSSKFAAMMLAGAPPHLDSMSPENEKEEESRRREKRGNEDHVAIIKEYRGKIEAELSKICDGILNLLESNLIPSAASPESKVLYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETFKQQPGE

SEQ ID NO: 15861 - protein, 367 aa, Glycine max
AVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 15862 - protein, 387 aa, Rattus norvegicus
TRDEALPDSHSAQNFYENYEPKEILGRGVSSVVRRCIHKPTCQEYAVKIIDITGGGSFSSEEVQELREATLKEVDILQKVSGHPNIIQLKDTYETNTFFFLVFDLMKRGELFDYLTEKVTLTEKETRKIMRALLEVVCTLHKLNIVHRDLKPENILLDDNMNIKLTDFGFSCQLQPGEKLREVCGTPSYLAPEIIQCSMDEGHPGYGKEVDMWSTGVIMYTLLAGSPPFWHRKQMLMLRMIMDGKYQFGSPEWDDYSDTVKDLVSRFLVVQPQDRCSAEEALAHPFFQEYVVEEVRHFSPRGKFKVICLTVLASVRIYYQYRRVKPVTREIVIRDPYALRPLRRLIDAYAFRIYGHWVKKGQQQNRAALFENTPKAVLLSLAEEEDF

SEQ ID NO: 15863 - protein, 260 aa, Hordeum vulgare subsp. vulgare
AGGHAADRIVRLPGQPEVDFDMYSGYITVDEAAGRSLFYLLQEAPEEAQPAPLVLWLNGGPGCSSVAYGASEELGAFRVMPRGAGLVLNEYRWNKVANVLFLDSPAGVGFSYTNTSSDIYTSGDNRTAHDSYAFLAAWFERFPHYKRREFYVAGESYAGHYVPELSQLVHRSGNPVINLKGFMVGNGLIDDYHDYVGTFEFWWNHGIVSDDTYRRLKDACLHDSFIHPSPACDAATDVATAEQGNIDMYSLYTPVCNISS

SEQ ID NO: 15864 - protein, 159 aa, Hordeum vulgare subsp. vulgare
  unsure (1)..(159): unsure at all Xaa locations
TGSYDPCTERYSTAYYNRRDVQTALHANVTGAMNYTWXZCSDTINTHWHDAPRSMLPIYRELIAAGLRIWVFSGDTDAVVPLTATRYSIGALGLATTTSWYPWYDDLQEVGGWSQVYKGLTLVSVRGAGHEVPLHRPRQALILFQQFLQGKPMPGRTTN

SEQ ID NO: 15865 - protein, 667 aa, Arabidopsis thaliana
MEIEQRRIMKREGEEEEDNNQLSLQEEEPDTEEEMSGRTIEPWTKQITVRGVFVSIVIGVVFSVIAQKLNLTTGIVPNLNSSAALLAFVFVQTWTKILKKSGFVAKPFTRQENTMIQTSAVACYGIAVGGGFASYLLGLNHKTYVLSGVNLEGNSPKSVKEPGLGWMTAYLFVVCFIGLFVLIPLRKVMIVDLKLTYPSGLATAVLINGFHTQGDAQAKKQVRGFMKYFSFSFLWGFFQWFFSGIEDCGFAQFPTFGLKAWKQTMTFVGAGMICSHLVNLSLLLGAILSYGLMWPLLDKLKGSWFPDNLDEHNMKSIYGYKVFLSVALILGDGLYTFVKILFVTIANVNARLKNKPNDLDDVGHKKQRKDLKEDENFLRDKIPMWFAVSGYLTFAAVSTVVVPLIFPQLKWYYVIVAYIFAPSLAFCNAYGAGLTDINMAYNYGKIGLFVIAAVTGRENGVVAGLAGCGLIKSVVSVSCILMQDFKTAHYTMTSPKAMFASQMIGTVVGCIVTPLSFFLFYKAFDIGNPNGEFKAPYALIYRNMAILGVQGFSALPLHCLQMCYGFFGFAVLVNVVRDLTPAKIGRFMPLPTAMAVPFLVGAYFAIDMCVGTLIVFVWEKMNRKKAEFMVPAVASGLICGEGLWTLPAAVLALAGVKPPICMKFLAS

SEQ ID NO: 15866 - protein, 454 aa, Bacillus subtilis
MTSLIKIHAHGRRFEIFRSRGNPTVEVDLYTAKDLFRAAGARRCVHCHLRGPRTPRCCCLDPASYEMGLKGCYAHQYNYKTCSGSQETGCCEAGEDCPADDADGRHSSQLYDLIKKHPASVPGCLQGCCRGEGGALYRHIADFAGNPEVTLPVPAFIVINGGSHPANKFAQEFILLPVGASSFRTAGPAEVYHNLKNVIKEKYGKDATNVGDEGGFAPNILENKEALELLKSAIAKAGYTDQVVIGDVAASEFYRAGKYDLDFKSPDDASRYITPDQLADQLKSFTTCISSLLLTLPDASLQSRFGYYPDGDQPQAHRAGSGGEGLQLPPLEVTESLQACKLAQSNACGVIVSIDLRRLRTLFIADLFFGRVRADQDFSPCPICACQVECSFESRGLGRANKAKFAGRSFGPPLAKFPNLTAGHACTKYTPEQVSSRRGGGKTTTPNNPPSFCC

SEQ ID NO: 15867 - protein, 519 aa, Trametes sp. I-62
MAKLQFSNFFVTLAVVTGALAAVGEADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAATLGLGSRLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIIEPTTVQTTSVIPLVETNLHPLVPTIVPGLPVSGGVDKAINLGFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 15868 - protein, 520 aa, Trametes sp. I-62
MSRFHSLLTFIVASLASSALASIGPVADMTISNAEVSPDGFARQAVVVNGVTPGPLVKGNMGDRFQLNVIDNLTNHTMLKSTSIHWHGLFQHGTNWADGPAFVNQCPVSAGHSFLYDFQVPGQAGTFWYHSHLSTQYCDGLRGPLVVYDPHDPHKSRYDVDNDDTVITLADWYHVAAKRRSAFPLGADATLINGLGRSPTTPSADLAVINVTQGKRYRFRLVSLSCDPNHTFSIDGHNMTIIEVDSVNSQPLVVDSIQIFAAQRYSFVLNANQAVDNYWVRANPSFGNVGFSGGINSAILRYAGAPAIEPTTNQTTSVIPLNEVNLHPLAPTPVPGKAVAGGVDTPINMAFSFNGTNFFINGASFVPPTVPVLLQILSGAQSAQDLLPSGSVYVLPSNASIEISFPATAAAPGVPHPFHLHGHTFAVVRSAGSTEYNYDNPIFRDVVSTGTPAAGDNVTIRFQTNNPGPWFLHCHIDFHLEAGFAVVMAEDTPDVKAVNPVPQSWSDLCPIYDALDASDQ

SEQ ID NO: 15869 - protein, 524 aa, Trametes sp. I-62
MSGFRLLPSFASLAVIVSLALNTFAAVGPVTDLTISNANVSPDGFQRAAVVANGGVPGPLINGQKGDHFQINVVNQLTNHTMLKSTSIHWHGFFQKGTNWADGPAFVNQCPIATGHSFLYDFQVPDQAGTFWYHSHLSTQYCDGLRGPFVVYDPNDPHASLYDVDNEDTVITLADWYHVAAKLGPAFPPRADATLINGLGRSTDTPTADLAVIKVTSGKRYRFRLASLSCDPAFTFSIDNHDMTIIEADAVNTQPLEVDSLQIFAGQRYSFVLEANQAVDNYWVRANPFFGTTGFAGGINSAILRYDGAAEVEPTTTQSTSTKPLAETDLVPLASMPVPGSPVSGGVDKAINFAFTFNGTNFFVNGATFTPPSTPVLLQIMSGAQDASALLPSGDVYSLPSNATIELTFPATTGAPGAPHPFHLHGHTFAVVRSAGSTKYNYDNPIWRDVVSTGTPAAGDNVTIRFRTDNPGPWFLHCHIDFHLEAGFAVVMAEDIPDTKLANPVPQAWSDLCPIYDALDPSDQ

SEQ ID NO: 15870 - protein, 308 aa, Nicotiana tabacum
GTRLDEEGCIEESGHISEKKRRLSVEQVKALEKNFEVENKLEPERKVKLAQELGLQPRQVAVWFQNRRARWKTKQLERDYGVLKSNFDALKHNYESLKHDNEALLKEILELKSKVYTENGESKGVAVKEEAMESESDDNKVIEQSKPNDNDNNNNNFLENFEEDDEEEEINFENFNVAAAATSTNIFGDNFKDGSSDSDSSAILNEDNSPNAAAISSSGAFLISTNGNGNGNGSSTSLNFCFQFTESSSKSNLGDGQKGNNNYYQPQQYVKMEEHNFFNGEESCSTLFTDEQAPTLQWYCPEDWNWKE

SEQ ID NO: 15871 - protein, 143 aa, Synechococcus sp. PCC 7002
DPVMATGWHMILGGIPLFIASDQLETLQWQFISTSGWWALAYATIFGSAIAYGLFFYLASEGNLTSLSALTFLTPVFALIFGNVLLNEKLSPLQWVGVGLTLVSIYLINQREKIAAWFSQAEAAAGVGTPQDSKIPVESSKRN

SEQ ID NO: 15872 - protein, 331 aa, Danio rerio
MSRPSSAGGAAGGLGAGKAGGSKHGGSGGTTASAAAAAAAAAAAAAAAAAAAGVSGSVAGSGTVPAAAVALPVAALPGQSPELTALFECPVCFDYVLPPILQCQAGHLVCNQCRQKLSCCPTCRGPLTPSIRNLAMEKVASTLPFPCKYSSAGCLLSLHHSEKPEHEEVCEFRPYTCPCPGASCKWQGSLEEVMPHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTSIAHLFADNGNLGINVTISMC

SEQ ID NO: 15873 - protein, 200 aa, Gallus gallus
HASAHASGLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNG

SEQ ID NO: 15874 - protein, 437 aa, Clonorchis sinensis
MSILKITGRQILDSRGYPTVEVDLVTRKGLFRAAVPSGASTGIHEANEMRDSGPEYHGKGVMKAVNNVNKIIAPALIKKNLCVTEQHAIDEFMVTELDGTKNKTHLGANAILAVSLAVLKAGAAEKNLPVYRWVANLAGNEKVTLPVPAFNVLNGGKHAGNRLAFQEFMILPVGAKSFAEAVRMGSETYHCLRNIIKAKYGLDACNVGDEGGFAPNISTPHDALDLLVDAISNAGYVGKILIGMDVASSEMYTTGGKYNMNFKDARQDPNQLISGDKLLDTYIQCLLSHYPIVSIEDPFDQDDWEHWIKFRSRSKVQIVGDDLLVTNPERVRKAIELGACNALLLKVNQIGSFTEALEACQMAKRANWKVMVSHRSGETEDSTIADLAVGINCGQIKTGAPCRSERLAKYNQLLRIEEELGCHAVYAGNVFKQSTLC

SEQ ID NO: 15875 - protein, 163 aa, Daucus carota
MASHQDQSYKAGEPKGHAQEKTGQMADTMKDKAQAAKDKASEMAGSARDRTVESKDQTGSYVSDKAGAVKDKTCETAQAAKEKTGGAMQATKEKASEMGESAKETAVAGKEKTGGLMSSAAEQVKGMAQGATEAVKNTFGMAGADEEEKTTTTRVTRSSARTE

SEQ ID NO: 15876 - protein, 469 aa, Homo sapiens [sequence omitted]

SEQ ID NO: 15877 - protein, 525 aa, Mus musculus
MDLAVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTRLLTDVQLMKGKQECMDSKLLAMKHENEALWREVASLRQKHAQQQKVVNKLIQFLISLVQSNRILGVKRKIPLMLSDSNSAHSVPKYGRQYSLEHVHGPGPYSAPSPAYSSSSLYSSDAVTSSGPIISDITELAPTSPLASPGRSIDERPLSSSTLVRVKQEPPSPPHSPRVLEASPGRPSSMDTPLSPTAFIDSILRESEPTPAASNTAPMDTTGAQAPALPTPSTPEKCLSVACLDKNELSDHLDAMDSNLDNLQTMLTSHGFSVDTSALLDLFSPSVTMPDMSLPDLDSSLASIQELLSPQEPPRPIEAENSNPDSGKQLVHYTAQPLFLLDPDAVDTGSSELPVLFELGESSYFSEGDDYTDDPTISLLTGTEPHKAKDPTVS

SEQ ID NO: 15878 - protein, 535 aa, Mus musculus
MKQSSNVPAFLSKLWTLVEETHTNEFITWSQNGQSFLVLDEQRFAKEILPKYFKHNNMASFVRQLNMYGFRKVVHIESGIIKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAPKKNLYQHIVKEPTDNHHHKVPHSRTEGLKSRERISDDIIIYDVTDDNVDEENIPVIPETNEDVVVDSSNQYPDIVIVEDDNEDEYAPVIQSGEQSEPAREPLRVGSAGSSSPLMSSAVQLNGSSSLTSEDPVTMMDSILNDNINLLGKVELLDYLDSIDCSLEDFQAMLSGRQFSIDPDLLVDLFTSSVQMNPTDNIKYTKSENKGLEATKSSVVQHVSEEGRKSKSKPDKQLIQYTAFPLLAFLDGNSASAIEQGSTTASSEVVPSVDKPIEVDELLDSSLDPEPTQSKLVRLEPLTEAEASEATLFYLCELAPAPLDSDMPLLDS

SEQ ID NO: 15879 - protein, 144 aa, Gossypium gossypioides
LGTSTFSEYTVVHVGQVAKINPEAPLDKVCVLSCGMSTGFGATMNVAKPKKGGSVAVFRLGAVGLAAAEGARVCEASRIIGIDLNPNRFEEAKKFGCTEFVNPKDYNKPIQEVIAEMTGGGVDCSIECTGSTQAMVSAFECVHD

SEQ ID NO: 15880 - protein, 144 aa, Gossypium davidsonii
LGTSTFSEYTVVHVGQVAKINPEAPLDKVCVLSCGISTGFGATVNVAKPKKGGSVAVFGLGAVGLAAAEGARVCEASRIIGIDLNPNRFEEAKNFGCTEFVNPKDHNKPIQEVIAGMTGGGVDCSIECTGSTQAMVSAFECVHD

SEQ ID NO: 15881 - protein, 144 aa, Gossypium schwendimanii
LGTSTFSEYTVVHVGQVAKINPEAPLDKVCVLSCGMSIGFGATVNVAKPKKGGSVAVFGLGAVGLAAAEGARVCEASRIIGIDLNPNRFEEAKKFGCTEFVNPKDHNKPVQEVIAEMTEGGVDCSIECTGSTQAMVSAFECVHD

SEQ ID NO: 15882 - protein, 144 aa, Gossypium turneri
LGTSTFSEYTVVHVGQVAKINPEAPLDKVCVLSCGMSTGFGATVNVAKPKKGGSVAVFGLGVVGLAAAEGARVCEASRIIGIDLNPNRFEEAKKFGCTEFVNPKDHNKPVQEVIAEMTGGGVDCSIECTGSTQAMVSAFESVHD

SEQ ID NO: 15883 - protein, 503 aa, Arabidopsis thaliana
MGSEATTAVNNLQQPLLESTKSEADFRMESVLTDTHLSYFRRIYLASLIEMKYLFHLAAPAIFVYVINNGMSMLTRIFAGRLGSMQLAAASLGNSGFNMFTLGLMLGMGSAVETLCGQAHGAHRYDMLGVYLQRSTIVLVITGLPMTLLFIFSKPLLISLGEPADVASVASVFVYGMIPMIFAYAVNFPIQKFLQSQSIVTPSAYISAATLVIHLILSWLSVFKFGWGLLGLSVVHSLSWWIIVLAQIIYIKISPRCRRTWDGFSWKAFDGLWDFFQLSAASAVMLCLESWYSQILVLLAGLLKDPELALDSLAICMSISAMSFMVSVGFNAAASVRVSNELGAGNPRSAAFSTAVTTGVSFLLSLFEAIVILSWRHVISYIFTDSPAVAEAVAELSPFLAITIVLNGVQPVLSGVAVGCGWQAYVAYVNIGCYYIVGIPIGYVLGFTYDMGARGIWTGMIGDTLMQTIILVIVTFRTDWDKEVEKASRRLDQWEDTSPLLKQ

SEQ ID NO: 15884 - protein, 337 aa, Oryza sativa (japonica cultivar-group)
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKECALVQNDKDYQPEGVQWYQNIGLASSPLGAIDFVHPYLIQWLKIANGIMDHCSSLPFEFEWQRIQTPKHEHFSIADVH

SEQ ID NO: 15885 - protein, 214 aa, Paeonia californica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPERFEGAKKFGVTEFVNPKDYNKPVQEVIAEMTGGGVDRSVECTGSIMAMISAFECVHD

SEQ ID NO: 15886 - protein, 214 aa, Paeonia suffruticosa subsp. spontanea
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMMSAFECVHD

SEQ ID NO: 15887 - protein, 214 aa, Paeonia szechuanica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTECVNPKDYNKPVQEVIAEMTGGGVDRSVECTGSIMAMMSAFECVHD

SEQ ID NO: 15888 - protein, 214 aa, Paeonia tenuifolia
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 15889 - protein, 214 aa, Paeonia veitchii
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAIISAFECVHD

SEQ ID NO: 15890 - protein, 214 aa, Paeonia lactiflora
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 15891 - protein, 214 aa, Paeonia lactiflora
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 15892 - protein, 214 aa, Paeonia lutea
IVESVGEGITDLKPGDHVLPVFTGECKECRHCKSEESNMCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVGCTGSIMAMVSAFECVHD

SEQ ID NO: 15893 - protein, 214 aa, Paeonia rockii
IVESVGEGVTDLKPGGHVLPVFTGECKECRHCKSEESNMCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKSGVTEFVNPKDYDKPAQEVIAEMTDGGVDRSIECTGSIMAMVSAFECVHD

SEQ ID NO: 15894 - protein, 214 aa, Paeonia suffruticosa subsp. spontanea
IVESVGEGVTDLKPGDQVLPVFTGECKECRHCKSEESNLCDLLRINTDRGVMLSDGKSRFSINGQPIFHFIGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 15895 - protein, 685 aa, Helicobacter pylori
MGSYFMESPMKKKANEEKAPKRAKQEAKTEVAQENKAKENNKTKESKIKENKTKESKIKEAKAKEPVPVKKLSFNEALEELFANSLSDCVSYESIIQISAKVPTLAQVKKIKELCQKYQKKLVSSSEYAKKLNAIDKIKKTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDSKKDDDNEEDEENEERKKVVSEKDRKRVEKVQESFKALDKAKKEWLKALEAPVDEKEDELVRLLTLAYKRQTLKDRLYDLEPTSKLINELVKTMETTLKSGDGFEKELKRLEYKLPLFNDTLIANHKKILANITNMTKEDIIAQVPEATMVSVYMDLKKLFLTKEASEEGFDLAPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQETGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESDRTLEEIGKELNVTRERVRQIESSAIKKLRSPQYGRILRNYLRI

SEQ ID NO: 15896 - protein, 453 aa, Volvox carteri
MSKLLLVALFGAIAVVATSAEVLNLNGRSLLNNDDPNAFPYCKCTYRQRRSPYRLKYVGAENNYKGNDWLCYSIVLDTTGTVCQTVPLTEPCCSADLYKIEFDVKPSCKGTVTRAMVFKGIDRTVGGVRVLESISTVGIDDVTGVPGAAILRIVKDLALPYSVVASFLPNGLPVCINRVPGSCTFPELFMDVNGTASYSVFNSDKDCCPTGLSGPNVNPIGPAPNNSPLPPSPQPTASSRPPSPPPSPRPPSPPPPSPSPPPPPPPPPPPPPPPPPSPPPPPPPPPPPPPPPPPPSPSPPRKPPSPSPPVPPPPSPSAVTISGGAGERVCLKISVDNAAAATCNNGLGGCCSDGLEKVELFANGKCKGSILPFTLSNTAEIRSSFSWDSTRPVLKFTRLGLTYAQGVAGGSLCFNIKGAGCTKFADLCPGRGCTVAVFNNPDNTCCPRVGTIA

SEQ ID NO: 15897 - protein, 166 aa, Pelargonium x hortorum
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 15898 - protein, 1216 aa, Bos taurus
MAGAQPGVHALQLKPVCVSDSLKKGTKFVKWEDDSTVVTPIILRTDPQGFFFYWTDQNKETELLDLSLVKDARCGKHAKAPKDPKLRELLDVGNIGRLEHRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLAKKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLDKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNRSFEMSSFVETKGLEQLTKSPVEFVEYNKMQLSRIYPKGTRVDSSNYMPRLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPIWEEEPIVFKKVVLPSLACLRIAVYEEGGKFIGHRILPVQAIRPGYHYICLRNERNQPLMLPALFVYIEVKDYVPDTYADVIEALSNPIRYVNLMEQRAKQLAALTLEDEEEVKKEADPGETPSEAPSEARPTPAENGVNHTTSLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKTAKKDNKKKSEPSSPDHVSSTIEQDLAALDAEMTQKLVDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHSSAPPLMTSDSGKLNQKPPSSEELEGENPGKEFDTPL

SEQ ID NO: 15899 - protein, 460 aa, Oryza sativa (japonica cultivar-group)
MSSSSPSLLSRRSTAELELPVPPEFRCPISLELMRDPVVGPTGITYDRAGIEAWLLAAGAGKTAAASSTCPVTKGDLRADDLVPNHALRRVIQAWCVANRCRGVERIPTPRVPVTPAQAGEVLGEVEAAARAGDAARCVAAVREVGRLARESDRDRRCLASAGAARALAAAVASFPAASDSASASSVLLDDVLAALVLVMPLDEEAIVAIGSSAASVALLANVAKHGDLQRRLQAVVVIREIVALSSCCSRNGGAATAIDLSDNLDGIIEVLVNTIRDPISPQATKASLVAAYHLALADGHAAARLAEAGLVPSLVELLIDGDRSTAEKALAALDATLASEAGRARAQADALAVPVLVKKMFRVSDTATELVVSALHRICKKWHDGDDDEVGSPAARRSAVVEAVQVGAFQKVMMLLQVGCRDATKEKATELLKLMIKYETRGGAHCIDAMDFRGLKRVS

SEQ ID NO: 15900 - protein, 354 aa, Loligo pealei
MACCLSEEAKEQKRINQEIEKQLRRDKRDARRELKLLLLGTGESGKSTFIKQMRIIHGAGYSEEDRKGFEKIVYQNIFSAIQTLIAAMETLSLEYKDPANNEHAEFLNSIDADAADTFEQAHVDAIQGCWKDPGMQECYDRRREYQLTDSAKYYLDDVERIHEPGYIPTLQDILRVRVPTTGIIEYPFDLDSIIFRMVDVGGQRSERRKWIHCFENVTSIMFLVALSEYDQVLVESDNEENRMEESKALFRTIITYPWFQNSSVILFLNKKDLLEEKIMTSHLVDYFPEYDGPKCDYEAAREFMCDSYMDLNEDKEKMLYYHYTCATDTENIRFVFAAVKDTILQLNLKEYNLV

SEQ ID NO: 15901 - protein, 481 aa, Paramecium tetraurelia
MTINLVYDQRQCQGVLGVGAFSQVRKVTHRKTRAIRAMKVISKSRLSTTELQQNFINEINVYKQLDHPHILKLYEFYQDEKNFYIIIELCTGGELFDKIIEKGSFSEKEASYVMKQIMSAVLYAHNQNIVHRDLKPENVLLDITSQGNYNVKVVDWGTAKIFSPNQQINEKFGTLYYMAPEVLKRNYNEKCDIWSCGVILYILLSGMPPFGGKTDLEIQKSITYGKYTLDSDVWNSVSAHAKDLVSQMLQYDVQKRLSAKQVLEHPFLQLQHQEKVDKQIVQCRLKNLVNFRAEQKLQQATLMFIGTTMISKEEKNQLMQAFKEMDQNGDGILTKEEILETYKKYMDDETACQEVQKIMDLVDMDGSGTIDYTEFIIATMDRKKAVQKEKLKEAFQIFDKDGNGFISEQEIKDVLGPSITGIDEKYWMNMIKEIDKNGDGQISYEGILCNDDENHLMIYIDQFHLYKKRSSIALNISYICV

SEQ ID NO: 15902 - protein, 493 aa, Paramecium tetraurelia
MGPCSSQQRKPVSTSQALVPGLNQRMQRSFRYVPISLRHQNKVPQVPIIKLRKVWVQVVRYVKLGAFGEVRLVIHKSSGYKRAMKQIRKDKIIKEDEENMFSEVNTLKELDHPNIVKLHELFQDAKNYYLVTEYLEGGELFQKITDMKHFSEKMAADIMKQILAGVVHCHEKKVVHRDLKPENILFENKKPNSNLKIIDFGTSRKMETNQNLTKRLGTPYYIAPEVLKRNYNEKCDVWSCGVILYIMLCGYPPFGGQDQQILQNIELGKYEFDPEDWNKISEDAKNLIKRMLTKDYQLRISAQEAYNDPWIQKNAPNGPIDMKAIKNLSSFFGKNKVRAALMQFITTNLMTNTEKEGLLNEFKKIDKDGNGQISKDELLQVYMKQYDEIKAKQMVDDIFEKVDINRSGFVDFTEFMMSASSEEKLLSKIKLQQAFNMFDTNGDGQISREELQEIMGGVDDNLWTEILQMCDANGDGQISQQEFIDFLVKKYQQ

SEQ ID NO: 15903 - protein, 358 aa, Acinetobacter sp. ADP1
MFIKNAWYVACRPEEIQDKPLGRTICGEKIVFYRGKENKVAAVEDFCPHRGAPLSLGYVEDGHLVCGYHGLVMGCEGKTIAMPAQRVGGFPCNKAYAVVEKYGFIWVWPGEKSLANEADLPTLEWADHPEWSYGGGLFHIQCDYRLMIDNLMDLTHETYVHSSSIGQKEIDEALPVTKVDGDHVVTERYMENIIAPPFWQMALRGNHLADDVPVDRWQRCHFFAPSNVHIEVGVAHAGHGGYNAPKTRKSLQWLSIVVTPETETSHWYFWGMARNFQPENQQLTDQIREGQGKIFTEDLEMLEQQQQNIVRNPQRQLLMLNIDAGGVQSRKIIDRLLAKENSPSPQDTQRKFPNIRVI

SEQ ID NO: 15904 - protein, 316 aa, Acinetobacter sp. ADP1
MTTMNAIYQHASSTEQYLDLGLRDQWYPVLASWEVSANPVGITRLGENIVVWRDEAGQLYALEDRCPHRGARLSLGWNLGDRVACWYHGVRSGGRMVLVADVPAVHECPLKGAACVKSYPIIEKHDAIFIWFGIDANEPPAELVFPEQLASEAWSSCLCQADWKVNHQYAIDNVMDPMHGTYLHCTSHSMAEGERTAEMKHRSTEHGFIFEKEGQTGVNFDWVEYGNTGASWLRLSIPYRKDFGPGGVFWIVGFATPIDADNTRVFFWRCRKVNGWQRNVWRFLYRNHLEKLHWDVLEQDRIILENLAPNARSKEF

SEQ ID NO: 15905 - protein, 308 aa, Neocallimastix frontalis
MAQKKQQQKLGFYEDFLLAGVSATISKTAAAPLERVKLLVQNQGEMLKSGRLATPYKGIGDCFVRVAKEVGIASFWRGNGANIIRYFPTQALNIAFKERIKNALAVDKEKEGYAEWLVGNIASGGAGGALSQVFVYSLDYARTRLANDAKSANGGERQYKGLIDVYKKTYKADGITGLYRGFALSCVGIMVYRGLYFGLYDSMKPLLKNLGMEGSFAASFILGWGVTTVAGIASYPIDTIRRRMMMTSGETVKYKSSIDCAKQVMQKEGVQAFFKGCGANILRGVAGAGVLSGFDKIKEVYINWRIKN

SEQ ID NO: 15906 - protein, 194 aa, Mirabilis jalapa
MMKNDMNKSGGGVIAKDVNDNTKVNGANNNADLAKPPAKAQVVGWPPVRSYRKNMLAVQKSTGAPESESEKPAANGGLVKVSMDGAPYLRKVDLKLYKSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 15907 - protein, 147 aa, Oryza sativa (japonica cultivar-group)
MPLRRKILNLNPPTSPLPEQQSPQGFCHPNRRRLRFLQGILRYGLLAEGWEPRQAVRRLGLAAVPGGISYGTDDQSLKEAFANYGEVIEARVIVDRTTGRSRGFGFVTYTSTDEAAAAITGMDGKVCCANFVISIGLQFNFYLRFNA

SEQ ID NO: 15908 - protein, 1060 aa, Drosophila melanogaster
MEATTTTTPDLNRGDATRKSVRLYAARKGAAPAPPKLSVAPSSNQNSNHSSNNNNSSSNLPETEKEMELRQTHLANKDLDGATEDDSIVELRRRDAQATPLPRIAVSALPTLQPHPTPKERQKPPMPRLLSTEDDAGVSFALGSIEKHIHNVEESFKQQQQNQQSQSSMDVMKLEIKRKQSKRYGETENLLRPGISDMSSENDFQYLGGRRAGELDDSNELMLSEFQRGSDGRNSIGAYSKNSAAAANGANAVKAKLARTASDTKNNDTVLAMRATFKQKQHLQDEKQPAVWRPAGTGPTPAARSSSSTTSTSGSASRGGSSSSVVDGVAPSKLTATTISASKRREENLRQFEALLAQKSSHRHGASGASGTGSNAASSKRRSDRPIVAPIPPYNSSRAEHVTSSTRHSVDPRSHSGHESRSGTASTHPPVGHHPTSRVPSVVANRSNVYSNNAAQGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGAETLRVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKMASAVKSSRHFPRNVPSRSTFHSGQTRARNNTALEYSGTSGASGDSSHPGRMSFFSKLSSRFSKRPNQ

SEQ ID NO: 15909 - protein, 329 aa, Oryza sativa (japonica cultivar-group)
MAVAVEEIVRRAGGCAVIDGGFATQLEALGADINDPLWSAACLITKPHLIKEVHMQYLEAGADVIISSSYQATIPGFLARGMLLEEAEGLLRRSIELALEARDEFWKSTLRKSKPVYNRALVAASIGSYGAYLADGSEYSGSYGEDITAEKLKDFHRRRLQVLASAGPDLIAFEAIPNKMEAQALVELLEEENIQVPSWICFSSVDGKNLCSGESFAECLQFLNASDKVTIVGVNCTPPQFIEGIIRELKKQTKKAIAVYPNSGEIWDGRAKRWLPAQCFGHKSFDALAKRWQEAGASLVGGCCRTTPSTIRAVSKVLKGKTSYSATQI

SEQ ID NO: 15910 - protein, 695 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMFDLTV

SEQ ID NO: 15911 - protein, 719 aa, Homo sapiens
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLYYYWVPLLTVIFGSYLIAHGFFSVYAMCVETIFICFCEDLERNDGSTEKPYFVTPNLHGILIKKQLVPQKQKE

SEQ ID NO: 15912 - protein, 404 aa, Oryza sativa (japonica cultivar-group)
MTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANAKEESKIIDLTIPLGTPNPSDAEVLVTRKQQVAVVHTPACQVGRANERLKAHHSN

SEQ ID NO: 15913 - protein, 253 aa, Oryza sativa (japonica cultivar-group)
MASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQKYRMQLKKSIPTTSKHGATLSSTALDKTQDHPSRSQYFNQDGCKEIMDYSLPRDDLSSGSECMLEELNDYSSEGFQDFRWDSDKQEYGPCFWNF

SEQ ID NO: 15914 - protein, 151 aa, Oryza sativa (japonica cultivar-group)
MDKIHPKYQNCSLFFLPDAEKAAATGGSHERDALLTTVATEKRISLIKAWEENEKAKADNKAAKKLADIASWENSKVAEIEAEIKKYQEYLERKKAEQVEKLMNGVAKVHRAAEEKRAATEARRGEEVVKAEEAAAKYRAKGEPPKKLLFG

SEQ ID NO: 15915 - protein, 102 aa, Oryza sativa (japonica cultivar-group)
MSPRLTETFAHRAAKKLADIASWENSKVAEIEAEIKKYQEYLERKKAEQVEKLMNGVAKVHRAAEEKRAATEARRGEEVVKAEEAAAKYRAKGEPPKKLLFG

SEQ ID NO: 15916 - protein, 269 aa, Argopecten irradians
MGFVKVVKNKAYFKRFQVKFRRRREGKTDFYARKRLVIQEKNKYNTPKYRLIVRFTNKDIICQIAYARIEGDHIICSAYAHELPRYGVKVGLTNYSAAYCTGLLLARRLLKQFKLDSVYAGQEEVDGDEYYVEDVDGEAGAFRCYLDAGLVRTSTGARVFGALKGAVDGGLDIPHSTKRFPGYDGESNEFNAEVHRNHIFGKHVAGYMAHLQEEDEEAYKRQFSRFIKNGLNSENLEEMYKKGHAAIRANPERATKTKKAPAGKVKRWN

SEQ ID NO: 15917 - protein, 323 aa, Mesocricetus auratus
MNSKQQTVRLSDGHVLPVLGFGTYATSEVPKTKVTEATKIAIDAGFRHIDSASMYQNEEEVGLAIRSKIEDGTVKREDIFYTTKLWCTFHHPELVPFCLEQSLKKLQLDYVDLYLIHFPMSLKPGENYFPKDKNGKFIYDTVDLCATWEAMEKCKDVGLTKSIGVSNFNRRQLEMILNKPGLKHKPVCNQVECHPYLNQKKLMDFCKSKDIVLVAYSALGSHREKAWVDQNLPILLDDPVLDSMAKKYKRTPALIALRYQLQRGIVVLAKSFTEKRIKENMQVFEFQLTSGDMKIIDDLNKNIRYIACHEFKDHPGFPFSDEY

SEQ ID NO: 15918 - protein, 203 aa, Zinnia elegans
MGKVSKADKKIAYDQKLCQLLDDYNQVLVAAADNVGSNQLQNIRQGLRGDSVILMGKNTMMKRSIRMHSEKTGNKAYLNLIPLLVGNVGLIFTKGDLKEVREEVAKYKVGAPARVGLVAPVDVVVPPGNTGLDPSQTSFFQVLNIPTKINKGTVEIITPVELIKKGDKVGSSEAALLAKLGIRPFSYGLVVQSVYENGSVFKP

SEQ ID NO: 15919 - protein, 553 aa, Halocynthia roretzi
MGKENLVENGSGQYSEKPKATFSLIMGVAMAVIGSSFQYGYNIAVVNAPADEIKDFFFGPYKTVVIINSTTPAYNYTTAMTSLNSTQFPFTEAVIKTETIVVDEDLRVYRDNMYAIAVSAFAASGMVGSILVGPVVKRFGRCGGLMVNNCISLIAAVFLGFSKLANSFIMIIIGRVFIGIFAGLATGIVPMYIGEISPKEWRGAIGVLNQLLITIGILVAQLLGLQGALGTPDLWPILLGFTAIPSIIQIIARPFMPKSPRYLLIDQHKSDEARNTLVKLRGTDNIASEMDEMQNEADSEISVGQMSIAQLFKDHTVRWQLIIVLSIMVAQQLSGINAVFFYTNEIFESAKIPAGNQQDLASVGVGVVNVLMTIVSVGVIEWAGRKSLLVWGFGMMIFWCIAMTVVLNLLQTITVAWISYLSIACVIGYIVGFAIGPGPVPWLVTAELFRQAARPPAFMIACLLNWTCNFLIGIGFPAVNKATGPYVFLIFMVVCIAITVFLSLVMPETKGKTFQEINNLFAKRNGVRESSTNNDKSMRIPLKDFGNEAGDRV

SEQ ID NO: 15920 - protein, 346 aa, Nierembergia sp. NB17
MEVASRVQAIASLIKCMDTIPSEYIRSENEQPATTTLHGVELQVPVIDLAPRVVGDEQHDHDDVEVVKQIADASKEWGIFQVINHGIPNDVIADLQKVGKEFFENVPQEEKELIAKTPGSNEIEGYGTSLQKEVEGKKGWVDHLFHKIWPPSSINYRYWPKNPPSYREANEVYGKKLREVVDKIFKSLSLGLGLEAHEMKEAAGGDDIVYLLKINYYPPCPRPDLALGVVAHTDMSYITILVPNEVQGLQVFKDGHWYDVKYIPNALIVHIGDQVEILSNGKYKSVYHRTTVTKDKTRMSWPVFLEPPSEQEVGPIPKLVNEANPPKFKTKKYKDYVYCKLNKLPQ

SEQ ID NO: 15921 - protein, 503 aa, Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 15922 - protein, 284 aa, Arabidopsis thaliana
MMFEKDDLGLSLGLNFPKKQINLKSNPSVSVTPSSSSFGLFRRSSWNESFTSSVPNSDSSQKETRTFIRGIDVNRPPSTAEYGDEDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRVLKLSPQFYMHMSPPTTLTMCPSCEHVSVPPPQPQAATSAHHRSLPVNAWAPATRISHGLTFDALRPRS

SEQ ID NO: 15923 - protein, 323 aa, Homo sapiens
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 15924 - protein, 400 aa, Homo sapiens [sequence omitted]

SEQ ID NO: 15925 - protein, 416 aa, Homo sapiens [sequence omitted]

SEQ ID NO: 15926 - protein, 474 aa, Homo sapiens [sequence omitted]

SEQ ID NO: 15927 - protein, 349 aa, Homo sapiens
MCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 15928 - protein, 472 aa, Mus musculus
MATKCTKCGPGYSTPLEAMKGPREEIVYLPCIYRNTGTEAPDYLATVDVDPKSPQYSQVIHRLPMPYLKDELHHSGWNTCSSCFGDSTKSRNKLILPGLISSRIYVVDVGSEPRAPKLHKVIEASEIQAKCNVSSLHTSHCLASGEVMVSTLGDIQGNGKGSFVLLDGETFEVKGTWEKPGDAAPMGYDFWYQPRHNVMVSTEWAAPNVFKDGTNPAHVEAGLYGSRIFVWDWQRHEIIQTLQMTDGLIPLEIRFLHDPSATQGFVGCASAPNIQRFYKNAEGTWSVEKVIQVPSKKVKGWMLPGVPGLITDILLSLDDRFLYFSNWLHGDIRQYDISNPQKPRLAGQIFLGGSIVRGGSVQVLEDQELTCQPEPLVVKGKRIPGGPQMIQLSLDGKRLYATTSLYSAWDKQFYPDLIREGSMMLQIDVDTVNGGLKLNPNFLVDFGKLPLGAALAHELRYPGGDCSSDIWI

SEQ ID NO: 15929 - protein, 386 aa, Mus musculus
MAVPHHSLETSYLLPPDPEDWEKQGIPDFVYGQEDLVGKEVQWPRDSPSAVDTVPLSRFDSALRSAWRQRLELGLFRYRLEDLQTQILPGSVGFVAQLNIDRGIQRRRPQNIRSVRQEFDPEQFNFNKIRPGEVLFRMQREPKGPATPKQEDDVLVVINVSPLEWGHVLLVPAPAQGLPQRLLPGVLRVGLEAVLLSLHPGFRVGFNSLGGLASVNHLHLHCYYLAHPLPVEGAPSTPLDPKGCIHLLQALPAPGFLFYTSGPGPDLEVLISRVCRATDYLSDREIAHNLFVTRGAPPGPTSSTSDLSGIRVILWARKSSFGIKESGAFNVALCELAGHLPVKTSQDFSSLTEAAAVALIQDCLLPETQAGEVRAALVALMAQEEL

SEQ ID NO: 15930 - protein, 259 aa, Listeria monocytogenes
MPKVSQPDKEAKEKVYIWIAAYQENGDEDAQYNLVVHYKNLVESIARKYSQGKSFHEDLVQVGNIGLLGAIRRYDATFGKSFEAFAVPTIVGEIKRFLRDKTWSVHVPRRIKELGPKIKNAVEELTRELQSSPQISDIADFIGVTEEEVLEAMEMGKSYQALSVDHSIEADSDGSTITLLDVVGGTDDGFERVNQRMLLEKVLPVLDEREQKILQFTFIENRSQKETGELLDISQMHVSRIQRQAIKKLREALQNEEVE

SEQ ID NO: 15931 - protein, 259 aa, Listeria monocytogenes
  unsure (1)..(259): unsure at all Xaa locations
MPKVSQPDKEAKEKVYIWIAAYQENGDQDAQYNLVVHYKNLVESIARKYSQGKSFHEDLVQVGNIGLLGAIRRYDATFGKSFEAFAVPTIVGEIKRFLRDKTWSVHVPRRIKELGPKIKNAVEELXRELQSSPQISDIADFIGVTEEEVLEAMEMGKSYQALSVDHSIEADSDGSTITLLDVVGGTDDGFERVNQRMLLEKVLPVLDEREQKILQYTFIENRSQKETGELLDISQMHVSRIQRQAIKKLREALQNEEVE

SEQ ID NO: 15932 - protein, 384 aa, Pisum sativum
MGLLCSKSNRYNDAKAEENAQTAEIERRIELETKAEKHIQKLLLLGAGESGKSTIFKQIKLLFQTGFDEAELKSYLPVVHANVYQTIKLLHDGSKEFAQNDVDFSKYVISTENKDIGEKLSEIGGRMDYPRLTKELAQEIESMWKDAAIQETYARGNELQAPDCTHYFMENLQRLSDANYVPTKEDVLLARVRTTGVVEIQFSPVGENKKSGEVYRLFDVGGQRNERRKWIHLFEGVSAVIFCVAISEYDQTLFEDENKNGMMETKELFEWVLKQQCFEKTSFMLFLNKFDIFEKKILDVPLNVCEWFKDYQPVSTGKQEIEHAYEFVKKKFEESYFQSTAPDSVNRVFKIYRTTALVKKVVKKTFKLVDETLRRRNLFEAGLL

SEQ ID NO: 15933 - protein, 138 aa, Oryza sativa (japonica cultivar-group)
MAGKGGKGLLAAKTTAAKSADKDKDKKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTSKE

SEQ ID NO: 15934 - protein, 379 aa, Oryza sativa (japonica cultivar-group)
MEKMMPGMVKEEWPPSSPEEGEAPRPMEGLHEVGPPPFLTKTFDLVADPATDGVVSWGRAGSSFVVWDPHVFAAVFLPRFFKHNNFSSFVRQLNTYFLVRTNYLNKRSHFYSLRFQGFRKIDPDRWEFANDGFLRGQRHLLKMIKRRRPLSYLPGSQQALGTCLEVGQFGLDEEIDRLKRDKNILLAEVVKLRHKQQSTKANMRAMEERLQHAEQKQVQMMGFLARAMQNPDFFHQLIHQQDKMKGLEDTFSKKRTRSIDIVPFLNPGEVSQGDQLESTLLFDPRPFAELNDEPAKSELENLALNIQGLGKGKQDVNRTRNQPRNQASNETELTDDFWEELLNEGARDDAGIPGMERRRPRYVDALAQKLGYLSNSSQK

SEQ ID NO: 15935 - protein, 326 aa, Listeria monocytogenes
MPVISYIDAITMALKEEMERDDKVFILGEDVGKKGGVFKATAGLYDEFGEDRVLDTPLAESAIAGVGIGAAMYGYRPVAEMQFADFIMPAVNQIISEAARIRYRSNNDWSCPMVIRAPFGGGVHGALYHSQSVEKVFLGQPGLKIVVPSSPYDAKGLLKAAIRDNDPLFFEHKRAYRLLRGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 15936 - protein, 1214 aa, Homo sapiens [sequence omitted]

SEQ ID NO: 15937 - protein, 190 aa, Malus x domestica
NGIIKKAKEITVLCDAKVSLIIYSSSGKMVEYCSPSTTLTEILDKYHGQSGKKLWDAKHENLSNEVDRVKKDNDSMQVELRHLKGEDITSLNHVELMALEEALENGLTSIRDKQSKFVDMMRDNGKALEDENKRLTYELQKQQEMKIEENVRNMENGYHQRQLGNYNNNQQQIPFAFRVQPIQPNLQERI

SEQ ID NO: 15938 - protein, 237 aa, Malus x domestica
MGRGKIEIKLIENQTNRQVTYSKRRNGIFKKAQELTVLCDAKVSLIMLSNTSKMHEYISPTTTTKSMYDDYQKTMGIDLWRTHYESMKDTLWKLKEINNKLRREIRQRLGHDLNGLSYDDLRSLEDKMQSSLDAIRERKYHVIKTQTETTKKKVKNLEERRGNMLHGYEAASENPQYCYVDNEGDYESALVLANGANNLYTFQLHRNSDQLHHPNLHHHRGSSLGSSITHLHDLRLA

SEQ ID NO: 15939 - protein, 298 aa, Gallus gallus
MADQAISFLKDFLARGVAAAISKTAVAPIERVKLLLQVQHASKQIAADKQYKGIIDCVVRIPKEQGVLSFWRGNLANVIRYFPTQALNFAFKDKYKQVFLGGVDKHTQFWRYFAGNLASGGAAGATSLCFVYPLDFARTRLAADVGKAGADREFSGLGDCLVKITKSDGLRGLYQGFNVSVQGIIIYRAAYFGIYDTAKGMLPDPRNTHIVISWMIAQTVTAVAGVVSYPFDTVRRRMMMQSGRKGADIMYSGTIDCWRKIARDEGGKAFFKGAWSNVLRGMGGAFVLVLYDEFKKVI

SEQ ID NO: 15940 - protein, 299 aa, Oryza sativa (japonica cultivar-group)
MAEKIVDPSRRRDIPRAARAAAVADLALAAGHRAAARRRRRTPYWGGEGFGEMPPKRQRSAAGPSGEAPVNSLDDGCLMHIFSFLSPIPDRYNTALVCHRWRFLACHPRLWLRVERPIRNTIEPGVYPNLESAVSAARPGDTILIAAGGTHVARNIQIKKPLCIQIGGGELPDDTVLTCSRGSDSALEFHSTCKIANLTIRAELGCCLLHRSGRLTIEECLLQCEQNPLDYLSFPIISTAIEYDSFSSLKEQGHGVTVVRTRIEGGAKAVRTNGTLALQHVRAIYSRSSVFFWFEVGER

SEQ ID NO: 15941 - protein, 297 aa, Oryza sativa (japonica cultivar-group)
MAPAATGGGGGEDDAAVPLLLPVLPPAAGWCSWEWEDVAISAGLVAVQLAGAAYMVVLAPVLALGLDPLFLVTFGSLATGLFTLPFAINLERKRWPSHLNANHLLLRLFLLALGVTVFQALMLHGMKKTSPAIASTMPNLAPVFIFVVAACLGFERVDLSCRYTRAKIAGTVLCLAGAVTMSVLQSPAAAAATRSSSHRTTTAAAANAGGGDWAVGCACLLGAVLVVSGTTVLQAATMVHFPAPFTLCSATSLAGAALTGAFQAATAAGGLSPGTPQISLQIILSLLLVFYVFHKSF

SEQ ID NO: 15942 - protein, 449 aa, Oceanobacillus iheyensis HTE831
MHMYQTTTLKDKIKLFIIILLPILITQVSINLMSFFDTMMSGQFSARDLAGVAIGSSLWVPILTGINGIVLSITPIIAHLIGAKNKKDIPQVIQQGIYLSFVLSIIIIVIGGIALDPILQAMSLEKEVQRIAKYYLITLGTGIVPLFLFHTIRSFMDGLGQTRSSMIIILISLPINAVLNYILIFGKFGIPAFGGIGAGIATSLTYWIISGISIFMIHRVYPFHSYKVFQKILPPTLSYWADQLKIGLPIGLAIFFETSIFSAVTLLMSEYNTNTIAAHQAAMNFASLLYMLPLSVGMALTIAVGFEVGAKRLHDAKRYTYLGIMGGLFIAIFAGIILYTFDDVVARLYNSNPEVIELTKQFIIFAIFYQLADAIGAPIQGALRGYKDVNMTLVIALISYWIIGLPTGYLLANYTALEPFGYWVGIIVGLSTGAIALLARLLFIQKKSV

SEQ ID NO: 15943 - protein, 706 aa, Mus musculus
MGKDSQNYYGKHGTPQKYDPTFKGPIYNRGCTDVICCVLLFLAIVGYVAVGIIAWTHGDPRKVIYPTDSRGEFCGQKGTKNADKPFLFYFNIVKCANPLVLLEFHCPTPQICVKQCPDRYLTLLSARNTRDFDYYKQFCVPGFQNNKGVTEILRDGECPAVITPSKPLAQRCFPAIHASKGVLMVGNETTYEDGHGARKNITDLVEGAKKANKILEARQLAMQIFEDYTVSWYWIIIGLVIAMVLSLLFIVLLRFLAGIMVWVMIVMVILVLGYGIFHCYMEYSRLRGEAGSDVSLVDLGFQTDLRVYLHLRQTWMAFMIILSILEVVIILLLIFLRKRILIAIALIKEASRAVGHVMCSLLYPLVTFFLLCLCIAYWASTSVFLSTSNTAVYKVVDDTACPLLRKTCNPETFPLRNESLQCPTARCQFAFYGGESTYHRALLGLQIFNAFMFFWLANFVLALGQVTLAGAFASYYWAMRKPDDMPAFPLFSAFGRALRYHTGSLAFGSLILAIVQIIRVMLEYLDQRLKAAQNKFAKFLMVCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIIGSYLIAHGFFSVYGMCVDTLFLCFLEDLERNDGSAERPYFMSSTLKKLLNKTNKKVAES

SEQ ID NO: 15944 - protein, 785 aa, Mus musculus
MLCGGWKRSRRSPEESRVSAQVAAPLAFPPSPASSDSSTKRPGLRALKKMGLTEDEDVQAMLRGSRLLKIRSRTWHKERLYRLQEDGLSVWFQRRIPRAASKHIFFVQHIEAVREGHQSEGLRRFGGAFAPACCLTIAFKGRRKNLDLAAPTAEEAQRWVRGLAKLRARLDAMSQRERLDHWIHSYLHRADSDQDSKMSFKEIKSLLRMVNVDMNDMYAYRLFKECDHSNNERLEGAEIEAFLRRLLKRPELEEIFRRYSGEDRVLSASELLEFLEDQGEDGATLACAQQLIQTYELNETAKQHELMTLDGFMMYLLSPEGAALNVAHTCVFQDMGQPLAHYFISSSHNTYLTDSQIGGTSSTEAYIRAFAQGCRCVELDCWEGPGGEPVIYHGHTLTSKILFRDVIQAVRDHAFTSSPYPVILSLENHCGLEQQAVMARHLRSILGDMLVTQALDSQNPEELPSPEQLKGRILVKGKKLPAARSEDGRILSDREEEEEEEEEAEEALEAAEQRSRAKQISPELSALAVYCCATRLRTLEPSPGPPQSCTVGSLSERKARKFTREAGTSFVRHNTQQLTRVYPLGLRMNSANYNPQEMWNSGCQLVALNFQTPGYEMDLNTGRFLINGQCGYVLKPAYLRQLNTTFDPECPGPPRTTLAIQVLTAQQLPKLNAEKPSSIVDPLVRVEIHGVPEDCAQKETDYVLNNGFNPCWEQTLQFRLRAPELVLVRFVVEDYDTTSPNDFVGQSTLPLSSLKQGYRHIHLLSKDGASLAPATLFVHIRIQNS

SEQ ID NO: 15945 - protein, 208 aa, Populus x canescens
LIAGGTESSAVTVEWAISEILRKPEVFEKATEELDRVIGRERWVEEKDMVNLPYIYAIAKEVMRLHPVAPMLVPRAAREDININGYDIKKGSRVLVNVWTIGRDPKVWDKPDEFFPERFIGNSIDVRGHDYELLPFGAGRRMCPGYPLGLKVIQATLSNLLHGFKWRLPDGQKKEDLNMDEIFGLSTPKKYPLVAVAEPRLPAHVYPK

SEQ ID NO: 15946 - protein, 375 aa, Populus x canescens
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 15947 - protein, 233 aa, Oryza sativa (japonica cultivar-group)
MGSVLCCLADDGRPVCCFRLPWPIFNAAHNHNHNSGSIARPRADTRVAPDQGRISLTAPSQHDSMDTFRCPPRPLPWDDPRFSHHTEHHPLVGGHDKASTTFHKSGSLGESKNADSISNSKAVKDDGPSTAVKDDGSSVKHHSDGLHIGKEQVHDLFDFEDDCPICLEEYDYENPKMTLQCNHNFHLCCIYEWMERSQACPVCSKKKLVACVNPHITFRLDVTDARLSDCICF

SEQ ID NO: 15948 - protein, 715 aa, Stevia rebaudiana
MAVAGSTMNLHLTSSPYKTVPSLCKFTRKQFRLKASATNPDAEDGKMMFKNDKPNLKVEFAGEKPVTPLLDTINYPVHMKNLTTQDLEQLAAELRQDIVYSVANTGGHLSSSLGVVELSVALHHVFNTPDDKIIWDVGHQAYPHKILTGRRSKMHTIRKTSGLAGFPKRDESAHDAFGAGHSSTSISAGLGMAVGRDLLGKTNNVISVIGDGAMTAGRAYEAINNAGFLDSNLIVVLNDNKQVSLPTATLDGPATPVGALSGALSKLQASTKFRKLREAAKSITKQIGPQAHEVAAKVDEYARGMISASGSTLFEELGLYYIGPVDGHNVEDLVNIFEKVKSMPAPGPVLIHIVTEKGKGYPPAEAAADRMHGVVKFDVPTGKQFKTKSPTLSYTQYFAESLIKEAEADNKIVAIHAAMGGGTGLNYFQKKCPERCFDVGIAEQHAVTFAAGLATEGLKPFCAIYSSFLQRGYDQVVHDVDLQKLPVRFAMDRAGLVGADGPTHCGAFDITYMACLPNMVVMAPADEAELMHMVATAAAIDDRPSCFRFPRGNGIGAPLPPNNKGIPIEVGKGRILLEGTRVAILGYGSIVQECLGAASLLQAHNVSATVADARFCKPLDTGLIRRLANEHEVLLTVEEGSIGGFGSHVAHFLSINGLLDGKLKLRAMTLPDKYIDHGAPQDQLEETGLSSKHICSSLLSLLGKPKEALQYKSIM

SEQ ID NO: 15949 - protein, 473 aa, Stevia rebaudiana
MSLSYLSPTQTNLITFSDTCKSQTHLLKLQGGFCFKRKDVKLAGKGIRCSAQPPPPPAWPGTALVDPGTKNWDGPKPISIVGSTGSIGTQTLDIVAENPDKFRVVALAAGSNVTLLAEQIKAFKPQLVSIQNESLVGELKEALADADYMPEIIPGDQGIIEVARHPDCVTVVTGIVGCAGLKPTVAAIEAGKNIALANKETLIAGGPFVLPLARKHNVKILPADSEHSAIFQCIQGFPEGALRRIILTASGGAFRDLPVEKLKDVKVADALKHPNWSMGKKITVDSATLFNKGLEVIEAHYLYGSDYDNIEIVIHPQSIIHSMVETQDSSVLAQLGWPDMRLPILYTLSWPDRISCSEITWPRLDLCKLGSLTFKAPDNVKYPSMDLAYAAGRAGGTMTGVLSAANEKAVEMFIDEKIQYLDIFKVVELTCAKHQSELVTAPSLEEIVHYDLWARDYAASLKSSPGLTAVALV

SEQ ID NO: 15950 - protein, 433 aa, Borrelia burgdorferi
MGFHIYEIKARQIIDSRGNPTVEADVILEDGTYGRAAVPSGASTGINEAVELRDGDKSVYMGKGVLKAIENIKNIIAPELEGMSALNQVAIDRKMLELDGTPTKEKLGANAILAVSMATAKAAAKYLGLRPYQYLGAYKANILPTPMCNIINGGAHSDNSVDFQEFMIMPIGAKTFSEAIRMAAEVFHTLKGILSGKGYATSVGDEGGFAPNLKSNEEACEVIIEAIKKAGYEPGKDIAIALDPATSELYDPKTKKYVLKWSTKEKLTSEQMVEYWAKWVEKYPIISIEDGMAEEDWDGWKKLTDKIGNKIQLVGDDLFVTNTSFLKKGIEMGVANSILIKVNQIGTLTETFEAVEMAKKAGYTAIVSHRSGETEDTTIADLVVALGTGQTKTGSLSRTDRIAKYNQLIRIEEELETTAEYHGKSVFYSIKQK

SEQ ID NO: 15951 - protein, 246 aa, Arabidopsis thaliana
RPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 15952 - protein, 213 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQTVRSRS

SEQ ID NO: 15953 - protein, 403 aa, Arabidopsis thaliana
NADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 15954 - protein, 317 aa, Arabidopsis thaliana
RSNFFDFDAEFEADFQGFKDDSSIDCDDDFDVGDVFADVKPFVFTSTPKPAVSAAAEGSVFGKKVTGLDGDAEKSANRKRKNQYRGIRQRPWGKWAAEIRDPREGARIWLGTFKTAEEAARAYDAAARRIRGSKAKVNFPEENMKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 15955 - protein, 1928 aa, Homo sapiens
GQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDVLTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGVMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADVLRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPRKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLAKPGRLHGAGGRHHPDMRGLGSSSIAAPHLCSMFSFLKIHLFQWGAWKMAFPESILISIDHSQSLKSNPHTTENCLLHLSPFPVEKRRKSTRMRLSKWQPRSCLSSLAWLGLEL

SEQ ID NO: 15956 - protein, 214 aa, Cucurbita maxima
MAGIKVHGIPTSTATARVLAALYEKGLQFELVNVKLHEGEHKKEPFLSINPFGQVPGFNDGDLTLFESRAITQYISGNYASNGTELIPKDSKKGAVVLTWIEVESHHFDPVAMKLVFEFCLKPLFGLGDADPAVVEKSEADLGQVLDIYEKRLSGSKYLGGDSFSLADLHHLPVLGYLLATPSKKLFESRPHVNAWVGDIIARPSWAKVLALRK

SEQ ID NO: 15957 - protein, 106 aa, Oryza sativa (japonica cultivar-group)
MAGGGVWVFRNNGVMELEEQATSRKALVHVATSEVIRSTEALERRLGALGWERYYEDRATLQLHRRDGSADLISIPRDFSRFRSTHMYDVVVKNRDHFKVDVMEKN

SEQ ID NO: 15958 - protein, 816 aa, Oryza sativa (japonica cultivar-group)
MGETTGERALTRLHSMRERIGDSLSAHTNELVAVFSRLVNQGKGMLQPHQIIAEYNAAIPEGEREKLKDSALEDVLRGAQEAIVIPPWIALAIRPRPGVWEYLRINVSQLGVEELSVPEYLQFKEQLVDGSTQNNFVLELDFEPFNASFPRPSLSKSIGNGVQFLNRHLSSKLFHDKESMYPLLNFLRAHNYKGMTMMLNDRIRSLDALQGALRKAEKHLAGITADTPYSEFHHRFQELGLEKGWGDCAQRVRETIHLLLDLLEAPEPSALEKFLGTIPMVFNVVILSPHGYFAQANVLGYPDTGGQVVYILDQVRAMENEMLLRIKQQGLNITPRILIVTRLLPDAHGTTCGQRLEKVLGTEHTHILRVPFRTENGTVRKWISRFEVWPYLETYTDDVAHEISGELQATPDLIIGNYSDGNLVACLLAHKLGVTHCTIAHALEKTKYPNSDLYWKKFEDHYHFSCQFTADLIAMNHADFIITSTFQEIAGNKETVGQYESHMAFTMPGLYRVVHGIDVFDPKFNIVSPGADMSIYFPFTESQKRLTSLHLEIEELLFSDVENTEHKFVLKDKKKPIIFSMARLDHVKNLTGLVELYGRNPRLQELVNLVVVCGDHGKESKDKEEQAEFKKMFNLIEQYNLNGHIRWISAQMNRVRNGELYRYICDMRGAFVQPALYEAFGLTVIEAMTCGLPTFATAYGGPAEIIVHGVSGYHIDPYQNDKASALLVEFFEKCQEDPNHWIKISQGGLQRIEEKYTWKLYSERLMTLSGVYGFWKYVTNLDRRETRRYLEMLYALKYRKMATTVPLAIEGEASTK

SEQ ID NO: 15959 - protein, 406 aa, Oryza sativa (japonica cultivar-group)
MAAAVVARCGGAKKRKGEGLGEMHDDVLERVLARLPPASYFRLRGVCRRWSDAASSPTFLAACGRVPARDPWFLMLSEGEGQERRLPAVAFDAGEGEWARCGGAPGHVMPVVAASGGRVLYRAPDTGELTVANPLTGASRVLPAPPPGAALHAVAMYGSSPYRVVLITGDLPDLSMTVFDSSKNAWDDAVALSRKPDASSPERDAEGGVGGGGGGGDDETVYFLSKSGDVMATNMQRSASRQYSSAVTCGDGGEAVAYFLSNSGAVVACELSRRAFAELPRILPVYFEYSIDVVACGGRAYVVVLSELLGTASLRLWEFAGGAWRQVAAMPPAMSHAFHGKKADVNCVGHGDRVMVCVSSGEANGCFMCDVPTNRWEELPPCAGAGGEPMDFVAAFSFEPRMEVTV

SEQ ID NO: 15960 - protein, 333 aa, Oryza sativa (japonica cultivar-group)
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDSLNSYLNKYRIELDPQLEALVGRHSRKPWSKFINADNQHLVSPEAIDFLDKLLRYDHQDRLTAREAMAHPYFLQVRAAENSRPRAQ

SEQ ID NO: 15961 - protein, 1230 aa, Drosophila melanogaster
MSAPLLGEMEQTIGMLERGTIVTKLYGKQRRPDRRHLMLIRETRQLLWATVATQTPRTDYEGAIQLREIREIRVGKHSKEFRLFADDCQRFESSKCFVILHGNHFKLKSFSVVALSEIEADNWVRGLRYMVKDTLGAPYPLQIDRWLRREYYQIENVNTHSAKATEQSPAQVTIKDFKLFLAGVSCKMTTGKFMEHFTEDVRRKHDLKFDDFSRLYQKLLLPNGFASVLSGSGVANFPYSEDQQVVRPAELKQFLETEQRDVSASEISSAAIASFIRDFVQDVERDVQEPYLTFPEFVDFLFSKQNDLWNSKYDQVFMDMNLPLSSYWIASSHNTYLTGDQFSSESSCEAYARALRMGCRCIELDCWNGPDNLPYIFHGHTITSKIKFMDVIKTIKDHAFTSSEYPVILSIEQNCSLEQQRNMAQALIEVFGDMLLTQPCDRNEQHLPSPYQLRRKIILKHKKLPQFDDIANGISSTGSLGHRSSLGGAGGGAHGENDGENVRKVFKEGLLYFKDPVDKSWNLYQFVLTHQELIYSSEINESRNGNSEDDDFGLSSSCSLNSNMQQKQKDTSANDELHFGENWFHGKLEGGRKEADDLLKKYKHFGDGTFLVRESATFVGDYSLSFWRRNRPNHCRIKLKHENGSIKYYLVENFVFDSLYSLIVYYRKNMLRSSEFSIILKEPVPQPKKHEDQEWFHPNTTKEQAEQGLYRLEIGSFLVRPSVQSINAFVISFTINRKIKHCRIMQEGRLYGIDTMNFESLVSLINYYTRNPLYRNVKLSHPVSQELLRQALAEAAQGDHSGGHDDNGASNYMGSNLEENVTCKALYSYKANKPDELSFPKHAIITNVQRDNSMWWIGDYGGMIKKHLPANYVKVIDSTTEDYNSLNEEGTDGRTDSIEIFGAVASLFESNDPGIIFKLQIQTPTMQNPFVIGFDNQETAYEWIKAIQEAALIASQLASERRKKERTARVAKEMSDLIIYFRSVPFREHSWIFQEMSSFPETKAEKQFFQQNTQLFLSYHRNQISRVYPKGQRLDSSNFNPMPFWNVGSQMIALNYQTGDKAMQLNQAKFRNNGQCGYILKPSFMKSDSFNPNNPLCDGLSEVKVSIRLIAARHLFRGGKSNNPQIVVELIGASFDTGVKYRTKVNENGFNPVWNESCEFNVRNPQFAILRFEVQDEDMFAETHFIAQACYPLTCIRQGYRSVILRNKFSEELELSSLLINIKIANVTAP

SEQ ID NO: 15962 - protein, 101 aa, Carica papaya
  unsure (1)..(101): unsure at all Xaa locations
GYTQXGXVDIXRPPXLASKTGRWKACAFLVGNEAFERMALXGIASXXVNYLXTQLHXDPVSSVXNVXXXSGSVWIXXIXGAXIADSDLGRXXTFXISSVIY

SEQ ID NO: 15963 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 15964 - protein, 348 aa, Brassica nigra
  unsure (1)..(348): unsure at all Xaa locations
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 15965 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTRYGIVPSFS

SEQ ID NO: 15966 - protein, 348 aa, Brassica nigra
MLKQESNWAQACDTCRSAACTVYCRADSAYLCTSCDAQIHAANRLASRHERVRVCESCERAPAVFFCQADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 15967 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 15968 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSIIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 15969 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 15970 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 15971 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADQALSTMVVFDTGYGIVPSFS

SEQ ID NO: 15972 - protein, 342 aa, Brassica nigra
  unsure (1)..(342): unsure at all Xaa locations
MLKQESNWAQACDTXRSAACTVYCRADSAYXCTSCDAQIXAANRLASRHERVRVCESCERAPAAFFCKADAASLCTACDSQIHSANPLARRHQRVPILPISGCVATNHHSSEXTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAXRNEVDADHALSTMVMFDTGYGIVPSFS

SEQ ID NO: 15973 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 15974 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMVDTGYGIVPSFS

SEQ ID NO: 15975 - protein, 342 aa, Brassica nigra
  unsure (1)..(342): unsure at all Xaa locations
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 15976 - protein, 344 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSIQYQQDYNVPQRSYVADGVVPLQVGVANGHMHHKKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 15977 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDANHALSTMVMSDTGYGIVPSFS

SEQ ID NO: 15978 - protein, 345 aa, Brassica nigra
  unsure (1)..(345): unsure at all Xaa locations
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSXS

SEQ ID NO: 15979 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 15980 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGLSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 15981 - protein, 1161 aa, Kluyveromyces lactis
MDEDRKHTAFPVEQDIYKKIERERNIILGSNQLKKKTDNVMVIQKCNTNIREAQQNIEYLEQILAKLRVSQQPDNTPTSQNASNHPGFGQLSTISPDEFRYSRLDLVKYDCPSLSQRIQYMLQQLEFKLQVEKQYQEANDKLTKLYQIDGDQRSSSAAQGGSVESKHRIQLLTKSLKKYQAINVDIDPFNDHTEEATQPKFRRKQLSGTLTIGVTAIRDVDHIQSPLFSRKPETFITIKVDDVVKAKTKPSRNDRWHEDFNIVIDKGNEVEVTIYDKVNDRIVPVAVMWLLLADIAEEIRKKKVGQQQKQGKSHAEWMQASRLPPSQPANNTAVITKDLPQLPDAGIPTEDREANDTHTQSLTTNTWFILEPAGQILLTLGFNKSNTTQRKTFMGGLHRHGAIVNRKEDIFEQHGHHFVQKSFYNVMCCAYCGEFLRYSGYQCQDCKFLCHKKCYAHVVTKCIAKTSTDSDPDETKLNHRIPHRFEPVSNRGTKWCCHCGYILPWGRKNVRKCTECGVMCHAQCAHLVPDFCGMSMEMANKVLLTIQDTKRTQQQRGFSGIKVNNKPKPISKGFDGLNNRFETSFDHDDMHTSVIKPTTPSEARKDLVTDRLNNFITQHDSHYDSFTSNVETSSPDHGNYQHSLDPGLSPDSMKKIQFDAAHISNLPQAHAQEHFAQEYEGNYENKHPNKQDSGYVQDYGYEEELDDSEQSHYELRERLRKEEEERWYNEQNMLQQEQQQQTYSTGDVELATKKGDYDIIEETADVTDDQYSPPAQYEDLEYSLSTTETPELHAADIANITGKSSPSSPQKSYTSSTKHKKKSSKRRKVSLDDFILLKVLGKGNFGKVLLARSKNTSNLCAIKVLKKDNIIKNHDIESARAEKKVFLLATETKHPFLTNLYCSFQTENRIYFAMEFIGGGDLMWHVQNRRLSVRRAKFYAAEVLLSLKYFHDNGVIYRDLKLENILLTPEGHIKIADYGLCKDNMWYGNKTSTFCGTPEFMAPEILKGQAYTKAVDWWTFGVLLYQMLLCQSPFSGEDEDEVFNAILTDEPLYPIDMAGDIVQIFQGLLTKDPEKRLGAGPKDALEIMAEPFFSNINFDDILNLRVEPPFVPEIKAADDTSYFEKEFTSAPPTLTPLPSVLSSVLQEEFRGFSFMPEDLQL

SEQ ID NO: 15982 - protein, 947 aa, Eleocharis vivipara
MERVCLHAIHGACKPDMDGNIRFGRKKRHLYKRLSSCRVRAMKLDQSGFEASRKQSSYALKAIATPMAVTTKKRVFTFGKNKTEGNKGMKELLGGKGANLAEMSSIGLSVPPGFTVSTEACQQYQESGHKMPPGLWDEIIDGLKWVQQDMGARLGDPEKPLLVSVRSGAAVSMPGMMDTVLNLGLNDEVVSGLAKKSGERFAYDSYRRFIDMFGDVVMGISHEHFGDKLEEMKATKGVKNDTDLSANDLKELVVQYKEVYAKAKGEPFPTDPMKQLSLAVLAVFDSWDSPRAKKYRSINKITGLKGTAVNVQCMVFGNMGNTSGTGVLFTRNPSTGEKKLYGEFLVNAQGEDVVAGIRTPQELETMKDYFPQAYQELVDNCKILESHYKDMMDIEFTVQENRLWMLQCRTGKRTGKAAVKIAVDLVSEGLVDTRTAIKMVDPGHLDQLLHPQFENPKAYKDKVIASGLPASPGAAVGQVVFTAEDAEMWHAQGKAVILVRTETSPEDVGGMHAAAGILTARGGMTSHAAVVARGWGKCCVSGCSDIRVNDAEKVLLVGDKKLQEGEWISLNGSTGEVIMGKQPLSPPALSGDLGTFMAWVDEVRQIGVMANADTPEDALAARNNGAQGIGLCRTEHMFFASDERIKAVRQMIMSGTVEQRQKALDRLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVLPEIMVPLVGTPQELGHQVSLIRQVADKVFSATGTSVSYKVGTMIEIPRAALVADEIAEHAEFFSFGTNDLTQMTFGYSRDDVGKFLPIYIAHGILQNDPFEVLDQKGVGELVKLATERGRKTRPDLKVGICGEHGGEPSSVAFFAKSGLNYVSCSPFRVPIARLAGAQVVVQK

SEQ ID NO: 15983 - protein, 884 aa, Eleocharis vivipara
MAPSAPVVGAQRVFTFKNKTEGNKGMKELLGGKGANLAEMSSIGLSVPPGFTVSTEACQQYQETGHKMPSGLWDEIIEGLNWVQQDMGARLGDPEKPLLVSLRSGAAVSMPGMMDTVLNLGLNDEVVAGLAKKSGERFAYDSYRRFIDMFSDVVMGIPHEHFGEKLEEMKATKGVKNDTDLSADDLKELVVQYKEVYAKAKGEPFPTDPMKQLSLAVLAVFDSWDSPRAQKYRSINRITGLKGTAVNVQCMVFGNMGNTSGTGVLFTRNPSTGEKKLYGEFLINAQGEDVVAGIRTPEELDTMKDCFPQAYQELVENCKILESHYKDMMDIEFTVQENRLWMLQCRTGKRTGKAAVKIAVDLVSEGIIDTSTAIKMVDPGHLDQLLHPQFENPKAYKDKVIASGLPASPGAAVGQVVFTAEDAETWHAQGKAVILVRTETSPEDVGGMHAAAGILTARGGMTSHAAVVARGWGKCCVSGCSDIRVNDAEKVLLVGDKKIQEGEWISLNGSSGEVILGKQPLAPPALSGDLGTFMAWVDEVRQIGVLANADTPEDALAARNNGAQGIGLCRTEHMFFASDERIKAVRQMIMSGTVEQRQKALDLLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVFPEIMVPLVGTPQELGHQVSLIRQVADKVFSAAGTSVAYKVGTMIEIPRAALVADEIAEYAEFFSFGTNDLTQMTFGYSRDDVGKFLPIYIAQGILQNDPFEVLDQKGVGELVKLATERGRKTRPDLKVGICGEHGGEPSSVAFFAKSGLNYVSCSPFRVPIARLAGAQVVVQK

SEQ ID NO: 15984 - protein, 183 aa, Paracentrotus lividus
VAYKNVVGSRRAALHTVSIIEQKDETKTKNEENKLQLLKNYRGLIEKELTELCRDGLDILENFVIPSAKDPETKVFYLKMMGDYYRYLAEIFVDSERKTASDNSLDAYKKAAELAEAELNPTDPIRLGLALNFSEFYHEILKMPNDACRLAKAAFDDAIAGLDNINLPEDSYKDSTLIMQLLR

SEQ ID NO: 15985 - protein, 359 aa, Homo sapiens [sequence omitted]

SEQ ID NO: 15986 - protein, 359 aa, Homo sapiens [sequence omitted]

SEQ ID NO: 15987 - protein, 327 aa, Arabidopsis thaliana
MAEGLVLKGTMRAHTDMVTAIATPIDNADIIVSASRDKSIILWKLTKDDKAYGVAQRRLTGHSHFVEDVVLSSDGQFALSGSWDGELRLWDLAAGVSTRRFVGHTKDVLSVAFSLDNRQIVSASRDRTIKLWNTLGECKYTISEGGEGHRDWVSCVRFSPNTLQPTIVSASWDKTVKMWNLSNCKLRSTLAGHTGYVSTVAVSPDGSLCASGGKDGVVLLWDLAEGKKLYSLEANSVIHALCFSPNRYWLCAATEHGIKIWDLESKSIVEDLKVDLKAEAEKADNSGPAATKRKVIYCTSLNWSADGSTLFSGYTDGVIRVWGIGRY

SEQ ID NO: 15988 - protein, 294 aa, Allium cepa
MDQYEKVEKIGEGTYGVVYKARDRLTNETIALKKIRLEQEDEGVPSTAIREISLLKEMQHANIVRLQDVVHSEKRIYLVFEYLDLDLKKHMDSCPDFAKDSRLAKTFLYQLLRGIAYCHSHRVLHRDLKPQNLLIDRRTNSLKLADFGLARAFGIPVRTFTHEVVTLWYRAPEILLGARQYSTPVDIWSVGCIFAEMVNQRPLFPGDSEIDELFKIFRIMGTPNEDTWPGVTSLPDFKSAFPKWPAKDLATIVPKLDSAGIDLLYKMLHLEPSKRITARKALEHEYFRDLGTIP

SEQ ID NO: 15989 - protein, 336 aa, Pseudomonas tolaasii
MALSKEAPEFDIDDEVLLEMEILTEKESMSNDEGSATPSVRTKSKNSTALKQHKYIDYTRALDATQLYLNEIGFSPLLTPEEEVHFARLSQKGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVGEVKRMLGLNERVSSVDVSLGPDSDKTLLDTLTDDRPTDPCELLQDDDLSQSIDQWLSELTDKQREVVIRRFGLRGHESSTLEDVGLEIGLTRERVRQIQVEGLKRLREILEKNGLSSESLFQ

SEQ ID NO: 15990 - protein, 543 aa, Gossypium hirsutum
MVAPQLAAVFTKLQTLSTSDHASVVSMNIFVALLCACIVIGHLLEENRWMNESITALIIGVFTGVIILLTSGGKSSHLLVFSEDLFFIYLLPPIIFNAGFQVKKKQFFRNFITIMLFGAVGTLISCTIISLGVINFFKEMDIGSLDIGDFLAIGAIFAATDSVCTLQVLNQDETPLLYSLVFGEGVVNDATSVVLFNAIQSFDLVNTSPRILLEFIGSFLYLFLASTMLGVIVGLVSAYIIKKLYFGRHSTDREFALMMLMAYLSYIMAELFYLSGILTVFFCGIVMSHYTWHNVTESSRVTTKHAFATLSFVAETFLFLYVGMDALDMEKWRFVSDSPGTSVAVSAVLMGLVMVGRAAFVFPLSFLSNLAKKSTSEKISFREQIIIWWAGLMRGAVSMALAYNQFTRGGHTQLRGNAIMITSTITIVLFSTVVFGLMTKPLIRFLLPHPKPTASMLSDQSTPKSMEAPFLGSGQDSFDDSLIGVHRPNSIRALLTTPAHTVHYYWRKFDNAFMRPMFGGRGFVPFVPGSPTERSEPNLPQWQ

SEQ ID NO: 15991 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWDKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 15992 - protein, 337 aa, Petunia x hybrida
MENSSQESQHLRSENSVTYDSTYPIYSMAFSSFPTPRRRIAVGSFIEELNNRVELLSFNEETLTLNPIPNLSFDHPYPPTKLMFHPNPIKSNNDILASSGDYLRLWEVKESSIEPLFTLNNSKTSEYCAPLTSFDWNEVEPKRIGTSSIDTTCTIWDVEKGVVETQLIAHDKEVYDIAWGEAGVFASVSADGSVRIFDLRDKEHSTIIYESPTPDTPLLRLAWNKQDLRYMATILMDSNKVVILDIRSPAMPVAELERHQASVNAIAWAPQSCRHICSGGDDGQALIWELPTVAGPNGIDPMSMYSAGAEINQLQWSPAQRDWIAIAFSNKLQLLKV

SEQ ID NO: 15993 - protein, 339 aa, Homo sapiens
MTDRSPFETDMLTLTRYVMEKGRQAKGTGELTQLLNSMLTAIKAISSAVRKAGLAHLYGIAGSVNVTGDEVKKLDVLSNSLVINMVQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 15994 - protein, 570 aa, Homo sapiens
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 15995 - protein, 494 aa, Sphingomonas sp.
MTSVSSSPITDTILNFIDGSYREGSEGKSFSNVNPATGAEIGVVHEASQADVADAVAAAKAALTGPWGKMTTAERVKLITAVATEIERRADDFLAAEVADTGKPRHVASHIDIPRGAANFRMFADVVSTMPGESFNTPTPDGGQAFNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLGYYRRAVEDGATVVTGGGVPEISGAEAGGFFVEPTLWIDVAHGDTVMREEIFGPCCGILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 15996 - protein, 161 aa, Oryza sativa (indica cultivar-group); identical to SEQ ID NO: 3811
  unsure (1)..(161): unsure at all Xaa locations

SEQ ID NO: 15997 - protein, 356 aa, Magnaporthe grisea
MMGACMSASSEESEQKKRSQKIDKDLEEDSKRLRRECKILLLGSGESGKSTIVKQMKIIHLKGYSDDELYNYRPTVFKNLIECAKAVISAMRQFDIEPQLEGNKELCDYLLDYMVESGPQAEIDPKVGQAVQSIWNDPAREQLMDRQTEFYLMDSAEYFFQEVLRIVSPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKADKYLLWRFNQVNRAHLNLYPHLTQATDTSNIRLVFAAVKETILNNALKDSGIL

SEQ ID NO: 15998 - protein, 355 aa, Magnaporthe grisea
MCFGSRNVHDEAGAARSRELDKAIRADEKRLQKEVKLLLLGAGESGKSTVLKQMKLIYAQGFSKNEKIEWKPVVFQHIVQSFRLIHDAMQELDIEFENKENERNITLIMEEQELGAHDALPIEFLDPIKALWVDAGVKKAIAKGNEFALHDNLDYFCDDLDRIWDKSYVPTDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKMDLFKEKITKSPITEYGFTDYHGPSDDWKQTSKYFMDKFRALNRNPEKEIYGHFTNATDTNLLKITMTSVQDMIIQRNLKQLIL

SEQ ID NO: 15999 - protein, 321 aa, Stellaria longipes
MENFPIINMENIERKNTRDMIKDACENWGFFELVNHGIPHSLLDKMEKLTKDHVRKCLEERFKEMVASKGLEAVEAEVTDLDWESIFFLKHLPVSSISELPDLDEEYREVMIDFSKRKEKKAETKKDKKCENKGKEKSYLKNTFYGSKGPNFGTSVSNYPPLPKPDLIKGLSAHTDAGGIILLSEDDKVSGLELLKDGDWIDVPPMRHSIVVNLGDELEVITNGKYWSVEHRVQIDTNITRMSTASFYVPGNDRVIAPAEALPKEFKKDEVYPKFVFKSYMKAYAKLIRQSGLKFEAKEPRFEAMKAHRIGSSCNSHLEHD

SEQ ID NO: 16000 - protein, 302 aa, Bos taurus
IIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKEGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAAPAAAPAATTAAPAKVEAKEESEESDEDMGFGLFD

SEQ ID NO: 16001 - protein, 315 aa, Rhodobacter sphaeroides
MTASKPGRIAVVGSNMVDLVTYITRMPAPGETIEAPDFEIGCGGKGANQAVAAAKLGSAVSMVTKVGDDIFGENTRRNLAQHGIDIRHVETVAGKSSGVAPIFVEASGENSILIVKGANADLLPADVDTAEETLRAADLILMQMEVPRETVIHTVRRAAEWGVRTILNPAPAAADLNVDDLRDLSFLVPNESELALISGLPTGSEEEIAAAALSLIERGIGTVIVTLGGRGARLVTRAGVVPIAPVRVTPVDTTGAGDAFIGAFAHFLAATGEVEGALAHAARYAAHSVTGRGTQKSYATPEAFEAFCRALPPSA

SEQ ID NO: 16002 - protein, 832 aa, Rhodobacter sphaeroides
MNIVLLVTALAVLFIVIAACEPVAARLRLPYSVVLAVVGAMLGTLALWLQRSGVAASFPPEVADLLALPIRSSVFLYIFLPTLLFQVSLSLNIRRMIDDWVPILVMAVVAVLVSTLAIGFALQPFSSMSLAACLLLGSIVSTTDPSAVVSIFRSIAAPQRLTRIVEGESLLNDAAAIALFGFFLTFVMAGVPDPTLRQALVEFPLLILGGLGLGYLMARIALFLMTRMASHPTAQLSLSLALPYLTYVLAEQGFHASGVIAVVTAGIAMNLTGPGRLSPATWKLLSDIWEMLSHWAGSLIFIVAALLIPRLIGRATGWDLLLIGVVALAAVVARGVMLSGLLPLLTRFNLSPRVERPYRVAILWGGLRGAVTLALALAVTENPMVPPHVKREVGILATGFVLFTLLAQGTTLRWVIRRLGLARLTPLDLALSNQVIAVALQNVREGVAETVRERELDPQIVRSEAKGFGQRLARAVELADDSADDIPDRDRITLGLVALAGRERDAILAAFRQQIISPRLAEAMLVDVDRLIERTRLQGRDGYRAAGRRALGLGRQHRIAVWAHNRLKITRWLSQLTSDRFEMLLTQRLILGDLHGLIDGKIRRIHGRRVAEILHEMLKRREEETEQALEALRLQYPGYSEEMVRSFIRRTALQLELREYEMLHDDGLIGQELFMTLRQRIQVARGKKERRPHLDLAVQKVELVRQFPLFAEMEEDQLRALERLLQTVYVRPGDVLLRRGDVPRKVFFIASGAVESDVAGQKVRLGRGEMFGQLAILTRKTRKAQVTAISHGTLLSLDEARFLELLRRNRTLQEAAVESAARRNVTIDLSAI

SEQ ID NO: 16003 - protein, 394 aa, Rhodobacter sphaeroides
MRSLSIFGATGSIGESTFDLVMRKGGPEAFRTVALTGGRNIRRLAEMARALKAELAVTAHEDCLPALREALAGTGTEVAGGAQAIAEAADRPADWTMSAIVGAAGLVPGMRALKHGRTLALANKESLVTAGQLLMRTARENGATILPVDSEHSAVFQALAGEDTACVERVIITASGGPFRDWSLERIRACTVAEAQAHPNWSMGQRISIDSASMFNKALELIETREFFGFEPDRIEAVVHPQSIVHAMVGFCDGGLMAHLGPADMRHAIGFALNWPGRGEVPVARIDLAQIASLTFQRPDEERFPALRLARDVMAARGLSGAAFNAAKEIALDHFIAGRIGFLDMAAVVEETLAGVSTDPLFGKVPDALEEVLAMDHLARRAAEEAAGLRQQKR

SEQ ID NO: 16004 - protein, 268 aa, Rhodobacter sphaeroides
MAEARPRVATVDPVWQRIVEEGHAAILAEPLLGGLVHSSLLHHPSMERALAYRFSLKLASGEMSEQILREIADEAYASDPELGQMARADMVAVYERDPACHRFLQPILFFKGYQAVQAYRVGHWLWTNGRQDLAYFVQMRVSEAFGVDVHPAARIGRGIMIDHAHSIVIGETAVVGDNVSMLHSVTLGGTGKEDGDRHPKIGNGVLIGAGAKVLGNIHVGHCSRIAAGSVVLQDVPPCTTVAGVPARVVGEAGCAQPAVTMDHLLSDG

SEQ ID NO: 16005 - protein, 596 aa, Rhodobacter sphaeroides
MPGFSSSSGPRRGRCCWRRRRSSFRPSRRRSCRSGRRAVSPCAPTRRRPDARGPAGPAAALQGVPDRAGTPTLGGVRDRAPAPASVAGRAGFPLPSLRPHETGNRQTIPSKEHPMEIREALTFDDVLLVPAASSVLPSDADTSTFVTKAIRMNIPLLSSAMDTVTEGRMAIAMAQAGGIGVIHRNLGIEEQAREVSRVKRFESGIVYAPITLRPDQTLADAKALQERYNVTGFPVVDESGRVVGIVTNRDMRFANDDRTPVKVMMTSDNLAILQEPADRDTAISLMKARRIEKLLVTDGQGKLTGLLTLKDTEKSVLNPNACKDELGRLRVAAASTVGEAGFERSQALIEAGVDMVVIDTAHGHSEGVSLAVERIKAFSNSVQVVAGNVATAEATRALIGAGADAVKVGIGPGSICTTRIVAGVGVPQLTAIMDAAGAAGDVPVIADGGIKFSGDFAKAIAAGASCAMVGSAIAGTDESPGEVILYQGRSFKSYRGMGSLGAMARGSADRYFQKDAASDKLVPEGIEGQVPYKGPAAAVIHQMVGGLRAAMGYTGNRTVAEMRQGCRFVRITGAGLKESHVHDVQITRESPNYRLG

SEQ ID NO: 16006 - protein, 371 aa, Rhodobacter sphaeroides
MSSSAMRRRAAWVPNSTTTVPSPRASAWASPSDIPPAGRQSRGPFGGPLRMFRVAHRRASCQKRAMAQTSLTPRASAELLLLGTIWGGSFLANGLALPQAGVAGTVAVRVGGAALVLWVAVRLLGLAVPRSLRIWASFLVMGLLNNVIPFTLITWGQQSIPSGLASILNAATAIFGVLVASLVLADERLTPRRIAGVLLGFAGVVTTIGPDALTGFDPRSAGQLALLGAALSYACAGAFGRRALAGLDPRMAAAGMLTGASLIVLPAALLLGGPPRLDLSLQAWGALFYLAVVASAFAYLLYYRILAVAGAGNLSLVTLIVPPVAILLGALVLGERLPPHAFAGFGLLVAGLLVLDGRILHIPRELVRRAR

SEQ ID NO: 16007 - protein, 331 aa, Rhodobacter sphaeroides
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 16008 - protein, 425 aa, Rhodobacter sphaeroides
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILKV

SEQ ID NO: 16009 - protein, 353 aa, Rhodobacter sphaeroides
MPIARESVLAVLDRIPLPDGGTLVSRDLIRALTVEGDAVRFVIEAPSAEAARALEPVRAEAERALRALPGVAGVQAVMTAHGPAAPSLKIGQHPTPQAAGPQPIAGIDRIIAIGSGKGGVGKSTVSSNLAVALARQGRKVGLLDADIYGPSQARMMGVNRRPASPDGKTILPPSAHGVTMMSLGLMLKEDEAVIWRGPMLMGALQQLLGQVAWGELDVLLVDLPPGTGDIQLTLCQRTQVTGAIVVSTPQDVALLDARKALDMFRKLKTPVLGLIENMSSYVCPNCGHEAHIFGHGGVAEEARRLDVPFLGELPLDLSIRLAGDEGRPVAAGEGPIAEAYADLARRLVAGGMA

SEQ ID NO: 16010 - protein, 495 aa, Rhodobacter sphaeroides
MLQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 16011 - protein, 246 aa, Rhodobacter sphaeroides
MGGEHRPGSAGRLHATRPAALRRHAGHHSGGAMIEAVIFDCDGVLVDSEPTAFALLGEDLARHGLALDHATLEAHFLGGTIPGAAVTARRLGADLPADWVEDFYERLYARLAEGTPLIPHVEEVVAALDQAGIPYAVGSNGSDRKMQVTLGQHPALMARLDGRLFSGQSMDAPKPAPDLYLHAARALGVEPDRCAVIEDSPTGARAARAAGMTCFGYVPDGSPEALVAEGARPFSDMRELPALLGL

SEQ ID NO: 16012 - protein, 888 aa, Rhodobacter sphaeroides
MTERPRIPDGGERGAEVQAMFSESRDTAPGGVFERWTGYVLVLAVGVTALVAAIFIFSDIDKQLEQNRVAHLDNRTWVLAQFEVDVLNLASAAQMAAYRSDDPARLDELRKRFDILYSRVDIVRGFESGTIAPLEADVLPIFDGPEGFFARWIPVIDGPDADLRAALPQLIGELERDAGSVRSGVVRALGEVMTVSDARRATLRQSLQTFALAALGLLGLMGVLIAVVIVQSNARRRRGMLLERSVHNLRATIESSLDAVVVLDHMGRVVECNRAALDMFRWSPQTAEGTNFVDYIRTDDADGLLRPHARGEEEAELNPTGRDGRITMMAQRTNGSTFPVEVSVAEAQGASQDPFFIAFIRDISERLEREESLKKARNDALKGEEAKSRFLAVMSHEMRTPLNGLMAASDLLQTSTDLTDRQRWLTDIVIGCGSAALDQVNNVLELTRLSDKDGASYARTVFSPVDLIEGLIRQNQPQADKRGNKLWFAQPKNPVPPVLGQRHLFLRVMYNLIGNAIKFTDNGKVSVELLWHPGRTSGTVDLCIHVGDTGIGIAEEHLDTIFRNFETLDASYGRIREGTGLGLGIAKLAAETMGGQIDVQSKLGLGSVFTLRLQLPVAQGAEAAQEEFAEDAPSAGDGARAILVVDDNAINRQLLAEILRMAGHEVATAEDGAEAAEAAGARRFDLILMDVSMPRVDGLEATRRIRRAGASTDTPILGATAHADPDRVPDFLAAGMNDVLVKPITRSALFRAIRQFTETSAAVEEVLPAGDPPPDDLPLIDAELRADLEGNLGPDYIAGMIGRVLSETGDALPEMRRLHEAGDHLAAAKLAHRTAGAAAAVGLMALHRSLASYETAADASNTAEAARALESLPATLERTAAACQATAA

SEQ ID NO: 16013 - protein, 752 aa, Rhodobacter sphaeroides
MAEVVTVMSVQPTSEKVTSRHWSWARAVPAMARVEAAASRACRMGVMVSPRFLLIDESINFTIARLGNHKIRYSAHAETRYGAYPKGRARQSHDRRDRAGGFSRCDREPDRQARGHVFGPCPPLLRWKGSAFHCGDAPRPVALRGRGAGRAARGGDPGGPDHRHPAGLVLGHEFPARGGGGVAEFLRSGPDRAPGEAASGDLPAPSAVESPRRAAAPGRRAGGRPRRRSGRADRRPLSARGAEGGPARQRGRRCLCPRLSERPSEGMSPVRAQPAASHFVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGMGPVDAPY

SEQ ID NO: 16014 - protein, 359 aa, Rhodobacter sphaeroides
MKPFPLWSPLLLLIRPDSMLTFSLPPSRAVPALEALVRQRILILDGAMGTQIQALGLSEEDYAGCGCRHHAERPQKGNNDLLILTQPQAIEEIHFRYAMAGADIVETNTFSATTIAQADYGMESAVEDLNREGARIVRRALDRATALDGRPRFVAGAVGPTNRTASISPDVNDPGYRAVSFDDLRMAYGTQVRALIAGGADLILIETIFDTLNAKAAIFACFEAFAEAGRRLPLMISGTITDASGRTLSGQTPTAFWHSVRHARPFTVGLNCALGAAAMRPHLAELAGVADAAICAYPNAGLPNAFGQYDEGPDETAAQVARFAREGLVNVVGGCCGTTPDHVRAIACAVADLPPRTLV

SEQ ID NO: 16015 - protein, 298 aa, Rhodobacter sphaeroides
MSTYTSLPAPSPEQGLNRYMQEIRKFPLLEPEEEYMLAKRWVDHQDNRAAHKLVTSHLRLAAKIAMGYRGYGLPQAEVISEANVGLMQAVKRFDPEKGFRLATYAMWWIRASIQEYILRSWSLVKLGTTSAQKKLFFNLRKAKAKLGALEEGDLRPENVAQIAKDLGVSETEVIDMNRRLSGSDASLNATIGSDGEGSTQWQDWLEDEDSDQAADYAERDELEIRRELLAQSMSVLNDREKDILVQRRLTDDPVTLEELSEGYGVSRERIRQIEVRAFEKLQAKMRELARSKGMTIPA

SEQ ID NO: 16016 - protein, 575 aa, Rhodobacter sphaeroides
MRPPWLAPLPPAALQQEVARQAAILRREAFVRFPAMALAFAVSMLFLPGWIVWTCVLLSALGEIVTNHLDACPARITERWRHPAYILSAFLLQCAFVTPPALMWHLENPYVKAFAIGFMVCSMMHVATVRSIHLPMGLAGGSAIALFTLASNTLYWLPRHDLAALGLTTLCALVALAYSLAAILMTYRLHREAAAGRAEALAANATKDRFLAQMSHELRTPLNAILGIGHAELRGASDPVSRDRLGVLIRSAEGLSTMLDDILDMSAVQQGRMPVRPQTVSPREEIVASVELFRPLVEETGVALELVLGDLPKRARLDPQRLRQCLSNLLSNALKHTQEGRIRVEARIEGAGPRPLLRIEVSDTGDGILREEAEAIFDPFMPTGNGRLAGNGLGLSISRALARQMGGDLRLLAQPGPGARFALTIALQTVEAPASAPAAPRAEHRLGGRRVLVVDDISTNRLVAAAYLQLFGVRTIEAQSGPEALALLEREPVDLVLLDMNMPGMDGLETLRRIRAMPGPAASLPVVAMTADATEEQRDMYLGAGLTGYVAKPVTPDRMSAELSRVLGLAHPDES

SEQ ID NO: 16017 - protein, 293 aa, Rhodobacter sphaeroides
MDLRSIGMGLAFAFMWSSAFASARIIVAQAPPLSALSLRFLCSGLIALALGAALGQSARLSPAQWRGVVIFGLCQNALYLGLNFVAMRWVSASFAAIVASTMPLLVALAGWIFLHERLRPVTALGLLAGMAGVALIMGTRLSGGEDALGFLLCVAGVIALTAATLTVRVASSGGNLLMIVGLQMLVGSAALAPAALLTETPLEVQWSGSLVAAFAYTTLVPGLLATWVWFLLVGRIGAVRGATFHFLNPFFGVAVAAVLLGERMGIWDVAGVVVIAAGILAVQLSRVPEAARR

SEQ ID NO: 16018 - protein, 313 aa, Rhodobacter sphaeroides
MPVQPDRIEVIAPNLKRRLSGVTATIARLVPVQARLIGIAATGPGLPADLPHLPLWRLPFLPRDRWRVWHARRNTEMLLGIALRHLLRRRLKLLFTSASQRRHTGYTRWLIGRMDALVATSRRTASYLERPAEVILHGIDTDTFRPGDRAEVRARLGLPEAVLVGCYGRIRAQKGTDVFVHAMMRLLPERPGVAAVVMGRAVGEHQAFLDGLRREVEAAGLGQRILFRPEVTVDRMPDWYRALDLYVAPQRWEGFGLTPLEAMACGVPVVATRVGAFEELVSADTGRLVPPGDLAAMVAEVAALLDDAALYGR

SEQ ID NO: 16019 - protein, 287 aa, Rhodobacter sphaeroides
MRQRRPARASSGPGPCSAAAPPTGGFPMTDTPAAHPVFPDLKGASVFLSGGGSGIGAALTEGFLRQGAQVAFVQRSDATAFCDRMEAETGARPLFLPCDVTDIPALRQALAEVAERQGPIQVLVNAAAHDDRHTTAEVTEDYWDRAQAVNLKHYFFAAQAVIPGMKAAGGGSIINFSSISYMMGNAGYPAYTTANSGINGLTRSLAREFGPDRIRVNALAPGWVLTERQKDLWVTEDGLQAHLDRQCLKEALVPADIVGGVLFLASEASRMMTGQALVIDGGVVVTG

SEQ ID NO: 16020 - protein, 849 aa, Rhodobacter sphaeroides
MDIEQKLAKERRARLAAERLLEYKQRELFAANEKLAIHARALSDQIIEQRAVVKTALSEAEKLKGQNSRFLSELERAHTAAVMAERRLWDSIDAIEDGFAVFDAGQRLVAANEAYRCHFEGLEVRPGMALADLLQLATTHGLIDLRGEPADHWRQRMIRRWDEDPVEPEIVRRCTGQWLRLVNRRARDGDMVSLLIDITEQMRLRAAIDAIPDGFVLFDRAERLVLCNDRYRAIYPRSAEALRPGAPFEEILRHGLAHGQFPEAAGREEEWLADRLAAFRHLGGAAEQQLDDGRWLRVIEHETPDGGRVGLGVDITELKRQQAALESARAAAEAASRAKSAFLANMSHEIRTPMNGIVGMADLLCETVLTEDQRLFSETIRSSGEALLVIINDILDYSKIEANRLTLHPEPFDLERTIHEVAMLLQPKARAKGIDLLIDFDLFLPTRFVGDPGRLRQVLTNLIGNAVKFTAAGHVLIRVVGLEVAPGRHDLRVTVEDTGIGIAPEHLDHVFGEFNQIEAEATRRFEGTGLGLAITRRLIELMQGAVWVESEPGRGSCFGFRLTLPAADDEAAPPVPIEVRRALVVDGQFINRTILERQLAPCGISVTLCRSGIEALAELSADAGYDLLLTDHEMPDLDGLALAQRVRAGGFSMPILLLTSNPSAVRDHPAEALLAGVLQKPLLRSDLYRRLQSLTAPPAAPDRPPPVPVPALRRMRVLAAEDNRTNQLVFGKMVRDLDIDLTFADNGREAVELYDRIRPDLVFMDISMPEMDGRAAARAIRARERGGTHVPIVALTAHALESDARASAAAGIDRTLTKPLRRAMILETLAAFCPAGTRPIQPALVEGPD

SEQ ID NO: 16021 - protein, 644 aa, Rhodobacter sphaeroides
MPTATGGHSTGSGPLRPSDREERMTEKITLEQLQEMAADPGTRPEDLAPYFRTRDAASPFDPQIEIDETRVMVPDTAEAASRSALVLNSANWIERMKRQTRFHRRLSEGNYTGPIIVEEGDSWFQYPLLLRDVIDVLMDRYAIFSLSAGGDTLENMATGAQYRKALEETQASILLLSGGGNDLVADGQLADHLRPFDPNLRPADYLLGSFDQLIARSMALYDRIFADVARRFPKVDVICHGYDYTLPRIRGKWLGQPMQARGIADPALQASIAVVMVDRLNAELARLARRHPRVHHLDLRGRVERDHWNDELHPDDSGYAAVAAVFAERIDALTRRPRGVPRGAAAGGPAPEAAPALVQPRPMALSLHVGVNRVDQAHYRNFVQDLEFCVNDAEAMRDLAVQRGYETRLLTDAQATREALRGAMTDAAQQLEPGGIFLMSYAGHGAQIGDFNGDEGDGPDRDRLDETLCLHDAMLVDDELYQLWAAFREGVRVVAVFDSCHSGSILRASANRRTDRAGRTGRVRTISLGASVQIYRANRAFYDGLPSSILPSDSAVLTKELTYPVSASILQISACQSNQTAEEAFGNGLFTERLMATLAEGSGRLGYSGFTDRIAARMPPEQTPKFWRVGRPDPVFEAQTVFSV

SEQ ID NO: 16022 - protein, 838 aa, Rhodobacter sphaeroides
MTSLTRQGEIPRELIQLDARASSKEEAIAQAAAALVAAGCVRPGFEASMLRREAVSNTYLGKGIAIPHGTVEDRDLIQKDAIAVLQVRDGVEWNAGERARLVVAIAARSDGHIEILRRLTRLLQDEDRLAVLAATDDRQALSDALNGVAAGAAATAEPAGDFAQSFDWVLDYPTGLHARPATEWAEAARRFPCRIRIRHGAETADARNMISLLSLGLKSGDAITVSAEGQGAAEALATLKVTMTGLSAREKADAARAEEKRRATAAAGGWVPPSSPRAIEGVPAAPGLAIGRITRIATDGMEIPDEPVELARAADLLHAALGQTAEQLHSLADDTARRLGESDAAIFRAQAGLLADPDLITLASQWLVDGHGLAWSWHRAYEDMAARLSALRNPVLAARAADLRDVGQRVLAHIDPRFARSRLADLPEDTILVAEDISPSDAAGLDPAKVAGLVTALGGPTSHTAILARTLGLPAVVGTGAVVERLEDGACAIVDGHGGRLYLDPSEADLASARDWIAAEEARRARAAETRALPATTRDGHRIDIGANINLAEQAAFALGQGAEGVGLMRTEFLFLERSESPTEDEQAEAYAAMARALEGRPLVIRALDIGGDKQVAHLDLPREENPFLGVRGARLLLRRPDLLVPQLRALYRAAAGGAQISVMFPMVTSLGELLELRATCERIRQELDAPVVPLGIMVEVPSAALLAAEFAAHADFFSIGTNDLTQYALAIDRQNPELAPEADSLHPAVLRLIDLTVKGAAVHGRWVGVCGGIAGDPFGAALLAGLGVDELSMTPRDIPAVKERLRQSDRAGLRALAEHALACSDAEAVRALAAEAP

SEQ ID NO: 16023 - protein, 637 aa, Rhodobacter sphaeroides
MTDRPCTPTLDRVTLPVDIKGLTDRELRSLADELRAETISAVSVTGGHLGAGLGVVELTVALHAIFDAPRDKIIWDVGHQCYPHKILTGRRDRIRTLRQGGGLSGFTKRSESPYDCFGAGHSSTSISAAVGFAAAREMGGDTGDAVAVIGDGSMSAGMAFEALNHGGHLKNRVIVILNDNEMSIAPPVGALSSYLSRLYAGAPFQDFKAAAKGALGLLPEPFQEGARRAKEMLKSVTVGGTLFEELGFSYVGPIDGHDLDQLLPVLRTVKQRAHAPVLIHVITKKGRGYAPAEAARDRGHATNKFNVLTGAQVKPVSNAPSYTKVFAQSLIKEAEVDERICAVTAAMPDGTGLNLFGERFPKRTFDVGIAEQHAVTFSAALAAGGMRPFCAIYSTFLQRGYDQIVHDVAIQRLPVRFAIDRAGLVGADGATHAGSFDVAFLSNLPGIVVMAAADEAELVHMVATAAAHDEGPIAFRYPRGDGVGVEMPVKGVPLQIGRGRVVSEGTRIALLSFGTRLAEVQVAAEALAARGISPTVADARFAKPLDRDLILQLAAHHEALITIEEGAIGGFGSHVAQLLAEAGVFDRGFRYRSMVLPDTFIDHNSAEVMYATAGLNAADIERKALETLGVEVLARRA

SEQ ID NO: 16024 - protein, 855 aa, Rhodobacter sphaeroides
MSARRDTDLRRTVAAPRLWQRLRLPAAVLVMLAGATAIIGLANDARERFQQLDYIVTDGVQTRLSDLDGNLSQFASALGVTGSSPSPAAVRTSLRQLQEGLAQLDTAMAEAGVLWDPAYGEGIARLRQFERDRADLIAAPDATVTAAMPGLTRALPHLEQAVAELSATASADRESRNLENRAIIGSSIMRLVALTIGLVLMLSAGSFQLLRLYLRSREQAEAAGRASARLEAIFRISADAILVTDWSARVIDCNRAALAIFGHQRERLAGADAMELLFPAELQGRQRMRVVDALRNSDPRIDGPLRLELEAVHADGSRFPVEVSLAAARVEGEDIIVALMRDISARRRAERELTEARDRALAGEQTKADFLAVMSHEMRTPLNGLAGSLELLAQTPLDPRQRELVSVLRASAEILLDHVNSVLDIARSEARPSVAEMVDFDLDRLIEDCIANQSGFAAVVGNRIDHRPLTGPVGILNGEPQRLRQVLLNLLNNAVKFTRNGRIIVESEVQGADVEIRVLDTGIGIAPENLEKVFDDFVTLDASYERRSGGTGLGLGIARRLARIMGGDLTVQSTPGRGSRFTLRLPLRRPREELAASRGSDEALSVLLVEDNDINRFIAQNFLESAGHRVLTARSGLEGLTAAQSRHFDVILTDISMPGLDGLQVARRIRDGGGPSAASRILAVTAHSLTADPGALRAAGIDGWLEKPVSRDALLRMLRHPAEPASPPVEEALDTARLRELEDQIGPVALHGLIRQMILDGTAILERLAALGFEPPPEEARPLVHQLAGAISTFGTGPLHRRLRQAQEALRTGAEAGPHLAALPALWDRMRTALEEAAPDRPLDTAAPVRSSGAL

SEQ ID NO: 16025 - protein, 208 aa, Rhodobacter sphaeroides
MDAARSTRSCLVARLLSLVDFAATLPAGAANVERARLQFLSACCIKIGRMGAVVQKMCNFPVRPLFFCRRFVVRCARSKPCDPVGSEAAQAEQGIVVKLIIAAIKPFKLEEVREALTTIGVRGMMVTEIKGFGSQSGHTEIYRGAEYAVNFVPKVRLEIVVSDGLAESVVETIRTTAKTDKIGDGKIFVLDVEQAVRVRTGEINDDAL

SEQ ID NO: 16026 - protein, 668 aa, Rhodobacter sphaeroides
MAVKDTDDGKPEDQDAETSLDMSQAAVKRMIAEARERGYITYDQLNTVLPQDQVSSEQIEDVMAMLSEMGINVIENEEAEEGEPAGELVEQGSGSREIAVAGTQGETLDRTDDPVRMYLREMGSVELLSREGEIAIAKRIEAGRNTMIAGLCESPLTFQAITIWRDELLSEDILLRDVIDLEATFGRSLDGDGDDEIDGPEIDEVEVAAAPAPAPRRSTSSEPELDADGNPISRAEEEDEDDEASAMSLAAMEAALKPRVLETLELIARDYGKLAEMQNRRMSATLNDHIRFTTEDEAAYQKLRSEIVLLVNELHLHNNRIEALIDQLYGINRKIMSINSAMVKLADAARINRREFIDEYQGYELDPMWAERMAAKSGRGWQTLMEKSRDRVEDLRGEMAQVGQYVGVDISEFRRIVNQVQKGEKEARQAKKEMVEANLRLVISIAKKYTNRGLQFLDLIQEGNIGLMKAVDKFEYRRGYKFSTYATWWIRQAITRSIADQARTIRIPVHMIETINKLVRTGRQMLHEIGREPTPEELAEKLQMPLEKVRKVMKIAKEPISLETPIGDEEDSQLGDFIEDKNAILPLDSAIQENLKETTTRVLASLTPREERVLRMRFGIGMNTDHTLEEVGQQFSVTRERIRQIEAKALRKLKHPSRSRKLRSFLDQ

SEQ ID NO: 16027 - protein, 321 aa, Rhodobacter sphaeroides
MADAAQFHDRMLSLGLARVSEAAALASARLIGRGDEKAADQAAVNAMRDQLNLLDIAGVVVIGEGERDEAPMLFIGEEVGTGHGPAVDIALDPLEGTTLTAKDMPNALTVIAMAPRGTLLHAPDVYMEKLAIGPGYAPDTVTLKMTPAERVHALAKAKDGTPEDVTVCILERPRHEELIAEVRSTGAAIRLITDGDVAGVIHCAEAHLTGIDMYMGSGGAPEGVLAAAALKCMGGQMYGQLLFRNDDERSRARRAGIQDLDRIYTRDELVTADVIFAATGVTNGSILAGIKREPGWVTTETILMRSKTGSVRRMSYRSPVK

SEQ ID NO: 16028 - protein, 254 aa, Rhodobacter sphaeroides
MSDFLQGLFSLTGRRAMVTGASRGLGQAIALGLAEAGADLVLTARAAGALEETAARIRALGREALCLALDQSDPASVAAPMEAAGRIDILVNNAGTEEVCPSEAVTPELWDRILDTNLRGAFFVTQAAARGMLARGQGSIVNLCSLTSFVGVPTAVPYGSSKSGLLGMTRALAAEWAPRGVRVNAIAPGYFRTALTEVFYQNEDWAQAMQARIPQGRFGEGRDLVGAAVFLASDASAYVTGQCLGVDGGYLGSI

SEQ ID NO: 16029 - protein, 389 aa, Rhodobacter sphaeroides
MVDARAGRGSDGSARQQRERAFRDNWICLAARCMAELRAPGRPRPSVPDPSEDKMTDALSRLLRTRDWLMADGATGTNLFNMGLSSGEPPELWTVDRPDNIRSLYRAAVEAGSDIFLTNSFGGNAARLKLHEAQGRVGELNRIAAELGREVADAAGRPVVVAGSMGPTGEIFEPMGTLTHRMAVEIFHEQAEALKAGGADVLWVETISAAEEFKAAAEAARLAGMPWCGTMSFDTAGRTMMGITAAALVDLVTKLPNPPLAFGANCGVGASDLLRTVLGFAAQGIEVPIIAKGNAGIPKYHDGHIHYDGTPELMAEYAVLARDAGARIIGGCCGTMPEHLKAMRAALEGRPRGPRPSLETISETLGGFSSASDGSDDAGPTRERRRRRS

SEQ ID NO: 16030 - protein, 254 aa, Rhodobacter sphaeroides
MDYRTVFRLDGACAAVTGAGSGIGLEICRAFAASGARLILIDREGAALDRAAEELGAAVASRIVADVTDAEAMTAAAAAAEAVAPVSILVNSAGIARLHDALETDDATWRQVMAVNVDGMFWASRAFGRAMVARGAGAIVNLGSMSGTIVNRPQFASSYMASKGAVHQLTRALAAEWAGRGVRVNALAPGYVATEMTLKMRERPELFGTWLDMTPMGRCGEPSEIAAAALFLASPAASYVTGAILAVDGGYTVW

SEQ ID NO: 16031 - protein, 316 aa, Rhodobacter sphaeroides
MPTYDVSSIGFYVCDILGRPVTRIPDGGRADYIQEIRMTVAGTAGATAADCAILGLKTLAVTTVGEDEMGDFMVAKLTRFGVDCAMVARDGSVQTSATILPVRPNGERPALHVPGTAATFRIPEGRLDAALDARIVHVGGTGLLKSFDGAPTVEALRRAKELGRITTFDLIQATPETFELVRPCLPYIDYFVPSIEEASEMAGTTDPAEVARFFKGLGVKNAILTMGGEGVYVSPEAGEDFRLPAHAIEVVDTTGCGDSFTAGVIVGLARGWDLRDCCRFASAVAARVAMGLGSDGKLVSFEDTIEAMNTLPLRAN

SEQ ID NO: 16032 - protein, 248 aa, Rhodobacter sphaeroides
MTKTAVVTGAARGIGRALAVGLAEAGYDVAVTDLAAQADGLAETRALIEAAGRRAFVETVDVSDRAAVVAAMARIEDAAGGIDVLVNNAGILKPARLEDLSEADWDAHMDVNVKGVLSCCQAVLPGMRARKAGRIVNIASIAGRQGVPTQGHYAATKAAVITLTRVLAQEAGMDGITVNAICPGIILTEMGKNNLGSDEAIRHWEEVAALKRLGAPEDIVGPVLFFAGEQSAFVTGQALNVCGGIYFH

SEQ ID NO: 16033 - protein, 648 aa, Rhodobacter sphaeroides
MTNPTPRPETPLLDRVCCPADMKALSDAELERLADEVRSEVISVVAETGGHLGSSLGVVELTVALHAVFNTPTDKLVWDVGHQCYPHKILTGRREQMRTLRQKGGLSGFTKRSESAYDPFGAAHSSTSISAALGFAMGRELGQPVGDTIAVIGDGSITAGMAYEALNHAGHLNKRLFVILNDNDMSIAPPVGALARYLVNLSSKAPFATLRAAADGLEASLPGPLRDGARRARQLVTGMPGGGTLFEELGFTYVGPIDGHDMEALLQTLRAARARTTGPVLIHVVTKKGKGYAPAENAPDKYHGVNKFDPVTGEQKKSVANAPNYTKVFGSTLTEEAARDPRIVAITAAMPSGTGVDIMQKRFPNRVFDVGIAEQHAVTFAAGLAGAGMKPFCAIYSSFLQRGYDQIAHDVALQNLPVRFVIDRAGLVGADGATHAGAFDVGFITSLPNMTVMAAADEAELIHMIATAVAFDEGPIAFRFPRGEGVGVEMPERGTVLEPGRGRVVREGTDVAILSFGAHLHEALQAAKLLEAEGVSVTVADARFSRPLDTGLIDQLVRHHAALVTVEQGAMGGFGAHVMHYLANSGGFDGGLALRVMTLPDRFIEQASPEDMYADAGLRAEDIAATARGALARGRVMPLRQTAKPRAV

SEQ ID NO: 16034 - protein, 254 aa, Rhodobacter sphaeroides
MGPAEFLTGRGIDVRPHPHIGLGTVTYLLRGRLHHRDGLGTDQWIEPGAVNWMLAGHGITHSERTDAPEGPGSLFGLQTWLALPKDREDDAAAFVHQGADRLPELEGEGKRVRLILGQAWGERAPVDLPVEAVYADAILAPGARLPMPEGHEDLGAYVIDGSVSVGGQSFEAGRMLVMRPVDRLALTAGSQGARLMVLGGAVADGPRWIWWNFVASSKERIEAAREAWRAGDWAHGRFRLPPNDSAEFIPAPEK

SEQ ID NO: 16035 - protein, 303 aa, Rhodobacter sphaeroides
MAHAGRPPHRSPLTCGAPGPSSFHRQTKETAMTATLEFHDGSRIPQLGFGLWQVPEDRTAEVVREALELGYRLADGAAIYGNEEGLGHGLRTSGLPRDKVFVTTKVWNDAQGFESALRAVEESLKRLGLDRLDLCLIHWPAPKRNLYVETWRALIRLRDEGRITSIGVSNFDLDQIDRLTAETGVTPVLNQIELHPMLQQAELRAGHAERGIVTQSWSPLGRGMAFETPAIREIAERTGRSPAQVVLRWHIELGCAVIPRSTRRAGLAENLALFDFELTEADHAAISALDAGTRTGPDPQSFG

SEQ ID NO: 16036 - protein, 470 aa, Rhodobacter sphaeroides
MIRSRKPMADFIVKDLSLADFGRKELDIAETEMPGLMALREEFGASKPLKGARIAGSLHMTVQTAVLIETLVALGADVRWASCNIFSTQDHAAAAIAASGVPVFAIKGETLEDYWAYTDKIFQFADGTCNMILDDGGDATLYILLGARVEAGETDLIAVPQSDEEVCLFNQIRKRMAETPGWFTKQRDAIKGVSEETTTGVHRLYDLHKKGLLPFPAINVNDSVTKSKFDNKYGCKESLVDGIRRATDVMMAGKVAVVCGYGDVGKGSAASLRGAGARVKVTEVDPICALQAAMDGFEVVVLEDVVQDADIFITTTGNRDVIRIEHMREMKDMAIVGNIGHFDNEIQVAALKNHKWTNIKDQVDMIEMPSGSRIILLSEGRLLNLGNATGHPSFVMSASFTNQVLAQIELWTKGADYQPGVYILPKALDEKVARLHLKKIGVKLTELRPEQADYIGVKVEGPFKAEHYRY

SEQ ID NO: 16037 - protein, 486 aa, Rhodobacter sphaeroides
MIEKRDFYINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAISGWDPEAEALAAE

SEQ ID NO: 16038 - protein, 459 aa, Rhodobacter sphaeroides
MERARPARHGQRRLHAGGSHDPRGLPPRARGPARPARLAALRHRHPGPRLCGPHRGGARPDAPRAGRDHPHRLRQEAPGLSDRAGRPAGLPPRFRLSRGELSRGARLHPALLRRDPGVSGGGRRAHARHARALPAELHLCPQGRGRGCALLLHDGRLRGAARAERSRALHARHVCRDPAYLRRYDRHAGHRGADPRRMERAGRRAMSGPFDLTGRVAVVTGAGRGLGAAMAEALAAAGATVVLSGRDPGPLERTAAAIRAAGGAASVTLCDITKRAEVEALVAETEARHGRLDVLVNNAGITGRSALTEVEDADWDLMLRTHMTGPFMACRAALPGMMRRGAGKIVNTVSVLGELGRPWVVPYAAAKGGLRMLTRALATEVAGANIQVNGIGPGYFETEMNAAIVQNEALHAERVARVPARRWGRPVELGGTAVYLASAASDYVNGQIIYVDGGLTASF

SEQ ID NO: 16039 - protein, 460 aa, Rhodobacter sphaeroides
MIARQGEGIVVLADPQRLEIRPLAPRAQEEARIEAAAAQRIDLKLRHEEMELEAHLGEGAAEGLQEARHLGAAAGDLVEADVQRAELPLRNAPRAEPGILDPLENVAAVFEEGRARPGEADAARLALEKRRAHLGLEIADLPPERGLRQVQPLGRPVEVQLFRDGQKVAEMTSLQHLIPQRHRPGQPKVLASRPPCARQSGRLRRVRRKGGFIMTGRLAGRKIVITGAGSGIGRESARQFAREGATLALIDRDEAAAQVTADETGGHVFALDVTDEAAVETVVGRAAEALGGIDGLLNSAGILTMKTVDDIGVEEFRRVVDVNLTGTFLVCQAALPWLRKEPKAAIVNIASAQALLPSLTGSAYAASKAAVMMFSKSIAKELAPAVRVNIICPGATETPMTDQGVAPDDVAGRKALAAVYAMNRLAQPEEIAAGILFLMSDEAAAITGVALAIDNGRTFH

SEQ ID NO: 16040 - protein, 290 aa, Rhodobacter sphaeroides
MCSTPAPSSSRAPGPSSTGTKPSATAIWRLPDTSLGGDIMTRFEGRTALVTGGANGIGRASAIAFAEQGARVGILDIEEGPLAETAEAIRAKGGRVVTVVTDMRDRAAVKAAIGQVEAELGPIDLLLNNVGQTARKNASEFLDSVPETWDFVVDLNLMVTFYVTWTVAKGMKERGFGRIVNISSDSTLVGERSIVDYVAAKSGVSGFTRGLARELAPFGITVNAVAPGVTNTRGPKQLPKEVYDAALAEIPLGHLAEPEDIANAITFLASQEARCITGQMLTVNGGRIFY

SEQ ID NO: 16041 - protein, 263 aa, Rhodobacter sphaeroides
MDLTGKTALITAGAGGIGLAIARRFADLGAQLCLCDISETAIAEAQALLPEALILRADVARSADVQEVVDRLVERFGGLDILVNNAGVSGPTRPVDEITDAEWNDTLAVNITAMFYMVRAAVPLFRAAGGGAVINMGSVAGRVGMPLRLPYSVSKYAVRGLTETLAIELGEIGVRVNAILPGLVDGPRGRRIIAEQARERGLSPEDYTRLFLHNISMHSMVQMEEVADMAAFLASDLAPHVSGQMIGVCGNFESYRAPLTVPA

SEQ ID NO: 16042 - protein, 551 aa, Rhodobacter sphaeroides
MADATIRTEPLPEEAIPAPEGPTQIIDTDYEIGQDNISYRRRFVFELDIHNVVFSVSALTIVAFTFLTLMFQTTLGPVFAAVRDALTSNLAWFFLLAGNVFVLLCVVLIFLPLGRIRLGGPDATPDYSRLSWFSMLFAAGMGIGLMFYGVSEPLGNYTAAFTGPVFENGVRTDWSPLNGAPGDTEAARRLAMAATIFHWALHPWAIYAVVALSLALFAYNKGLPLTLRSVFYPIFGERVWGWPGHVIDILAVFATIFGLSTSLGIGAQQAGAGLDFLFGLPSTVGVTVFLVIVITGIATASVIAGMDKGVKRLSEANMALAFLLLMFVILVGPTLQIVRGFFLNLLAYVEYLPALSNPFGRTDDNFRHGWTAFYWAWWISWSPFVGMFIARVSRGRSVREFLIAVLLIPSIVSTIWMTALGGTAISQVVNEGLSSVQDAALEIQLFEMLSHLPLTQITSMIGIVLVIVFFVTSSDSGSLVIDTIAAGGKVNAPVPQRVFWATFEGLVAIALLLGGGLAALQAMAVSTGFPFTIVLLGACYALIRGLAAEPR

SEQ ID NO: 16043 - protein, 498 aa, Rhodobacter sphaeroides
MTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWIDLADDAAEAVS

SEQ ID NO: 16044 - protein, 347 aa, Rhodobacter sphaeroides
MHGDGPCASGHPHQRGLPERGEHADAAHGLREARLRPGSGGGGAGPHRASGPHRRARGHCRCGAVPRLGCRALPLRLSRRGQWREGRRMSRFEGRVALVTGGGRGIGQAIARRLASDGARVFTAQRGADAGFEAIAADFADADAPARAVAEAVDRAGRLDVLVNNAGVMQEARVEEMALADWERTIRVNLTAPFLAIRAALPHLRAVRGAIVNVGSIEGLGANPRHAAYCASKAGLHGLTRAVAVDHGAEGIRCNAVAPGWIETELNEAFVEAMPDPEAFRRGIGRIHPVGRTGQPEEVAALVAWLASDEAAFVTGQVWTVDGGRMAQLSLPHEDYSAAARHSFQRR

SEQ ID NO: 16045 - protein, 407 aa, Rhodobacter sphaeroides
MPGDPLHPRAALQQHRGDRRDPRPAASRGLSRRDGRGCGDRAARGGAGGLRRLRHEGHADRRPPPDGGLPRHLRGPLDAPHLRRRLGRRHHRGRLHPYRRHRPAAADGGGLAGPALYRGPFRPRERPADRGRPHPPARGAGPRDRAGREPLRRAGRVFRVGGAMQGFEGKVALVTGAAGGIGGAVVTALRAAGARVAVADRAVAGIAADLHLPGDLREAAYADGLPGAVAAGLGRLDIVVNNAGVISRGRITETTDADWSLSLGVNVEAPFRICRAAIPLMAAAGGGAIVNVASCWGLRPGPGHALYCLTKAALASLTQCMGMDHAPQGIRINAVCPNEVNTPMLRTGFAKRGFDPDRAVAELGRTVPLGRIAEPEDIADVVLFLASDAARYLCGSLVEVNGGKAVA

SEQ ID NO: 16046 - protein, 258 aa, Rhodobacter sphaeroides
MRPARVASPKRGMAIMGEQKTMVLTGASRGIGHATVKRFSREGWRVLTCSRQPFDPRCPWPGGEENHIQVDLANPDMTIRAIEAIKDKIDGRLHALVNNAGVSPKGPKGERLSTITTDLRTWGQVFHVNFFACVVLARGLQEELTAGKGSIVNVTSIAGSRVHPFAGAAYATSKAALAALTREMAHDFGPLGVRVNALAPGEVETAILSPGTDKIVEKLPLQRLGQPSEVADAIWFLRSDQSSYISGAEIEVNGAQHV

SEQ ID NO: 16047 - protein, 412 aa, Rhodobacter sphaeroides
MVPPAGDGGRHPYLPRGQPHRHCPRPRCGSGRAGARGSCAGALCAPCASLAHPARTLHLRRAQTQMRHLPDPRSLPLRGKDGMKQFQIVGIGNALVDVLSHCDDAFLAENGIAKGIMQLIDMGRAVDLYGRIGPAQEISGGSAANTIAGIAQLGGRTAYVGKVCDDQLGAIFAHDLRAQGAVYETPMAPKGGAQETGRCIILVSPDGERSMNTCLGWSEFLTPDDIDEAQMASTEWIYLEGYRFDGPESHAAFAKAIAACRGAGGRVSLTLSDPFCVERHRDAFRRMIREDVDLLFANRAEILSMYRTEDFGAALKAAAAEVAIVACTESEKGAHILADGQHWHVPALPTQIVDATGAGDLFAGAFLWGLTHGHGYETAGRMGCIAASEVISHLGARPEADLRALFRAQGVL

SEQ ID NO: 16048 - protein, 246 aa, Rhodobacter sphaeroides
MAGRLEGKRALVTAAGQGIGRASALAMAREGARVLATDLNAAALEGLAAEGLEVQPLDVRDPASIAAAVAAAGPLDVLFNCAGFVASGTILDCDEEDWAFSVGLNLTGMYRMCRAFLPGMIAGGGGSIINMASVVSAAIAAPNRFVYGTTKAGVVGLTKSIAADFIGQGIRCNAICPGTVESPSLEDRLRATGDYEAARRAFVARQPIGRIGRPEEIAALVVYLASDESAYTTGVAHVIDGGWSNI

SEQ ID NO: 16049 - protein, 126 aa, Rhodobacter sphaeroides
MVSGFRTRQRGSRAVKKIEAIIKPFKLDEVKEALQAAGVQGLSVTEVKGFGRQKGHTELYRGAEYVVDFLPKVKIEVVLADDMVEAAVEAIVSAARTDKIGDGKIFISPVEQAIRIRTGETGEDAV

SEQ ID NO: 16050 - protein, 404 aa, Rhodobacter sphaeroides
MPPNFPPCNAGRGLASCWPKGTPMGLSKTIWTNPAEYLRALSPEAPVLFFSPSTLQATARRFIDGFPGMVTYAVKSNPEEVVIENLAAAGIRGYDVASPHEIRMIRRIAPDAALHYNNPVRSRSEIGVGVEMGVKSWSVDSASELAKLIELVPAEGCEIAVRFKLAVSGAAYNFGAKFGATVELAVELLRRVAEAGFIPSMTFHPGTQCTDPAAWETYIRTAAEIARDAGVTIARLNVGGGFPSHRLNGVEPELEAIFHLIDRVTDEAFGADRPLLVCEPGRGICADAFTLAARIKAVRDDAHVFLNDGVYGSLTELPMIGVIDRVAVLTPEGRRRDGETRDRIIFGPTCDSVDRLPGELPLAADVEEGDFLVFQGMGAYSAATNTRFNGFGELSMATVLSLKL

SEQ ID NO: 16051 - protein, 250 aa, Rhodobacter sphaeroides
MLLNGKTIIISGASSGIGAAAARLFAAEGARLILGARRAALLEEITNEILAGGGEADFVVGDVEDSGFAAELVQRAEDRFGGLDGAFNNAGVTGEMCPIPDMPESNWHKVIAVNLSSGFYAAKHQIPAMRKRGGGSIVFTSSFVGHTIGLPGMGAYAAAKAGLIGMTQVLAAEHGPEKIRVNALLPGGTMTPMAGEDAGFHEVVRGFHALKRMADPSEIAQAALFLLSDQASFVTGTALIADGGNSISKL

SEQ ID NO: 16052 - protein, 150 aa, Rhodobacter sphaeroides
MEFRSHMQAALAEARAAGARGEVPVGAVVVAPGGQVVARAGNRCRELSDPTAHAEMLAIRAACATLGERLTGCDLYVTLEPCPMCAAAISAARIARLYYGAADPKSGGVAQGARVFAHPQCHHVPEVYDGIGEAEAAALLRGFFSARRPG

SEQ ID NO: 16053 - protein, 886 aa, Rhodobacter sphaeroides
MPGTSRIGQKIHFEKSAFDVNQGLSRINLSDRPRRSAAVEGGGSWRWTCRARGTGKGLAPRSPTSCALEGVWSMIAEKSERFFPFAVSAELAPVGVSAAERSALADYLESSETLLTERVVAYASTRSYSHLVSTLPEAWRSSVQGLTDSVILMLDHQSAEAAIDYDADIGTDPSTAYGIEAGLRHRLRGISLETFIGAFKGYRDVYLNVTAEARVPAAMREGWLRLLRGFFDRAEIGICAHWSGELGTLDHDQLLSVNRALVNEKNKYLTIFESMNNPVLLVDDGGRIENMNFAAARLFLQDALPGSVYYGPEANLRFADLAGFDLEAVKLRGEAGDVLTCIGERWYSITAQEMLDVSRKFVGIVVTFHDVTEARRAREQAEALARAKTDFLATMSHEIRTPIHSIGGVTELLKQSELASRDRGYVDAIERSTEVLASIVSDVLDYARIESGLVELEQVDFSIDQILDDVARMMQPLVRRKPQLRIVIERTDLPPVLGDAGKLRQILINLTSNAVKFTPEGTVVIGAERLAGGHRFRFTVSDTGPGIAAEKLEEIFKPYIQSDSSISRRHGGTGLGLAICRRLAGHLGGRLDVRSTPGFGSRFTLEVALAPGGSEPPGDATADAPPPARALDLLVVEDDEVNALVAQSLLSAAGHGVRVAGTGEAALVALGEHRFDLVLTDLNLPDMDGLELARTIRRHADRHTAELPLVALSAHGPGVDPAALTEAGIDAFLGKPFHFARLEEILSRLVGSSSPTPLGKAAPARRALQSVDLCVLRGHAEALGRTSAARIVQTFRQSVLETARALELAMDEADMRSVTSLAHRLKGAARHLGFRGLSDKAEQVETAAAADGCEAALVLELVSDCRAAPALADLAWAEASAGVAES

SEQ ID NO: 16054 - protein, 733 aa, Rhodobacter sphaeroides
MSLALIDPSDPPERQRDKLLEIVRALMARVERTTDDGGAAYAQFQRAAMLEDQVRERTADLQRTLELLNLSNERLAEATRAAEEARQNLANAIETVQEGFALFDADDVLVLCNSRFGMHMLDIQEHLKPGLSFGGYIDRVSRSRYLALPEAETPEDWAVRRKRRHYDRHSIFNVRLIWDRWLQVSEHRTADGGTVILQTDVTDLIRIERLERGKMLDDQARVIRATLDHINQGVCIFDAEGRLVGWNQRLGSLLAIPMNRFRLGVSFGYLLERFAHEISFGEGMDAAHLEAWVQARHERAPLSFELRRHDELILDVFAQEMPDRGFVMSFTDVTAERAAIEALSRANETLEARVMERTLELEDALGHAERANASRSRFVAAASHDLLQPLSAAKLFIATIGDEAVAPESREALTKAQKALDSVEGILGALLDISKLESGRAAVSIQPVRLDRLMAQLSDEFAPIAAARGLRLTVLPSSAVVASDPTYLRRILQNLIGNAIRYTAKGRVLVGARMTAGMVRLEVWDTGPGIAEADQEAIFKEFHRLDAPASPAEGMGLGLAIVERACGLLGHPLGLRSEIGRGTCFMLQVPRAESAPAPSVPDASAVRAQAKVAVQDKIAFLVENDDDLRQAMGLLLEKWGVSVLDAPSGEEALALIEEIGILPDFFLVDQQLGAGMTGVEFIRTMRDRHGPVPACIVTAARRPEVAALCAETGIRLIQKPIDARVLEEFLRAL

SEQ ID NO: 16055 - protein, 848 aa, Rhodobacter sphaeroides
MQKIEPISDFDRITPTAAISLKTHGFRAKCLQRLVRLDLPVPVTVALPATTVRAIAAGHPVDCPAILADFGPTPLVSVRPSPENPDWGGPATVLNIGMNAARHAALARIHGEEAADAIYLGFIQSYAIHVARLDPEMFETGGSSSEALRAALHAWAEEMDEPFPQDPAQQLSEVLRSMARAWEGTTARLLRQAKGAPAEARLGLVVQEMAQDLGQGISGSGVIQFVDPATGVPQVTGRFFNRSRAWHGKAETLYLTQDPRGPSLEERAPEIFAALCRHGSVCRARLREEMQIEFTIEDSHLSVLDAVKVQRSSRAGLRIAVALADDQVITRSEALLRVEPRALSELLHPQVDPRGRRDRFARGIAASPGAAVGRIVFSSQAAQASAARGEPCILVRRETSPEDIRGMNCAAGVLTERGGVTSHAAVIARGLGLPCVVGASEIRLDARERRLVAPDGRVFREGDLITVDGTAGEALAGEAAMLAPALDSCFRKLLSWADEMRDIGVRANADTPADALVARQFEAQGIGLCRTEHMFFTDDRLVVMREMIFADSATDRAAALARLLPMQRADFVQLFEIMQGHPVCIRLLDPPLHEFLPHSREGLLELAEALDRPLSEVTRRVEAMAEFNPMLGMRGVRLGVAIPEIYDMQAQAIFEATLEVAGRGDPVVPEIMIPLVSARREVELVKTRIDAVAAAVHTKYGREFAYRLGVMVETPRAALRAGEIAQHAAFLSFGTNDLTQMTYGLSRDDAGRFMNTYVQSGVFPEDPFHILDVDGVGELLLIGAERGRATRPDLVVSICGEHGGDPESIEFCRRAGFDYVSCSPYRVPLARLAAAHLAIRSREQPNAS

SEQ ID NO: 16056 - protein, 374 aa, Rhodobacter sphaeroides
MKITAAVLERDGIAGNYAEERPLAIRELDLAEPGPGEVLIRVAAAGICHSDLSVINGTRRRPLPMVLGHEASGHVEALGEGVEDLEHGDHVVCIFAPGCGRCTPCAEGRPALCEKAARHHAVGELMTGHRRLSLGGRSVHHHLGISGFATHAVVARPSLVRVPREVPPHVSALFSCAMLTGAGAVFNTAQIRPGSKVAVVGLGGVGLSAILGAAAAGAAEIVAIDPFPAKMEAARAMGATLSVPADGDTVAAVRDLTAGGVDYAFELAGSVRALETAFAVTRRGGMTVTAGLPHPDDRMSLEALKLVAEERTLKGSYIGSCVPQRDLPRMLALHRRGLLPVEKMLTHRLKLDEINLAMDRLAKGSAIRQVVDLG

SEQ ID NO: 16057 - protein, 265 aa, Rhodobacter sphaeroides
MHMTGGRIMDLNGKRAIVTGSNSGIGLGCAEELARAGAEVVINSFTDRDEDHALAEKIGREHGVSCRYIAADMSDGEACRALIETAGGCDILVNNAGIQHVSSIEEFPVGKWNAILAINLSSAFHTTAAALPGMRAKGWGRIVNIASAHGLTASPYKSAYVAAKHGVVGFTKVTALETAGKGITCNAICPGYVLTPLVEAQIPDQMKAHDMDRETVIREVMLDRQPSRQFATTGQIGGTVVFLCSGAADQITGTTISVDGGWTAL

SEQ ID NO: 16058 - protein, 463 aa, Rhodobacter sphaeroides
MATQVLMPALSPTMEEGTLAKWLVKEGDAVKSGQIIAEIETDKATMEFEAVDEGTVGKLLVAEGTSGVKVNTPIAVLVEEGESADEVQAPVPTQKEKQPEPAEASEGKAVDEPLVSSPGAPVPGKRDRSPDWPDGTQMKTMTVREALREAMAEEMRGDEHVFLMGEEVGEYQGAYKISQGLLDEFGDRRVVDTPITEHGFAGIAVGAAFGGLRPIVEFMTFNFAMQAIDQIINSAAKTLYMSGGQMGCPIVFRGPNGAAARVGAQHSQDYAAWYAQIPGLRVVMPYSAADAKGLLKTAIRDPNPVIFLENEILYGRSFEVPVMDDFTIPFGKARIWREGTDVTIVSFGIGMTYALEAADKLAAEGISAEVIDLRTLRPIDYETVIESVKKTNRCITVEEGWPVGSIGNHLAATIMQQAFDWLDAPVLNLTGKDVPMPYAANLEKHALVTTAEVVEAAKSVCYR

SEQ ID NO: 16059 - protein, 285 aa, Rhodobacter sphaeroides
MTHHPKPPFPDQEQPMPGKTSRLDPQPDHGEKSYRGSGRLQDMKAVITGADSGIGRAVALAFAREGADVLISYLSEDEDAAETERLVTEAGRKAVLVRGDLQDAAHCRAVIDRAVEEFGRIDLLVNNAAHQASFSDLGDIPDDEWELTFRVNIHAMFYLSKAAVPHMGPNSAIINTASVNADSPSPHLLAYATTKGAIQNFTGGLAQMLAEKEIRVNCVAPGPIWTPLIPSTMPAEKVKNFGTQVPMQRPGQPAELATAYVMLADPLSSYTSGATIAVTGGKPII

SEQ ID NO: 16060 - protein, 278 aa, Rhodobacter sphaeroides
MVDPLRLRHRLLHLRLGHGGRQCRLPRRRDGGDGGSAVISFSLEGQRALVTGANTGIGQAIAVGLAGAGAEVIAAGRSSCAETVAMTGGRELRLDFADPMAARDVFEAERIDILVNNAGIIRRADAVEFTEEDWDAVMDVNLKALFFTCQAFGRAALARGTGGRIVNIASLLSFQGGIRVPSYTAAKHGVAGITKLLANEWAGRGINVNAIAPGYIETNNTEALRADEARNRAILERIPAGRWGKADDIAGAAVFLASPAAAYVHGAILNVDGGWLAR

SEQ ID NO: 16061 - protein, 248 aa, Rhodobacter sphaeroides
MNQIDLAGRVAVVTGGAQGIGRAVAERLIASGARVCLWDRDAGRAAATAAELGGNSFFQVVDQVDFTAVKAAADATEATGGRIDILIANAGIAGSNAPVADYPVEEWHRIIDINLNGVFHCCKAVVPGMKAHGYGRIVTVASIAGKEGNPNAAAYSASKAGVIALTKSLGKEVAGQDIAVNCVTPAAARTQIFDQMAQSHIDYMLSRIPRGRFLDLDEAAAMIAWLASAENSFTTGAVFDLSGGRATY

SEQ ID NO: 16062 - protein, 376 aa, Rhodobacter sphaeroides
MRTRAAVAVEAGKPLEIMEVNLEGPKAGEVMVEIKATGICHTDEFTLSGADPEGMFPAILGHEGAGVVVEVGPGVTSVKPGDHVIPLYTPECRQCPSCLSQKTNLCTAIRGTQGQGLMPDGTSRFSMLDGTPILHYMGCSTFSNYTVLPEIAVAKVRPDAPFDKICYIGCGVTTGIGAVINTAKVEIGAKAVVFGLGGIGLNVIQGLKLAGADMIIGVDLNNAKKEWGERFGMTHFVNPSEIDGDVVAHLVNMTKTPFDQIGGADYTFDCTGNVKVMRQALEACHRGWGQSIVIGVAPAGAEIQTRPFQLVTGRVWKGSAFGGARGRTDVPKIVDWYMEGKIQIDPMITHILSLEEINKGFDLMHAGESIRSVVVF

SEQ ID NO: 16063 - protein, 418 aa, Rhodobacter sphaeroides
MEERHAEGFLQVPDLAVDCRRRQTEARGPARQRGAARHRHEGAQLLQGDRIEPHHFQIPEQNFYLIKFHKIRSAASWAHVAEEMPVKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 16064 - protein, 289 aa, Rhodobacter sphaeroides
MQGGVMLLNLGSINIDHVYRMPHLPAPGETLEAESYSVGLGGKGANQSVAAARAGARILHVGAVGPEGRWARDWMAAAGVDVTHVAVGEVATGHAIINLDEEAENTIVIFPGANRTLDAATVTAALAAAGPGDTLLLQNETSAQVEAARLASQRGLRVIYCAAPFEIGAVQAVLPYVSLLVMNEGEAAALRAALGALPEVAMVVTLGARGAEWLVPGEDRLSVPAFPVTAVDTVGAGDCFTGNLAAALDAGLAPAEAMRRASAAAALQVTRPGAAEAMPTAEEVDAFLG

SEQ ID NO: 16065 - protein, 219 aa, Rhodobacter sphaeroides
MLKIYGVYRSRASRPLWLLAELDLPFEHVPVIQANRVAHPHGPEAPLNTASAAYLAVNPLGQIPCLEEEGLILTESLAITLHIARTQGGQLGPRSEPEDALMVSWSLFAATAVEPPALEIQLIQRSGGGTSPEGQAAIAIAAERLRRPLARLERHFAAEDYLVGGRFTVADLNLAETLRYGQAHPALLEPFPAVAAWLDRCQSRPAFRLMMERRAAEPE

SEQ ID NO: 16066 - protein, 451 aa, Rhodobacter sphaeroides
MVRSSTFTSHARAILALGLPLVGSHLAQMSLHVTDTVMLGWYGVTELAAVVLGASLFFVTFILGSGFAQAVMPMVAEALGRGDETQVRRDTRMGLWLSIAFGLLVYPLFWFSGSILLALGQQPEVAALAQDYLRIAGLGMVPALLIMVLKSYLSALERTQIVLWATLAAVVVNAGLNWVLIFGRFGAPELGVEGAAIASVGAQIMSLAALGLYAALLPPLRRFNLFQRFWRPDWHALARVFALGWPIGFTGLAEGAIFQAAALMMGWIGTVPLAAHGIAPEVTALAFMVHVGISNAATIRTGRADGAGNTEGLRDGAKVAILLSLGFGLVMVAIFLLFPGPIIALFLDRANPEFDEIVAFGSVLLAFAALFQIADAMQVIALGLLRGLRDTQVPMWLASFSYWMVGIPASYVLGFPMGLGGPGLWLGLVVGLTLAAILLMTRFWLRAPRLA

SEQ ID NO: 16067 - protein, 240 aa, Rhodobacter sphaeroides
MSKVALVTGGSRGIGAAISVALKNAGYTVAANYAGNDEAARKFTEETGIKTYKWSVADYDACAAGIAQVEAELGPVAVLVNNAGITRDSMFHKMTRDQWKEVIDTNLSGLFNMTHPVWSGMRDRKFGRIINISSINGQKGQAGQANYSAAKAGDLGFTKALAQEGARAGITVNAICPGYIATEMVMAVPEKVRESIIAQIPTGRLGEPEEIARCVVFLASDDAGFVTGSTITANGGQYFV

SEQ ID NO: 16068 - protein, 458 aa, Rhodobacter sphaeroides
MARAPIPRPAPRPGPRSSAPAGASAPSRAPDLQADQTMDHFLYRNGSLHAEEVPLSDIAATVGTPFYCYSAATLERHYRLFTEALTPLPHLVCFAIKSLSNLAVLKLLGDLGAGMDVVSAGEYLRARAAGVPGDRIVFSGVGKTREEMRIALEGGIRQFNVESEPEMRALSEVASSMGLRAPIAVRVNPDVDARTHEKIATGKKENKFGIPIERASEVYAEAAALPGLEVMGIDVHIGSQLTELEPFEQAYLKVAELTGRLRAEGHEIRRLDLGGGLGIPYTRSNEAPPLPTDYGALIKRTVGHLGCEIEIEPGRLISGNSGVLVSRVIYVKNGEGRDFLILDAAMNDLVRPSMYGAHHDIVPLAEAAPGTESQPYDVVGPVCETGDTFAKARALPPMAEGDLVAFRSAGAYGAVMASEYNSRPLVPEVLVRGDHFAVIRARPTFDEMLGRDSIPEWL

SEQ ID NO: 16069 - protein, 269 aa, Rhodobacter sphaeroides
MSLIISGKTAIVTGAAAGIGLAVARHFVDKGANVMFVDMDEERLADQIGEEARAEGPVRMFAGDLREKLTITNLLSATMDAFDRVDILVNASRQVALSDPLCPEEDAVETLLQQNMLTSLRLTQLTAKRMIARAEKSDEKPTQVGSIINLSSIAAIRTQPELLAYSISCAAVEQMTRSMAVALASKGIRVNAVSFGSVMSASLQTALKDSPAMRAQITERTPMKRIASPAEIVETVQFLASDAAAFMTGQVVTLDGGRSLIDPALAPVH

SEQ ID NO: 16070 - protein, 268 aa, Rhodobacter sphaeroides
MNLHLEGKIALVTGSSKGIGAGIARGLARAGAVVMVHGRDREQATAVARQIRQDGGTAHVVTGDLTEEAEVDTLLAEVRAIGDIDILVNNAGGSGGNSDWATTKAGAWAATYDANVLAAMRIAKAVLPQMRHAGWGRIINISSLAALMPPAGNPDYSAAKAAMLAMSASMAKAVAADGVTVNTVSPGTIHSEKLDRKFREVAQQRGIAPEAPWEVVEAEALPLFASVPTGRVGTLDEIADAVAFLASPRASYITGSNLRLDGGMLPTV

SEQ ID NO: 16071 - protein, 292 aa, Rhodobacter sphaeroides
MALDGYTDQTMSRQAMRAELLDAETELRLAYAWRDQRDERALHRLITAYMRLAISMASKYRRYGAPMNDLIQEASLGLMKAADKFDPDRGVRFSTYAVWWIKASIQDYVMRNWSLVRTGSTSSQKALFFNMRRVQARLEREASQRGEALDAHQLREMVAHDVGVPLSDVEMMEGRLSGSDFSLNATQSADDEGREWIDALEDDSAQAAEVVEGSLDAARLRGWLVSAMQQLNARERFIVTERKLRDVPRTLESLGEELKLSKERVRQLEAAAFAKMRRSLEAQSREVHHFLL

SEQ ID NO: 16072 - protein, 441 aa, Rhodobacter sphaeroides
MAGDGAGAAARPVCGLRGGRRGGLRAACHARPGPLQLGFGLGGHGMLDGKRILLIIGGGIAAYKTLELIRRLREGGAAVTPVMTRAAAEFVTPLSVAALAGEQVHRELFDLTQEAEMGHIALSRVADLVVVAPATADLMARMAQGRADDLASTLLLATDTRVLMAPAMNVRMWQHPATQRNLATLTCDGVLAVGPNEGDMACGEYGPGRMAEPMEILAAIETALGAGPLAGRRVLVTSGPTHEPIDPVRYIANRSSGAQGTAIAAALRDLGARVTFVTGPATVPPPPGVELVRVETAREMMAAVEAALPVEAAIFAAAVADWRVENASGSKMKKGTGGPALSFAENPDILATVARRAEGRPRLVVGFAAETDEVLAHATAKRARKGCDWIVANDVSPATGIMGGTENAVHLITETGVEDWPRMDKAAVAERLAARIAERIA

SEQ ID NO: 16073 - protein, 239 aa, Rhodopseudomonas palustris
MSFAGKAALVTGGSKGIGFAIAQALAQAGASVMICARDESEIAQALPALRNGVRGRVHGLACDVRDEAEVRQLVDHTVTAFDGLDILVNNAGVGLLGPVETFPPEHWRLTLDTNLTGAFYCCHYAIPALKARGGGAIVNIGSRSSVNAYGGGAAYCASKFGLLGLSESLLQELHPFGIRVSCVMPGRVATDFAGEPPQDWHLSADDVAQAVIDVLSFAPRALASRIELRPARPPSPAPR

SEQ ID NO: 16074 - protein, 450 aa, Rhodopseudomonas palustris
MRRPRRGRGAPAGRPHRHRVRRPRHPGQQRRGRSARASRDVSARALAAHPRYQPHRRVLLLPLRDPGAEGARRRRHRQHRQPLQRQRLWRRRGVLRLEIRPARAVGVAAAGAASVRHPRQLRDAGPGRHRFCRRAAAGLAPVRRRCRAGGDRCAVVRAARSGEPDRAAAGAAAIAGTAMSERAALPLYGRRAMVTGAAQGIGLAIARTLALHGAQVVLVNLKHESGEAAARAITNAGGDARFIVGDMSDEDAIAATVAASTAAIGGLDILVNNAAPTQRARPPFAEQSAALWDTTEAVMLRGYMLTAQAALPHLAQARGAIVNLSSVLARSVAHETAAYHVAKAGVEQLTRYLAWHLGRSGVRVNAVAPGVVDRDIGAKLSDDPVNRAVLEAAVPLGRAATGAEIAEVVAFLCSPAAGYITGQTLVIDGGLSLGEPFGVARATLRAAAGV

SEQ ID NO: 16075 - protein, 353 aa, Rhodopseudomonas palustris
MHREATMPAFPLNAWYAAAWDADIKHALFPRTICGKHVVMYRKADGTVAALEDACWHRLVPLSKGRLEGDTVVCGYHGLKFNPQGRCTYMPSQETINPSACVRSYPVVERHRFVWLWMGDPVLADPALVPDMHWNDDPAWAGDGKTIYAKCDWRLVVDNLMDLTHETYVHGSSIGNEAVAEAPFDVTHGDRTVTVTRWMKGIEPPPFWAAQLGKPGLVDRWQIIRFEAPGTVTIDVGVAPAGTRAPEGDRSQGVNGFVLNTMTPETDTTCHYFWAFVRNYRLSEQRLTTEIREGVSGIFREDEIILEAQQRAMLENPDRVFYNLNIDAGAMWSRKLIDRMVAQESAPKLQAAE

SEQ ID NO: 16076 - protein, 1296 aa, Rhodopseudomonas palustris
MSDMTKPISAKRTQLLALAAQRILVLDGAMGTMIQQLQLDEAAFRGERFKDFHRDLRGNNDLLILTQPQAIEDIHAQYLRAGADIVATNTFSSTSIAQADYEMSELAYEMSRDGARLARNAAAKVEAEDGKPRFVAGAIGPTNRTASISPDVANPGYRAVTFDDLRIAYSEQINGLLDGGADILLLETIFDTLNAKAALYAIAEITEARGIDVPVMISGTITDKSGRLLSGQMPEAFWNSVRHARPITIGFNCALGAKDLRAHIADISRVADTLVCAYPNAGLPNEFGQYDESPEYMASLVGEFAEAGLVNIVGGCCGTTPAHIKAIAEAVAPHKPRVIPTIDPRLRLSGLEPFELTKDIPFVNVGERTNVTGSAKFRKLITAGDYAAALQVARDQVENGAQIIDVNMDEGLLDSEAAMITFLNLVAAEPDIAKVPVMVDSSKFNVIEAGLKCLQGKPVVNSISLKEGEDKFLHEARIARRHGAAVVVMAFDETGQADTYARKTEICARAYDILVNRVGFPPEDIIFDPNIFAIATGLEEHNNYGVDFIEATRWIRQNLPHAHISGGVSNLSFSFRGNEPVREAMHSVFLYHAIKAGMDMGIVNAGQMIVYDDIDPELRQVCEDVILNRDPGASERLLALADKYRGQGKQQKEQDLAWRSWPVEQRLSHALVHGITEFIELDTEEARAKAERPLHVIEGPLMAGMNVVGDLFGDGKMFLPQVVKSARVMKQAVAYLMPFMEEEKARNLAAGTDTGERATAGKIVLATVKGDVHDIGKNIVGIVLQCNNFEVIDLGVMVPAAKIIETAKAENADIVGLSGLITPSLDEMSFLAGELQRSGFNIPLLIGGATTSRVHTAVKIDPAYPSGSVVHVNDASRAVGVASSLLSKDRGAAYAAEVRADYAKISAAHHRAQADKKRLTLAAARANATKIDWAATSPVKPSFIGTRSFSGYSLAELAEYIDWTPFFQAWELAGRFPAILDDSVVGEAARSLYADARKMLDRIVTENWFTAKATIGFWPANADGDDILVYADETRTTPIATLHTLRQQLDKREGRANAALSDFIAPVASSVADYIGGFVVTAGIGEDVIADKFKAERDDYSSIMVKALADRLAEAFAERMHARVRREFWGYAADENLSAEDLILEKYQGIRPAPGYPAQPDHTEKATLFELLDAEASAGVTLTESFAMWPGSSVSGLYFSHPQSAYFGVGKIERDQVEDYAARKGWDVATAERWLAPVLNYIPSRSTGATDETGMPPLAPQAAAPLSAEDAALASHPQGCTCALHLAWRKQKVAAK

SEQ ID NO: 16077 - protein, 513 aa, Rhodopseudomonas palustris
MADAATPPSGFQANLDRAAPLLKQLKADGIGHLIGGEIVAASSGEVFETASPIDNSVLAQVARGTAADIDRAAKAAKAAFPAWRDMAPAKRRKLLHTIADAIEARADDIAVLECIDTGQAHRFMAKAAIRAAENFRFFADKCAEARDGLNTPSDEHWNVSTRVPIGPVGVITPWNTPFMLSTWKIAPALAAGCTVVHKPAEWSPVTADMLARICKDAGLPDGVLNTVHGFGEEAGKALTEHPAIKAIAFVGETATGAAIMAQGAPTLKRVHFELGGKNPVIVFGDADLDRALDAVVFMIYSLNGERCTSSSRLLVQSSIADSFIEKLAARVRALKVGHPLDPATEVGPLIHQRHLDKVCSYVDVARKDGATIAVGGAPFDGPGGGHYVQPTLVTNARSDMQVAQDEVFGPFLTVIPFKDEAEAIQIANDVRYGLTGYVWTADMGRALRVADALEAGMIWLNSENVRHLPTPFGGMKQSGIGRDGGDYSFDFYMETKHVSLARGTHKIQKLGAV

SEQ ID NO: 16078 - protein, 377 aa, Rhodopseudomonas palustris
MHGAPGLLRFARSDGARAGLEYAEVVMSVTFRAAVLHELNRPLSIETVEAPPLAAGQLLVKLAYSGVCHSQVMEARGGRGPDRYLPHMLGHEGSGVVVEIGGGVTKVKRGDRVILGWIKGQGADTQGVRYASGERVINAGAVTTFNEYAVVAENRVTPLPAGLPMDVAVLFGCALPVGAGIVINIAKPQPGATLAIFGLGGIGLAALMACKLFACNQVIAVDVEAAKLKMATELGATTVIDASRIDPVEEIRRLTGGLGVDYAIESAGLTRVIEQAFDATRRFGGLCVFASHPRSGEKIALDPFELICGKRILGTWGGDSKPERDIELLAGLYRDGKLPLDAMFTRRYKLDEINEALDDLEHRRSVRPLIEIDPSLR

SEQ ID NO: 16079 - protein, 386 aa, Rhodopseudomonas palustris
MPRSRRRSPSQKARRFRRPKTPSPTSMRQQQAKEGAMATTFAAAIRDGLATALAVDDDVICFGLGTDDPKGVFGTTLDLHKQFGPDRVFDMPTSEAAMTGFAIGAALNGMRPVMTHQRLDFALLSLDQLVNNAAKWRFMFGGKRGVPITIRMIIGRGWGQGPTHSQSLQSWFAHIPGLKVVMPTTAEDAKGLLLGAIFDDDPVIFLEHRWLHNMKGEVPAGDVRSPLGKARIVRQGDAVTIVAMSYMTVEALHAVDHLAAQGIACDLIDLRSIRPLDWPAVIASVQKTGRLLALDSGHLTGGVAGEIVARVATDHFASLKSAPQRLAAPDVPEATSPALTKNYHVRAEHIAEAVGRMLGREVEIASLVAQRTFPHDVPGTWFSGPF

SEQ ID NO: 16080 - protein, 991 aa, Rhodopseudomonas palustris
MRAFDWASTPIGPPESWPQALKTAVRIMLTSQQPIWIGWGTELTYLYNDPYKSIIGGKHPWALGRPTSEVWSEIWEDIAPLLAKATSGHEGTYVEAQLLIMERNGFPEETYYTFSYSPIPTDDGSPGGIFCANTDDTQRVITERQLSLLRDLAASAAESRSVGQACERSAAALATDPQDLPFALIYLTDLGGGHAELAASSGIDASHPAVKPTLALAGGDKPWPVAETFRLNAPVVVPDLRDRFGVAFPTGGWRQPPTRAVVLPIPASGDTGRSGLLIAGLNPFRLYDSAYQDFLALVSGQISSAITNADAYQEERRRAEALAEIDRAKTAFFSNVSHEFRTPLTLMLSPLEEALGRDGIADEQRTLLGIAHRNGLRLLKLVNTLLDFARIEAGRVTAHFTPVDLSSFTAELASNFRSALDRAVLRFVIEAPPLPQPVYVDRDMWEKIVLNLLSNAFKFTFEGEIVVRVGPDPDGRHAVIEVSDTGTGIPEAEIPHLFERFRRVEGARGRSIEGSGIGLALVQELIKLHSGSIDVESEIGRGSTFRVTLPFGSAHLPADRPRHAALQVSTNVRAQAYLDEAIGWLDEGGDADLPPASGAQDLGIVSAPAAGRPHILLADDNHDMRDYVARLLGDAYEVEAVGDGVAALEAVKKRRPDLVLSDVMMPRLDGLGLLKALRSDPAVADLPVIFLSARAGEEAKLEGLEAGADDYLSKPFSARELLTRVRANLDTAAIRRTALRTEYALRQEAQAARKHAEGILASISDGFIALDEQYRFTYVNAAAERLIASTAEELIGKVYWDVYPMMLGTKIEQAYRRAMTERVACEFESYHPPSKRWFELRVAPTNGKSISVYFRDITEQKKAEAALRDINEQLEEQVAERTAELQQKEARLRTIFAASYTYQALLDVDGVVLDANRTSLAGIGGQLEDVIGKPVWATPWFGSTPGLPEMIRSDIAVVAAGETVRRELHVNLPAGAGSICRCARCKTRRAR

SEQ ID NO: 16081 - protein, 649 aa, Rhodopseudomonas palustris
MHPAARLRDRRGAAAVDLYRHPRHREGVRGQARDHRGRGDGPDPARHPHPSRPQQADLRPDLVLRPFRPHPGRRRRLLLGEDRSCRRHEACGVSEKVSPQPASSPLPARGERSARRSAAKSGRVRGRFSPAEPPGLAATPPHPGPLPASGARETRRTASNCPIQFVVLSSTDTDIRKPIRMTAKFTDYIVKDIGLAEFGRKEISLAETEMPGLMATREEYGPKQPLKGAKIAGSLHMTIQTAVLIETLVALGAEVRWVSCNIYSTQDHAAAAIAAAGIPVFAVKGETLKDYWDYTAKLFDWSDGGTPNMILDDGGDATMFVHQGLRAENGDTMFLDQHNSEEEEIFFALIKRILKEKPKGYFATLAKNIKGVSEETTTGVHRLYDMEKAGKLLFPAINVNDSVTKSKFDNLYGCRESLVDGIRRGTDVMLSGKVAMVAGFGDVGKGSAASLRQAGCRVMVSEVDPICALQAAMEGYQVVTMEDAAPIADIFVTATGNKDIITIEHMRAMKDRAIVCNIGHFDNEIQVATLKNMKWDNIKPQVDEITFPDGKRMILLSEGRLVNLGNAMGHPSFVMSASFTNQTLAQIELFQNQGKYEKKVYVLPKTLDEKVARLHLAKIGVKLTELRKDQADYIGVKVEGPFKADHYRY

SEQ ID NO: 16082 - protein, 293 aa, Rhodopseudomonas palustris
MFCSREPVSTSRQNAPGDRMDSIKTQGLNVPKLGLGTFKLQGKDCHEAVLTALSLGYRHIDTAEMYANEDFVGDALEDTDVPRDQIHLTTKVWWTNLAPDAIRKAFDQSLRKLKTDYVDFYLIHWPAPDMNLGAALETLLRIKDQGGARAIGVCNFPVALMKQAVEEIGAPIACNQVEHHVLLGQTKLLPYLQSKGIPLTAYAPLAQGRLASYPELQAIADKHGATAAQVALAWLLEQEGVMAIPKARGEASQRSNLGALKIKLDFDDRAVIAKLPKNQRFVTPAFSPKWDAE

SEQ ID NO: 16083 - protein, 250 aa, Rhodopseudomonas palustris
MPGMSARGCEGEPQVVTGAHDWLIAAVLLDMDGTLVDTERLYLESLTEVLNAFGLPDAIETCESMVGLPGPECQALLVARYGETLPLREINRAFVEKRDARFAQGLPVKPGTCELLDALDDAGCPVAVVTSSSRKTADMHLTLAGIRARFATILTRDDVVHGKPAPDLYLLAANRLGVPPAHCVAVEDSSVGVASAFTAGAITLMVPDLLQPDDATRGKCAAVLPDLNAVRSLLEIRGRFAAPDAALAPR

SEQ ID NO: 16084 - protein, 873 aa, Rhodopseudomonas palustris
MSGLWQSMTTAWMSRTDRSALLDFWLGGRGAGTLIANTDIDEQEMRRIRAAQINSVTRLTPVTMSINVANAALILFTFWDNDARPQLLAWTAMIVFAAGSAVQSWLRNRFEPRLEASAHAIRRMTLHALLLGLIWGAMPVMVFVKADPGDQLIVACVAAGMISGGAFTLSTVPRAGLAYTWSLAAGSALSLALCDGMAYRITAAFLVLYAVFMSRNLISHGEMFFDNLRAKFELERQTEIISLLLKDFQANASDWLWQTDAHGRLVHVPERFVEVAKLPPSLLIGAPLADVIGMLCPEDGRCAMGVAAKMAQREPMNDLVVHVVIGGTPRLWSLTAKPMFDAAGEFAGYRGVGRDVTERWRAEQAEAENRAKSSFLAMMSHEIRTPMNGVLGLANSLLETKLDPEQQQAVTTIRDSGDDLLRILNDILDLSKLEAGRLEFEQADFSPTTLVESVRAIIEPEVRGKGIELKVDIDPRLPPSLNGDAARIRQVLLNLAANAVKFTEQGSIAIVLTCVKRNDSHATVEWQVTDTGIGISPDRVGSLFTDFAQADVSINRRFGGTGLGLAISRRIVEQMGGDIAVTSREGEGSTFRFSLDLPWSNAWIADHRLDRLGSDDLRTRIAMLGRPLRVLIAEDDSTNQMVVMKMLQEFAAEITVVSDGTDAVQAAGEGEFDVVLMDVRMPNMDGLAATRAIRGKGGALAKLPIIALTANAFPDDVKVCRDAGMNDFLAKPLRKPALVAAVLRALRGASTPVTMPSPPMLVDLDTLAELTAEIGQDQVNEMVALFFAETERRIALFRRFAEHMDRHDLEVEAHSLKGGARTLGFHPIAEIARSIEREAGSISPEALDLFTGQLNKALIELRRQCEGSLKLAS

SEQ ID NO: 16085 - protein, 282 aa, Rhodopseudomonas palustris
MVWTIGKVKITKIVEMELTGGTRFILPQATPQEIQAMPWLIPQFASPEGRLTMSVHSWVVETPSRRILVDACIGNDKQGRGVPHWNGLDKPYLQDLARAGYPADSIDTVICTHLHVDHVGWNTRLVDGQWVPTFPNARYLFGRIEYEYWKTHATDAAHAAVFADSVEPVIDAGVVDLVASDAEIADEITLIPTPGHSPGHVALHIRSDGEEAVLSGDVAHHPCQMVRLDWSSSFDSDALLSIETRRRLFSRFADTPTLLFGGHFGPGRIVSDGDAFRLVAQP

SEQ ID NO: 16086 - protein, 272 aa, Rhodopseudomonas palustris
MERQTMPRLEGKTALVVGAGSIGPGWGNGKATAVTFAREGAQVFCVDRNLAAAEETVDIIKAEGGRGIAFAADVSRAADVEAMVAACVKAWDGIDVLDNNVGIAETGGVVEVTEADWDRVFAINLKSAYLAMKYVVPVMQRQGGGSIINISSIASIRYLGISYVSYAASKAAMNALTRNTAVEYAKDHVRVNAILPGLMKTPMVAHSAGLAASYSGGDVDAMWRARDAQVPMGHMGEAWDVANAATFLASDESKYITGIELVVDGGLTLKVN

SEQ ID NO: 16087 - protein, 651 aa, Rhodopseudomonas palustris
MRGTKPRDGAVEEVDLARLAARQILGGRRFLARHRAGQRQRLGEDIVGDTDAAGARHRDTFLDDVADHLLGAVDRQQRAVRQVGDRRQRVVGAVQDQLRPQRLIDIGCDRGRDLGRSQRGRDHVALRRGADQQFAAAVMPDVTRPGHFSADIYHRGDHRMADRGLQPGGVIDAILQAEDDAVRLQPRLQCAARSFGVGGFDAEQHQIWRSDRARIARGLQRDHLRAGLGLQPQTVRFDRGDVVWPPDQRDVMASQRQQPAEIASDRTGPHHRHLHSVLPSRAPTNAQCFLLKVGVRPMKPGVACVHIDLNPKLDFRDVLIRPKRSVLSSRFEANIKRSLRFRHSSRAWTGFPLIASNMDTIGTLEMAKAFKPFGALVALHKFHHPDRLAEYLAGDEDANVFVTVGTGSADWERLAAVKAKVKVPMLNIDVANGYTEAFVRAVARLRDENPDAIIMAGTVVTAEMTEALVLAGADIVRVGIGSGSVCTTRDLTGVGYPQLSAVIECADAAHGLKGHVCSDGGCVVPGDLAKAYGGGADFVMLGGMLAGHDECGGELRYAEQNGHKTPTSMVFYGMSSETAMNKYHGGVADYRAAEGKTVEVPYRGEVHATVEKIAGGLRSAMTYIGAENLKEIPKRTTFILVNAQRNTVFDR

SEQ ID NO: 16088 - protein, 399 aa, Rhodopseudomonas palustris
MNEQITRAEHAFATGGHAPRSRAPMVSAVPPRSMRRRVLVIQTQAENAGAQEISRLVGAGLTARGYDVHNLFFFRQSRGFDEPVNTTYCAPRRPGNPLAFLRFLVSLGRQIRAARPDAILTFQHYGNAIGGAIARLVSPAPVIANQVSARLTMPGWLQKLDLMMGRLGVFNTITVNSEDMLHDYSRYPDSYRRRLTHVPHGFDQKHSALTRAEARRRFALPVDGVMLGTAARLHPLKQLDATIRVLPAKPSWRLALAGHGPDEVRLRALAEQLGVADRVFFVGEITPEQVADFLASLDVFVFPSLAETFGLAAVEAAHAGVPVVANDLPVLREVLAYQGEPAALLVDASDTAALGAAISAVLDDPALRVRLQRSGEGLKTRYSVDAMVDEYVHILEQAM

SEQ ID NO: 16089 - protein, 369 aa, Rhodopseudomonas palustris
MTDRLTSSAQRSSRNHLVALRCGGVIMDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 16090 - protein, 248 aa, Rhodopseudomonas palustris
MTRHAIVTGASRGIGRAIALGLAQRGYDLALTDIAAQESVLRETVEEVKQLGRKCIPILADVSKIEDCQRSVTEAVAGLGHVDVLVNNAGILRLAMIDETTPEHWDQTFAVNVRGVFQMTQAVVVHMKERRYGRIVNIASLAARTGGPGQSHYAASKSAVVGFTRVSSMEFGGHGITVNAVCPGIIQTEMGRNNLRDPERVTYFEKITDLHRLGEPEDVVGPVAFFASDDSAFVTGQALNVDGGIFYS

SEQ ID NO: 16091 - protein, 421 aa, Rhodopseudomonas palustris
MRHFDYRDGVLHAEGVSLASIAQDVGTPFYCYSSATLERHYRVFTEAFAGLDALVCYAMKANSNQSVLRTLAKLGAGADVVSGGELQRALAAGIPPSKIVFSGVGKTEAELRAALDHDIKCLNVESEPELEQLSRIAVETGRTARISLRVNPDVDSGTHAKISTGKSENKFGIPIRHAREVYARAAKLPGIQVTGVDVHIGSQIIDLAPMEAAFRKVAEFIHVLRGDGHTVNHVDFGGGLGIPYYEDRDAPPEPFAYAEMVKRVTHNLGCTLLFEPGRMIVGNAGILVAKVIYVKHGDGKTFVIIDAAMNDLIRPTLYEAYHEILPVAAPAPGVATMVADVVGPVCETGDYLALDRKLPELKAGDLIAIMTAGAYGAVQACTYNTRALVPEVLVKDDQVAVVRPRIEVEQLIAMDKPAPWL

SEQ ID NO: 16092 - protein, 272 aa, Rhodopseudomonas palustris
MSGSLAVKVLLVFAHPEPRSLNGALRDVAVAELQRLGHEVQVSDLYAMGWKPAIDRADFPNLASDERLLPTEASKAAFGAGELTQDVRDEIDKLLWADVVILQFPLWWFSMPAILKGWVERVFACGFAYGVGEHSDKRWGNRYGEGVLAGKRAMLIVTTGGWEQHYGPRGINGPIDDLLFPIHHGILFYPGCEVLPPYVLYQAGRLDSVGFETAAERLRARMRTLAETPPIPYRRQNGGDYLIPAMELRPELGEPGAEGFAVHLSQEVGSSA

SEQ ID NO: 16093 - protein, 268 aa, Rhodopseudomonas palustris
MFKDLFSLQGRVALVTGGSRGIGKMIAAGFLAYGATRVYITARKAAACQATADELTEMYPGECVALPIDISTMAGIDMLAAEIKRRESSLDILVNNAGAAWAADFDEFPESGWDKVMDLNVKTPFFLTKALAPLLRAAASAEQPGKVINIASIDGIFVNPLETYPYAASKAGLIHLTRRLAVRLIKDHIVVTAIAPGPFASDMNKAARDESDAVAKRVPAGRIGTDEDMAGTAVFLASRAGDYVVGSTVTVDGGVAFANPGIKGDGWA

SEQ ID NO: 16094 - protein, 481 aa, Rhodopseudomonas palustris
MANLTIRKLDDVLKSELRQRAAANGRSMEDEVRVILRDACHKRLGFAEPASAGLSVPAPPAADEPVDGPRAQPQAGTVRVTLIVGGGIAAYKAMDLIRRLKERGADVRVVLTKAAQQFVTPLTASALSHQRCYTDLFDPSSEFDAGHIRLARDCDLIVVAPATADLMAKIAGGHADDLATAILLATNRQILLAPAMNPLMWNNAATRRNVAQLKQDGVAMVGPNAGEMAERGEAGVGRMAEPTEIAVAAEALWRPQPPKPLLGKRVLITAGPTHEPIDPVRYIANRSSGKQGYAIAAAAAAAGAEVALISGPVELRAPAGVDCIRVESAREMLAAVQSALPADVAIFAAAVADWRVAAEGMQKLKKGAGGPPPLQLTENPDILATISKLTEGRPPLVIGFAAETENLIDNATAKLARKGCDWIVANDVSPATGVMGGDRNTVHLLMRHDAATDLESWPLMTKDEVATALVARIAQAMAVHA

SEQ ID NO: 16095 - protein, 295 aa, Rhodopseudomonas palustris
MRARDLYNALYQKWRSTSHRSRQAARISGGRITMRFNGKVAVVTAAASGIGAATAARLAREGAYVYLSDIDQDALGRQAESLVDVAERISTVVADVTVPEQVSALIDGAARERGRLDILINNAGMGAFGRITEVTPEAWHRVFGICVDSIFHASRAAIPHLIKARGTIVNTASISGLFGDYGFAAYNAAKGAVINLTRNMALDYSRDGLRVNAVCPGLIATPLSLKLRDNAAVMAEYDRLIPLGRAGSPEEVAGAIAFLASDDASYITGVAFAVDGGLTARTGQPNFLGHLAPKP

SEQ ID NO: 16096 - protein, 574 aa, Rhodopseudomonas palustris
MSIPSWWARERFRDRCGPAGSFVQSVSRAAVHALEPDGAVSADQTRSAGVWPNGLDHAGPSRRAPDRQGDAMINIATRINPAIAPAVSEVISQLQARHLIGNTLVPSVGGATLDVIDPATGQVIGKAPAASGDDVARAVEAASAAFPGWAATPARQRGKLIAAAASAIAERSDVIATVLALETGKAIRTECRGEVATAIDITTMYAGLASELKGETLPFDPQILTYTSREPLGVVAAILPWNVPLVLMMLKIAPALVAGNTVVVKASEEAPYATIEMARLMARLLPDGVLNVICGTGRDCGAALVEHPAVAKVTFTGSQAVGELIYQMAAKKIIPVSLELGGKSPMIVYPDADMARVVAGAIAGMRFTRQGQSCTAASRIYVHTTLIDAFVAALREAVSKLKIGDPLDEATDIGTVISPRQKAKVESYIDLGARTAGAKVDRCGELPGAAHLKDGLFLQPTIITGVPEDSPLMREEIFGPVVCVQPWDDEDDVIARANDSDFGLAATVWTNDLRSALRTVQRLDAGYVQVNQNLTIQPNLSYGGFRKSGLGKEASLEAMLEHFTKKKTVVIDMR

SEQ ID NO: 16097 - protein, 689 aa, Rhodopseudomonas palustris
MTKLNVALLATTALTLGSLIGHPAAAESASAPMLLAQAVQGGPAPAPSEEKAKEAPPPGPRPAPAPPKAAPSAPPPPPAAAPPHVAPPPPPPAPPRAAPPPPPPAAAPAPAPKRAEPPPPPPPSHSAPPPPPPHAAPPPPPAPKPSAPPTAAPAERPAAPPPAAAPVRPPAPPAGEAPQRRGPPPGAVPPNAVPPNAAAPDAAKPDAAKQPPGERRGPPPGAPGTPPNATAPGMTPPPGEAPRRGPPPPPAAANPPPAAAPTPAPSAAPQAAPTSPANPSGPAVAPVARPSGERGPQPGAPAGGPPPRPQAGPGAPGAGPAVAPPPGQPQPVPPQPGQPPAGPAVAPPAPPPPAVTAPIPPAPPPPQALTPIAPGAQAPGPRNMSDFRGQRREVNENGRIVITEPGRIIVRDPSGQEFIRHNEVDRFRYGARDIRTEQIRGGGTRTIVVRPDGTEIINITGDDGQLMRRIRRDRDGREIIIIDNSYGPRDRANFYVDLPPPVIRIPRDRYIVDYEDASPELIYETLEAPPVERIERRYTMDEIRYSPAVRQRMPSIDLNTINFDLGSWDIPPDQAAKLQAIADGLNRAIQRNPREVFLIEGHTDAVGNDTDNLSLSDRRAEAAAALLTQQFGVPAENLTSQGYGEQYLKIQTQAPERQNRRVTIRRITPLLNGGQAALPPPPPGVAPPR

SEQ ID NO: 16098 - protein, 112 aa, Rhodopseudomonas palustris
MKLVVAIIKPFKLDEVRQALTEIGVHGMTVTEVKGYGRQRGHTEIYRGAEYIVNFLPKLRIEIAVDSALADKAVEVITRGARTGQIGDGKIFVTPIDRALRIRTGETDVDAL

SEQ ID NO: 16099 - protein, 112 aa, Rhodopseudomonas palustris
MKIVMAIIKPFKLEEVRDALTAIGVHGLTVTEVKGYGRQKGHTEIYRGAEYAVSFLPKIKIEVAIANEQVEKTIEAITSAAKTGQIGDGKIFVIGLDHAVRIRTGEADAAAL

SEQ ID NO: 16100 - protein, 640 aa, Rhodopseudomonas palustris
MGRAMAGKLRIRSRLRLLARRHPRITMAGRAVMAFSAGFGGAYGLLLGSNPETSGYDPHAFAVGASFLFALACLALAVQTMRLRRMRGRLRLLTASQEPPPDLQPNQSKTRALIAARESADAANHAKSRLLAMASHEIRTPLNGIIGMSRLLLDTPLSAEQATYAKAVKTSGEALLALTDELLDYARIEAGKIELDCRPFVLSSLIEDIIELLAPRAQARGLEIAADIDERLPVSLIVDAARLRQVLLNLCGNAIKFTETGGVALIVERGDQSGELRIIVRDTGIGIAPDAQARIFHEFEQADAGIARNFGGTGLGLSISDRIVAAMGGRIALESKPGEGSTFTITLPLSTAENDRATAAFAPPDLHGSSVMIVSAHGVEASLAARRLERWGAETCLCDDLAAAIARLPERSWHAVLIDHALGSDAIETLAREAQARATHRLVMLTPAARHELLPDLPAAFTGYLVKPLRSASLAARLGTAVEVATPSIADGDPPPVQDASSAITHEAFAILVAEDNDINALLIRALLHRLGHHAEIVGDGRRAVEAWGAADNTGTPFDLVLMDVQMPILDGLAAARQIRTLEAERARSRVPILALTANTLAEDREACLESGMDGFLVKPIDPDRLAAILAGVAAAHQAA

SEQ ID NO: 16101 - protein, 299 aa, Rhodopseudomonas palustris
MARAATLPILNGESGLARYLAEIRKFPMLEPQQEYMLAKRWREHGDRDAAHQLVTSHLRLVAKIAMGYRGYGLPISEVVSEGNVGLMQAVKRFEPEKGFRLATYAMWWIKASIQEYILRSWSLVKMGTTANQKKLFFNLRKAKSKISALDEGDLHPDQVKLIATRLGVTEQDVVDMNRRLGGDASLNAPIRDDGEPGEWQDWLVDQSPSQEAVMAEHEELDQRRAALNGAIQVLNPRERRIFEARRLADEPMTLEDLASEFGVSRERVRQIEVRAFEKVQSAVKGTIARQEQAALEAAH

SEQ ID NO: 16102 - protein, 219 aa, Rhodopseudomonas palustris
MTPELVIFDCDGVLVDSELISCRVHAETLTRYGYPITPDQVAARFLGRSGREARREIEAEIGRRFADDIEANLLDALLRAFAETLQPIPFVTDALDTLGRPFCVASSGTLDRIGVALTHAGLHARFAPHLFSAQQVAHGKPAPDLFLFAAAQMGAAPECCVVIEDSVPGVLGAKAAGMTVLGFHGGSHCTDATAAALAAAGAGRCFDDMRQLSGIIEEI

SEQ ID NO: 16103 - protein, 355 aa, Rhodopseudomonas palustris
MHRPDPHDCGIFLISPRYGSNSMSSAQYDVLAIGNAIFDVLVRTEEDFLVKHGMAKGGMALIDEARAAAIYADMGQATEMSGGSAANTIVGLASFGARTAYLGKVKDDQIGKLYTHDIRAAGVTFDTKPATAGPATGCSYILVTPDGQRTMNTYLGAAQDLSPADIDEAKIAASAITYLEGYLWDPPQAKEAFLKASQIAHGAGRKVALTLSDAFCVDRYRGEFLELMRSKTVDLIFANEAELHSLYQTSDFDAALTLLAQDVALGVVTRSEKGCAVVDKDGVTLVPAAAIDQLVDTTGAGDLFAAGFLFGLVRNLGYENAGRLGALAAAEVIQHIGARPQVSLKELAQQHGLAV

SEQ ID NO: 16104 - protein, 497 aa, Rhodopseudomonas palustris
MSPTAAARAADQAASLRDRLKDPSLLREQCYIDGAWSGTSTIAVTNPASGQTIAKVPHLGAAEATQAVEAAAQAFPAWAKLTAKQRSNILRKWFELIIANREDLALILTSEQGKPLTEALGEVDIGAAYVEFFAEEARRVYGETIPTQRADARLIAIKQPIGVCGAITPWNFPSSMITRKVSPALAAGCTVVLKPAEETPLSAFALAALAEKAGVPKRVFNVLTGDAPAIGKVLCEHPAVRFVGFTGSTEVGKILYKQASVGVKKLGLELGGNAPFIVFDDADVDAAVEGAMVSKYRNMGQTCVCANRLYVQDGVYDAFVEKLAAKVKAMKVGDGTEQGVTQGPLINEAAVEKTERHIADALSNGAKIITGGKRHALGGTFFEPTVLADVRPDALVAHEETFGPLAPVFRFKDEAEVIKLANNSPFGLASYFYARDLGRVWRVAEALESGMVGVNTGLITTEVAPFGGVKESGLGREGSHHGIEEYVEIKYVMMAGI

SEQ ID NO: 16105 - protein, 276 aa, Rhodopseudomonas palustris
MVAATRRSRFDAKGVKMSDGLNVIVTGSASGLGAATAKILAKDGARLVINYASSKDDAEKTAEECRKLGAAEVIVVQGDVAKDEDCKRIVEAAAPWGKLDALVNNAGTTKHVAHHLLDQLSADDFQRIYAINTVGPYQMVRAARELLVAGAKAAGRASAVVNVSSVAGISGIGSSIAYAASKGALNTMTLSLSRALAPNIRVNAICPGYIDTPWFTKGRGAEEAKQVRDMVVSRVPLKIASTAEDIAELVCFLATPKSSSMTGELVRMDAGMHLAG

SEQ ID NO: 16106 - protein, 355 aa, Rhodopseudomonas palustris
MGGAWRASARHNTAKSRRHHVGQDVTPVPGHSRAPDHSAPATAAVSGTMGRPLSAGAIALMLLCCLSWGFNQIAVKLVLPDIPPFLQAAIRSAGALIVILIIATSRRVKLFQRDGTLRAGLFAGVLFGLEFVLIYHGLTLTTASRAVVFLYTAPFFVALGSYRLLGERLRRMQWAGLALSFAGVALAIGVPQADVDASVLLGDLLLVGGGALWAATTLIVKGTRLQRAPAEKGLAYQVAISVPILTGAALLSGETITKMPSTLSLGLMAYQTIWVVGLTFLLWFGLVKTYSASKLSAFTFITPLFGVAAGYLIMHDPLTPAFGAAAVLVIAGLYLVNRPAPVPAPNDPLLNVTKT

SEQ ID NO: 16107 - protein, 550 aa, Rhodopseudomonas palustris
MQAVAGRFTQNQRGDVEAKFQIFLTLLAVLAGTALLARRVNIAPAILLLIAGITLAFIPGMPAIELPPDLILLLVLPPLIYSASVAMSWREFCANLRAIGLLAIGCVIFTACAVAAASHYLIGLPWSVGFLLGAIVAPPDVVAPLAIARKLGLPRRIVVVLEGEGLANDATALILYRFAVAAIMTGAFSLTKASGTFVAIMAGELAFGVAVGWLSLRARHWVRDPQIEITLSLLTPYIAYWIPEHHGGSGVIATVACGLYISWNGPLLISAATRLQGIFFWDLVIYLIEGMLFLLTGFQLRALLERSKEFAFGDILSATLLVAAIVIAARFIWVYPAFYLPRFLSRRLRASDPYPSWRTVFVIGFTGVRGAVSLAAALALPYALPGGETFPYRDLILFVTFGVILITLVGLGLTLPAVVKLLGVTRVGHREQIAEHDDEITARREALAAAQASLKKITDNRELTDEVLKLLHARHQTRASLLPDPIGSPEHEASAVGIALVRELIAVERKFIHAQLRAGKITDEARRRIERDLDLEEASLANRESGPAPL

SEQ ID NO: 16108 - protein, 305 aa, Rhodopseudomonas palustris
MSWMPTNDPVLGDPTTCDALELIIVPRTRDLGDGFAVRRALPHGKRQMVGPFIFFDHFGPVQFIAGKGMDVRPHPHIGLATVTYLFDGKIMHRDSEGNIQEIAPGAMNLMTAGRGIAHSERTPDVERSVGQSMLGLQSWIALPQAAEEIAPSFQHFAAATLPMVQDTGFTARVIAGSAFGKASPVTMVSPWFYVEVNAKAGTAVPLDPDHEERAIYVVDGEVEIAGERHVGPTLLIFRPGDRITVRAKTDTRMMFLGGDALEGPRHIWWNFVSSSKERIEQAKQDWKTGRFAAVPNESEFIPLPE

SEQ ID NO: 16109 - protein, 800 aa, Rhodopseudomonas palustris
MFDSGHASRANARGPGRRWTMIVFGAFLLALRRAGRQCSQRRLRHMRSTSGGPRVLLRRLRETMAEQVSAQERLDKIVVLIAANMVAEVCSVYVLRIDNTLELYATEGLNREAVHQTVLNAHEGLVGLVASEATPLNLSDAQSHPAFSFRPETGEEIYHSFLGVPILRAGNTLGVLVVQNRAKRTYVEEEVEALQTTAMVLAEMIASGELSALAQPGAEPAARHSIHKTGAVLSDGIALGHVVLHEPRVVITNYIAEDLPKEIKRLDAALAKLRSDLDRMLERGDFAEGGEHRDVLEAYRMFANDHGWSHKLHEAVATGLTAEAAVERVQSDTRARMLRSTDPYLRDRLHDLEDLGHRLMRQLVGQDHAPSREQLPDNAILIARSMGPAALLDYDRKRLRGLVLEEGTANSHVSIVARALGIAAIGEVPNAPGIADPGDAIIVDATSGSIYVRPSAEIEAAYAERVRFRARRQAQYSALRDLPCATKDGQPIDLMINAGLTIDLPHIEDTGSSGIGLFRTELQFMVGQSLPRSSDQLALYRAVLDAAGSKPVTFRTLDIGGDKALPYMETVVEENPALGWRAIRLGLDRPGLLRSQIRALLRAAAGRYLRVMFPMISEVAEFDAAKSIIERELTYLRQHGHTLPERVDVGTMLEVPALLYQLDELFKRADFVSVGSNDLFQFLFAVDRGNSKVSERFDTLSAPILRALRDIVRKARAAKRSLSLCGEMASQPLAALALIAIGYRSLSVSALAHGPVKAMILGLDLAKAEAMIGPLLDAPAGSVSIRDKLIEFAEAHQLAL

SEQ ID NO: 16110 - protein, 370 aa, Rhodopseudomonas palustris
MDIRAAVFREVGAALRVERIVLDPPQPTEVLVRLAAIGLCRTDYHVMRGERRVAMQPMVLGHEAAGIVEAIGDQVQGVAPGDHVVLTFIPGCGHCRWCQRGLHHLCAEGPRITHGPQLDGSFRRRDAGGRDVGAFCMIGAFAEATVVDQASVLVIDKDIPLDHASLIACGVPAGVGAARHRARVKPGDTVLVVGCGGDGMNVVQGAKLCGASMIIAADIVAQKLEWARDFGATHGTTAQGDELISTVLALTDGIGVDHAFVCINPAETLLPAFRATTKAGNVVVTAITPDTVKQIDVPPLELFATQKAIMGAVYGFASPRLQIPELLGLYRRGDLKLGELISRTYRLDEINQGYADLDAGRNLRGVVLID

SEQ ID NO: 16111 - protein, 280 aa, Rhodopseudomonas palustris
MGRLDGKVAVITGATSGIGWRTAEVFVAEGARIVVAGRRMAEGEALAAQLGSSCVFKQTDVTDEAQVKALIDTALDTFGRLDCLFNNAGGPAQTGGIEGLEVDRFDAAMATLVRSVMLGMKHAAPAMKKQGAGSIINNGSIAGRLAGFSSSLVYGAAKAAVNHLTKCVAMELGESGIRVNSISPGAIATGIFGKALGLTTDAAEKTAATMREIYKTAQPIPRAGIPDDIAQAAVFLASDESTFINGHDLVVDGGITGGRNWTAQQQGYVALRKAFDHGEG

SEQ ID NO: 16112 - protein, 459 aa, Rhodopseudomonas palustris
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 16113 - protein, 306 aa, Rhodopseudomonas palustris
MSLTPAVPLASPLFNPRALQIVLFCALWSFAFVAGKVGVSDCPPLILLAARFSLAGILILGISALRREPWTLRPRDVAICALLGLANNALYLGLGYVGLQTVSAGIGGLIVSANPVFTAVAAALLLHEALTWRKIAGLVLGVAGVAFIVWHRVAIGAEAWTGLGFTLASLASIVAGTILFKRLAPRGSLWIGNGIQNLAAGLALTPLAMSLSSVSDIVPSWRLAGAFAFLVLGGSIVAYWLWFRLLTLYGATAASAWHFVMPPLAMLFAWLVLGESIDGRDLLGVIPVAIGIYLVTRPARIAAPAS

SEQ ID NO: 16114 - protein, 380 aa, Rhodopseudomonas palustris
MTERIREFLRDRRAKGLDVEPCLVVDLEVVRDNFMHFAKALPDSRVFYAIKANPAPEVLSLLASLGSCFDCASVQEIQMALAAGATPDRISFGNTIKKERDIARAYELGIRLFSVDCTPEVEKVARAAPGSKVFCRILYDCAGAEWPLSRKFGCDPEMAVDVLDNAKRLGLEAYGISFHVGSQQRKVKAWDRALAMAAQVFRDCAERGISLSMVNMGGGFPTKYLKEVPPVVQYGRSIFRALRKHFGNQIPETIIEPGRGMVGNAGVIETEVVLISKKSDEDDVRWVYLDIGKFGGLAETMDESIRYAIKSRHDGAEMTPCVLAGPTCDSADVLYEKMPYPLPVTLEIGDKLLIEGTGAYTSTYSSVAFNGFPPLATYHI

SEQ ID NO: 16115 - protein, 258 aa, Rhodopseudomonas palustris
MSYKPLSRSVKGLRVLVTGAASGMGRATAHVFAEEGARVAVTDVTLAGAQPVADAIKARGGDATAFALDVGDAQAIRSGVEQIAQSLGGLDIVINNAGISAALPIDDANYEAVWDRALAILLTAHPRVIRAALPYLRKSQSPRIVNIASTEALGATATHSPYSAAKAGVTGLTRSLAVELGPEGITVNCICPGPITTGMTDRISAEHKQKYARRRTALHRYGDPEEVAHMTLSLCLPAASFITGAVIPVDGGLMARNA

SEQ ID NO: 16116 - protein, 244 aa, Rhodopseudomonas palustris
MNDLDFSGQQVLVVGGSSGIGNGIAQAFRTRGAKVCVTGTRPAPSDYAPEDGSNFDGLSYMQLDVGKAQAVDAFAPPIERLDILVLAQGAVIYRRGEFEMDGFRHVMEVNLMSLMACASKFHPQLKASSGKLIIVSSTAAFHATKGNPAYNASKTGAYGLTRTLAQAWAEDGIRVNGIAPGLVDTKMTKVTTDNPKRLAGAIEGIPMKRLGTPEDMAGAALFLASPLSAYVLGQTLVVDGGLIL

SEQ ID NO: 16117 - protein, 474 aa, Rhodopseudomonas palustris
MVRAMTAPGSNIAAGALAPAKSSAWRTELIETLWLAWPMALTQLGQIAMMTTDLALIGRLGDAAVAAAALAHFVLFSTFTMGLGLVSAVTPLAAQAFGARAPRQVRASLRVGLWAGVIAGVPLTLGQLYGEELLVALGQNPATSRLAGDYLDGLAWSLVPGWLFIALRGLMGAVNRPEPALWIMLTAIPINLGLAYVLIHGSFGLPRLEIFGAGLATSIVSWAMCIAAAVVCVTMRPFRKYQVFGELFRFDGELMRRLLQLGLPISGASVLEYGVFGAAALLMGKFGTTALAAHQIALQVAAIMFMVPMGISVAATVRVGHAVGRGDPPSARRAGFAAIGLGFVFMAAMTLLVALTRHQIPQLFLGDSDTSIETATLTAALLIVGASFFIADGLQVVANGALRGRNDTKVPLLFAVLGFWVIGFPFCWVLGFHTDLGPFGVWIGLAVGLVVYAALLVWRFHRLTRDAMAAAVAA

SEQ ID NO: 16118 - protein, 641 aa, Rhodopseudomonas palustris
MTEFSKTPLLDTIRTPEDLRKLRIDQVRQVADELRLETIDAVSVTGGHFGAGLGVVELTTALHYVFDTPRDRLIWDVGHQAYPHKILTGRRDRIRTLRTGGGLSGFTKRTESDHDPFGAGHSSTSISAGLGMAVASELAGKKNNVIAVIGDGSISAGMAYEAMNNAGAMNSRLIVILNDNNMSIAPPVGAMSAYLSRLYSGKTYRSLREAGKQIGKHLPKLIADRAARAEEYSRGFMMGGGTLFEELGFYYVGPVDGHNLDHLLPILQNVRDADTGPFLIHVVTQKGKGYGPAEAAADKYHAVVKFDIATGAQAKAKSNAPSYQNVFGQSLVKEAQKDDKIVGITAAMPSGTGIDIFEKAFPKRTFDVGIAEQHAVTFAAGLATEGYKPFCAIYSTFLQRAYDQIVHDVAIQKLPVRFAIDRAGLVGADGATHAGSFDNAYLGCLPNMVIMAAADEAELVHMVATQVAIDDRPSAVRYPRGEGRGVEMPEVGIPLEIGKGRVIRQGNKVALLSFGTRLAEAEKAADELATLGLSTTVADARFMKPLDVELVLKLARDHEVLLTIEEGSIGGFGSHVMQTLAEHGMLDGEVKMRALVLPDVFMDHDNPVAMYARAGLDAKAIVKKVFDVLGKDAATETSKLA

SEQ ID NO: 16119 - protein, 452 aa, Rhodopseudomonas palustris
MMSQEQNDLITRVGPGTPCGKLMRAYWQPAALVDELEGERPIKPVRLLGEDLVLFKDETGRYGLIDRDCPHRGADLAFGRLENGGLRCAFHGWLFDVDGKCIDTPAEPAGSPLCKNIKQRAFPVVAKGGILWAYLGAGEPPAFPEIDCFIAPDTHVFAFKGLMECNWLQALEVGIDPAHASFLHRFFEDEDTSQAYGKQFRGASAGSDLPMTKVLREYDRPIINVEHTEYGLRLIALREIDDERTHVRVTNQLFPHGFVIPMSTEMTITQWHVPVDDTHCYWYAIFTSYAAPVDKVKMRDQRLELYELPNYKSRRNKTNDYGFDPHEQATATYTGMGLDINVHDQWAVESMGAIQDRTREHLGQSDKAIIQYRRLLRQEIEKAASGGKPLLALDEAAARAIQGPATMDGIGPSRGWETYWMEVDVKRRRGAPWAVPVPSEIAAKVPHLTAAE

SEQ ID NO: 16120 - protein, 1008 aa, Rhodopseudomonas palustris
MAKAASKKKTAPKSKSSKTARGKGAAASSARKAVAKSPPKPAKKAVSKPAAKPAAKPAAKSKAVTKPATKTVTKAAAKPATKAATKPATKPAAKAVAKSAAKPAKKPAANAVAAPKAGKWVYTFGDGKAEGRANMRDLLGGKGANLAEMANLGLPVPPGFTIPTSVCTYFYANGKTYPKELQSQVERALDHVGKLTNKKFGDAKNPLLVSVRSGARASMPGMMDTVLNLGLNDQTVEALAEKSGDRRFAYDSYRRFITMYSDVVLGFEHHHFEEILDAYKDAKGFTLDTDLDADDWVDLVGQYKEAVARETGEDFPQDPHAQLWGAIGAVFSSWMNARAVTYRRLHDIPESWGTAVNVQAMVFGNMGETSATGVAFTRNPSTGESRLYGEFLINAQGEDVVAGIRTPQDITEHARIESGSDKLSMEMAMPEAFKELTRIYTLLEKHYRDMQDMEFTIEQGKLWMLQTRGGKRTAKAALRIAVELANEGLINRKDAVTRIEPGSLDQLLHPTIDPNAKRDVIATGLPASPGAASGEIVFSSDEAAKLHADGRKVVLVRIETSPEDIHGMHASEGILTTRGGMTSHAAVVARGMGKPCVSGCGAIRVDYGRGTMMIGNRTFKAGDIITIDGGTGQVLAGKMPMIEPELSGDFNTLMGWADEVRKLKVRVNADTPADARTAIKFGAEGIGLCRTEHMFFEETRIRTVREMILAEDEQSRRSALAKLLPMQRADFVELFEIMKGLPVTVRLLDPPLHEFLPHTQAEIEEVARAMNADPRRLADRARELAEFNPMLGFRGCRLAIAYPEIAEMQARAIFEAAVEAEKRTGEQVGLEVMVPLIATRAEFELVKARIDATAQAVNRDTGSNLKYQVGTMIELPRACLMAGDIAESAEFFSFGTNDLTQTTFGISRDDAASFLGTYIEKGIFTVDPFVSVDRDGVGELVRIGVERGRKTRAKLKVGICGEHGGDPALVAFCHEVGLDYVSCSPYRVPIARLAAAQAALGKGIASQA

SEQ ID NO: 16121 - protein, 292 aa, Rhodopseudomonas palustris
MCILQPPRLGARRSAEQSHPLDDTEMTGTAMTASSPHVALVTGAARGIGLAAAKRFLADGWSVALLDRDDDGLRAAMQALALPERTIALHCDVADRGSVARDIAAVTERFGRLDALVNNAGIAVFKPLMETTPDEWQRVMDVNLTGPFLMTQAAVPLMRDSGGGAIVNITSISSLRASTLRVAYGSSKAGLAHFTKQCAVELAALGIRVNGVAPGPVDTAMAKQVHTADIRSDYRDAIPMARYGLEEELAEAIFFLCSDRASYITGQILAVDGGFDAAGIGLPSLRGERKNS

SEQ ID NO: 16122 - protein, 148 aa, Rhodopseudomonas palustris
MTASTFMELALAEAAAAAEAGEVPIGCVIVRDGVVIAKAGNRTLTDRDPTAHAELLAIREAAAKLGSERLVDCDLYVTLEPCTMCAGAISFARIRRLYFGAFDPKGGAVESGVRFYGQPTCHHAPEVYSAVGEREAATMLREFFKARR

SEQ ID NO: 16123 - protein, 258 aa, Rhodopseudomonas palustris
MSPDSQKPRPPESNAPRRTMILTGASRGIGHATVIRFSSAGWRVITCSRHPFPEQCPWGAGPEDHIQVDLGDRADTLRAIDEIRERLDGGVLHALVNNAAISPKAAGGARLGTIDTEIDTWEHVFRVNFFAPILMARGLIEELKAVKGSVVNVTSIAGSRVHPFAGAAYATSKAALAALTREMAADFGHVGVRVNSIAPGEIDTSILSPGTEKIVEEQIPMRRLGTPDEVAKIIYVLCTETSSYVNGAEIHINGGQHV

SEQ ID NO: 16124 - protein, 523 aa, Rhodopseudomonas palustris
MAQVVRSSARFNIWEEAMNLITTMHPDASTVFKARYGNFIGGRWVAPVDGRYFDNTTPITGAKLTEIPRSQKEDVELALDAAHTASVTWSKTTTTERSLILNRIADRMEANLDLLAIAETLDNGKPIRETRAADLPLAIDHFRYFAGALRAQEGSISEIDHDTIAYHFHEPLGVVGQIIPWNFPLLMAAWKLAPALAAGNCVVLKPAEQTPASILVWAELVGDLLPPGVVNVVNGFGVEAGKPLASSPRIAKIAFTGETSTGRLIMQYASENLVPVSLELGGKSPNIFFGDVTAEDDPFFDKAIEGFVMFALNQGEVCTCPSRALVQESIYDRFMERALARVAAIRQGDPRDPATMIGAQASQEQLDKILSYIDIGRHEGAELLAGGGRAQLPGGLAGGYYVHPTVFRGHNQMRIFQEEIFGPVVSVTTFKDEAEAIAIANDTQYGLGAGVWTRDGTRAYRFGRAIAAGRVWTNCYHAYPAHAAFGGYKQSGIGRETHKMMLDHYQHTKNLLVSYGTGPLGFF

SEQ ID NO: 16125 - protein, 467 aa, Rhodopseudomonas palustris
MLQVTGIPDACDNLAPIPMECDAPFLSIKGELPRELNGTLYRNGANPQFVSPNAHWFFGDGMLHAFHLENGRASYRNRWVRTPKWLAEHEAGRPLYGEFNLKLPDAPRSVPDDGNVANTNIVFHAGRLLALEEAHLPMQIERDTLETRCYCDYGGALKGPFTAHPKIDPVTGEMLFFGYNASGPLTRTMSFGAIDASGNVTRLEHFKAPFAAMVHDFIVTEHHVLFPILPLTGSIWRAMRGRPPYAWDPRKGSYVGVMKRSGSTRDVRWFRGEACFVFHVMNAWEDGTRIVADVMQSEEAPLFTHPDGRRTDPEKGRARLCRWSFDLAGNTNAFKRSYLDEISGEFPRIDERRAGLRSGHGWYACASPETPMLGMLTGLVHVDGNGHRRTRYLLPTGDTIGEPVFVPRAADANEAEGWLLAVVWRGCENRSDLAVFNATDIAAGPIALVQLGHRIPDGFHGNWVPAG

SEQ ID NO: 16126 - protein, 1356 aa, Rhodopseudomonas palustris
MPLYCSNTGSTALREAEVQQPITAAHLSLTRSFLAFSAKVGQSEAPSSWMYLILRPSTPPAALICSIANFSACTEPVSEIAMVPVTECRMPTVTSVSVTASPVVLTAEVAGACANDVRGSIVRAGIAAIPISSLRRSGEFRPVLFSSDINYPFVVRGTRVQSGKRSTNSAAGPIRKITYVASQDRDVGFSGVGISGPGAVTTSARPTNCAGRDGKTGNVAGGSALVSSRDEEKRVAGRQRIDRVRRQYNQWVANQTLEDYALRFTAKSSRRWSAARVANTALGAISFLALEAIGGTITLNYGVTNATAAILVVSVIIFCCGLPIAYHAAKCGVDIDLLTRGAGFGYIGSTVTSLIYASFTFLFFAIEAVILANALELCFGLPLPIGYFFSAVVIIPVVTYGITLISRFQLWTQPFWVLLHILPFAAIAVKSPESFVAWTRFAGEQGSQDGKLDLLLFGTAASVVFALVAQIGEQVDFLRFLPRDRRASRGAWWIAMISAGPGWIVPGSLKLLAGSFLAYFALSRGAPPDQAAEPAHMYLEAFRTVLEQPGLVLALTGAFVILSQIKINVTNAYAGSIAWSNFFSRLTHSHPGRVVWLVFNVLVALLLMEIGVYKALEHTLALYSNVAIAWVGALVSDLVVNRPLGLRPKHMEFKRAHLYDINPVGVGSMTIATVVSISAFYGVFGPTAKALAPFVALVVAFVTAPIIAFVTGGRFYIARKPKRAWQTAESIKCCICEHSFEPEDMAYCPAYAGPICSLCCSLDARCNDLCKPHARIDAQFTDALGKMLPQRAYALLNSQVGHYLTVFAVSVGLIGLSLFLIYLQVATANEAQQIELAEILWKLFFALTIIVGVVSWLFVLARLSRQAAEAETRRQTQLLMQEIDAHRQTDAELQRAKEAAESANLAKSRYVVGLSHELRSPLNAISGYAQLLEQDNTLPPRPRDQIRLMRRSADHLSGLIDGLLDISKIEAGRLYLSRDEVRFGEFLDQLVGMFRLQAAAKDIEFVFKRPQYLPPMVYADEKRLRQVLINLLSNAIKFTQEGSVHFIVHYRNPVAELEVRDTGPGIHTDDLERIFAPFERGALGAAQPHSGTGLGLTISKLLAGVMGGDLTVTSTPDKGSTFRVKLLLSEVTNPTRTRSIRAPVLGYHGPRKTILVTDDDPAQRGLLQDALAPLGFIVLVATDGYSCIDLAEHCQPDLFLLDISMPGMDGWTVAETLRTQGHHHARILMLSASALEAHGTLLSQPFHDAYLMKPVDIPRLLELIGQLLNIDWIYKGEATATAANATEIQHPPMQHVEELIELGKIGYIRGIESKLDQIHTDYPETWAFVSQMRTMVEQFDLDTYMKTLNTLYRHEQ

SEQ ID NO: 16127 - protein, 698 aa, Rhodopseudomonas palustris
MASKAKTVQVQDKDKDDKVDAPEKDSVDAPSPLLDLSDAAVKKMIKQAKKRGFVTFDQLNEVLPSDTTSPEQIEDIMSMLSDMGINVSEAEDTEAEEEEAKEEADEELDNDLVEVTAKAVTETKKSEPGERTDDPVRMYLREMGTVELLSREGEIAIAKRIEAGREAMIAGLCESPLTFQAIIIWRDELNEGKIFLRDIIDLEATYAGPEGKNNIGEPGEEAAAEGEGGAPAHVAPPAAPPSATPFRPAQQRGAAPAEAEGEGAPEGDGDDDEFENQMSLAAIEAELKPKVVETFDKIADNYKKLRKLQEQDIANQLQNEQLSPSQERKYKKLKDEIIVEVKSLRLNQARIDSLVEQLYDINKKLVSFESRLMRLADSHGVARDDFLRNYQGSELDPRWLNRVSKLSAKGWKNFVHHEKDRIKDLRQEVQSMAALTGLEIGEFRKIVHSVQKGEREARQAKKEMVEANLRLVISIAKKYTNRGLQFLDLIQEGNIGLMKAVDKFEYRRGYKFSTYATWWIRQAITRSIADQARTIRIPVHMIETINKIVRTSRQMLNEIGREPTPEELAEKLGMPLEKVRKVLKIAKEPLSLETPVGDEEDSHLGDFIEDKNAVLPIDAAIQSNLRETTTRVLASLTPREERVLRMRFGIGMNTDHTLEEVGQQFSVTRERIRQIEAKALRKLKHPSRSRKLRSFLDN

SEQ ID NO: 16128 - protein, 315 aa, Rhodopseudomonas palustris
MSQSAEPRVVTEPAWDLGEIVAELAGLRAISQRRRYRSRSLPELPSREAVAGIVDALVAALYPRHFGPAGLSEDSLDIYVADTIEQALRRLRREVGRELRLADLDGAAKPGEIEQQALTIAADFAHDLPRIRALLDSDIRAAFDGDPAAKSLDEVVFCYPGVAAMIRHRIAHRLYVLGVPMLARIVAEIAHAQTGIDIHPGATIGESFFIDHGTGVVIGETARIGKRVRLYQAVTLGAKRFETDEHGRIVKGGDRHPIIEDEVVIYAGATVLGRVTIGQGSSIGGGVWLTRDVPPNSVITQAKARHDAFEDGGGI

SEQ ID NO: 16129 - protein, 903 aa, Rhodopseudomonas palustris
MNDFKDAKRKFEGAPVPAPRRPVRRGGRALIRLFGVAVIVSLSVMAGRIASQHTRAWEPPGVGHGLDVPWWIFVISLAVGLSIAGLIELQLSRYERRNAHKLRQAHLAAIVEGSSYAIVGQSIDGTVLSWNKTAERLFGYTAEQAIGQNATELMVPDDLRDEEQQMLSGISDGTAFAYLWTKRKRANGTLVDVAVSISPIRADDGRLIGMAASMRDITDLVQAEREVHDLNAALERQVAERTCQLEKTLTLQTAILERAAYAVIATDVTGTITLFNPAAERMLGYKAEDLIGRASAMLFHDSDELAARAEAMRKEGISVSSNLGVLQARLARNDPDTAMWTYIDAMGNRIPTRLTLSRLRTKTGVNLGVLGIAVDLTEQLKYEDELKAARASAEQASAAKADFLANMSHEIRTPLNGIIGYADLVLEDETLAPDTRRQVMRIFEASDSLRVIIDDILDFSKIEACGLTLESKPLYINELIANCASIIEPKADEKGLKLIATAQATPPVLIGDAGRLRQVLLNLMNNAVKFTTAGSVELIVSCIGRVDHLVRLRISVADTGIGISPEAQKGLFKRFSQADETISRKFGGTGLGLAISQRIVQAMHGELKIDSQPGVGSTFYFEVELPVAERLDIERLDAQVHCSRSVKILVVDDVEMNRDLCKTMLTRAGHDVDLADSGATAIAMVASRTYDLVFMDVQMGEMDGLEATRRIRALGHAYRDVPIIALTANVLPEQVERYKAAGVDGHLGKPINRAELLACVARWIDGDIAHVPSEPLAPVELGSEPEHPVRDQAALEDLRMFASEHDIAGFAEQLRDTITRIRAQWPHHIDAMKLDHEARTALGAAAHKTVSLAGQLGFKQLAAACRRMEAACAPHRDIHDAFAALHAALDNAEPVLDAPHELT

SEQ ID NO: 16130 - protein, 863 aa, Rhodopseudomonas palustris
MLPPTRPNLKRSLVALRVTTIVLIATIVGTNLIFLGNLRESTLQTAETNLERYTLTLAEEADRSLKSMDLLLSSVRDYVSRAGVTDSESYRRLMSQQSVYSLLSEKITGMPQVDAVTMIDETGKLINFSRYWPIPDVNISDRDYFRALSSDSTLSTFVSAPTRNRGSGTWNIYLAQRLNDTRGGFIGLLLGAISVQYFENFFAATSPGAGTEIALLRSDGTLLVNYPHSDKLGTVVTDAGRLALAAGSRQREAGNSNKQIRVTRMLPNYPIVVRVTQPEDSALQNWQDMAVLMIAMSVISALVIITGSVAIARWWGKQHLYAEAAEAASAAKSSFVAMMSHEIRTPMNAVIGLATNLLETRLDAEQRQAVTSIHDAGDNLLQILDDILDFSKLEAGRLSLEPIPFAPRNIVDNTLSVIGPRAIAKGLVIRLEARGDIPEALTGDAGRIRQVLLNLISNAVKFTTAGEIVITTECISRDTTNARMRWIVTDTGIGIAADKIDSLFKDFVQADSSISRRFGGSGLGLAISKRLIEQMGGKIGVSSAPGRGSEFHFSLTLPIADHAAPPEQDDQDVYAQFRARIEAAGRPLRILVVDDNPTNRAIATQMLGEFRVQTNTACDGTEAVTAATRFGYDVVLMDVRMPEMDGLDATRAIRSHGGALANVPIIAFTANAFAEDAAACRAAGMNDHVAKPVRKKALIEAILRALPPLPAAESPRIVPVPAPLAPPPADNSDQTEVPSDVAGAGQIYVGRKAFGHLVEEIGEDATLAVLSVFARDTEARIALFDTLDIANERRRIEREAHSLKSAAATFGLDTLSGLARELEHAAPHLTQAEYVAMTRQIKAAFSAARRVPADDNQLVELAG

SEQ ID NO: 16131 - protein, 253 aa, Rhodopseudomonas palustris
MDPLFDVSNEVILVTGASQGLGRQFARVLAARGAAIVLAARQIDKLQSLEQEIEGGGGRAVAVRMDVTDLGGMAAALDQAEAALGPITVLINNAGVATEKLAIDTSEADWDKVIGANLKGAYFLATEVARRMIARQQGGNIVNIASVLGQSVLKFVSPYAISKAGIIQATKAMALELASSRIRVNALAPGYIDTDINRDLWSTPAGEKLLKSIPQRRVGHESDLDGAILLLASNASRYMTGSVVTVDGGFLLG

SEQ ID NO: 16132 - protein, 302 aa, Rhodopseudomonas palustris
MEGLHDVRPYLIFATRLSMVLHRSPRAPGPHGVARNKQKWKRWMSIFDLSGRVAVVTGGNGGIGLGMAQALAAAGCNVSIWGRNAVKNHAALATMANAPGKVEAQICDVTDPASVKAAMDATLKAFGRVDGCFANAGIGGGGRQAFIDRTEEQWRSMFATNLDGVFHAFQAAARHMTERAADGDPFGRLVATSSLASIFGTARNEHYAATKAAINALVRALAVELARYGVTANAILPGWIKSDMTAGIMGNDKFVANVMPRIPVRRFGEPEDFGGIAVYLMSKASSYHTADTFVIDGGYTAF

SEQ ID NO: 16133 - protein, 246 aa, Rhodopseudomonas palustris
MVELTGKRALVTGASRGIGAAIAKDLAAKGADVAITYERSADRAAEVVRAIAAKGRRGVAIQADSADPAALKSAVNEAAAKLGGLDILVNNAGIGRVGPITELSLADIDALLNINVRAVVLASQAAIPHLGQGGRIISIGSTLAERVPFAGSTVYAMTKSALHAFTRGLSRELGPQGVTVNLVQPGSIDTDMNPASGEQADQLRALTALGRYGKPEEIAAVVAFLASPAAGLITGTMITADAGFSA

SEQ ID NO: 16134 - protein, 610 aa, Rhodopseudomonas palustris
MAVSRIIGECLDALLHPSARYDALTTARHRAFLAPRLLGSLAAFAAFPLYLVLRGAPTALEAAAFSWLIAPILVAWFLSRTGRYEQAHLLSSLALTSLVVGVAALTGGIQSFAAVWLVVIPIEAALSASRRAVTFAASLALGGAALLIGLGLFGVLPTPTAGAASSATLAAFGITSAALYASGLAYGAVWLARTNGALLNVEEERYRLLARNMSDVISRHNRNGAVRFISPAAENLLGTPVARLAEHGLFDRVHVADRPAYLKAMSDAARGRETGSVEFRIRRDVARDERGRPSAAEFVWVEMRCRPLESNLTTTAASNAGETEVVAVMRDITERKIHEQALDQARAEADRADAAKSRFLATMSHELRTPLNAIIGFSDMILQDDVLMLGPERRKEYAQLINDSGQHLLSVVNGILDMSKMESGSFEIVPEPFAPRPALLNCCNLLALKARDSGIDLVTRAPENLPEVVGDPRAFKQILLNLVSNAIKFTERGGTVTVSAAVEGTRLVLRVTDTGVGIAEEDLKRLGDPFFQAGKTYQRRHEGTGLGLSIVKSLVRMHGGEIEVQSQIDCGTTVTVSLPLALPAGSNVTTLNPAMPADSPAPDYQVKKSA

SEQ ID NO: 16135 - protein, 779 aa, Rhodopseudomonas palustris
MLTDTWWGPRMARVQAADACAQSDSIKGLAQSIAKPAYHRLLNAEPVLRRAVPLLIIAFLVTIFFGAAVQIIEQSKQKRGAMNRDLSALADLIAERLEHIGVVRLDRPASIERLQNLLPGLIPTWGIAPGRHVIVTSADQRILARVPIGTEPSVDNRFLEILGAASLTKSGQQSSISEITLPGGASALATMHVVKSLPGQVVIIQEDTGSLLRSDTALQVTLSATTGFVVLILGFAFHWQSTRAREGDLINDAVRSRIDTALNRGRCGLWDWDLSRGRIFWSQSMFTILGLESRNDLLTFGEVNALVKGEDIDLFAIADELMAGRVDHIDHSFQMRHAHGHWIWLRMRCELTQEAGATEKHLIGIAVDITEQKSLAERSVEADLRLRDAIETIPEAFVLWDAENRLVLCNSHFQRLHKLPDSAVTPGTSYETILEVGRMPQLRTRLCDNGAVMPGARTFEAQLDDGSWLHISERRTKDGGYVAVGTDITRIKAHEQKLVDNDLRLRATVADLKITQSKLEKQALELADLARKYADEKRRAEEANQTKSKFLANMSHELRTPLNAIIGFSEIMGSGMFGTLGSEKYQEYCHDIMTSGHYLLEVINDILDMSKIEAGRMRLEMEPLDLAKTIGESVKVVAGRAEHKHLELRSELNDQIPIVADRRAIKQILINLLSNAVKFTPDAGRVTVRGHLAGGSIVLMIADTGIGIPPQSLRRLGQPFEQVESQLTKSYHGSGLGLAIAKSLVNLHGGSMRLRSTLGAGTVVMVSLPRTCQQRPLAA

SEQ ID NO: 16136 - protein, 369 aa, Rhodopseudomonas palustris
MKTRAAVAFEAKKPLEIVELDLEGPKAGEVLVEIKATGICHTDAYTLDGFDSEGIFPSILGHEGAGIVREIGPGVTSVKPGDHVIPLYTPECRQCKSCLSQKTNLCTAIRATQGKGLMPDGTSRFSYKGQTIYHYMGCSTFSNFTVLPEIAVAKIRDDAPFDKSCYIGCGVTTGVGAVVNTAKVTPGSNVVVFGLGGIGLNVIQGAKMVGADKIVGVDINDDKEEWGRRFGMTHFVNPKKIDGDIVQHLVGLTDGGADYTFDCTGNTNVMRQALEACHRGWGVSVVIGVAEAGKEISTRPFQLVTGRVWKGSAFGGARGRTDVPKIVDWYMNGKIEIDPMITHVLKLEEINKGFDLMHQGKSIRSVVVY

SEQ ID NO: 16137 - protein, 531 aa, Rhodopseudomonas palustris
MSESAEKPEVFQLPAEPPVAAPARNRRAAAQRVREARDRLTSTSGTRPAFDHELVRQYAETRLSASYVVMLLVVVTGVLFGIWMDPLAAGAWTVAMLSIHAVVIRNCNRFLKEPASVPRTRTWRRRFVLLDLLYGLAWTAILIHPTELNVVSSTLLMFLMLLVVAVSSMLAASLPIAALAATMPVTAAIAVNFALSGSFDKYVLAALTVAAEGYFALLAHRLHSTTLATLQARAEKDVLIAELEQSKAISDEARHRAEAANVAKSRFLAQMSHELRTPLNAILGFSEVMKSEIFGAHAVPAYKDYSADIHNSGVHLLNLINEILDLSRIEAGRYELNEEAISLVHVVTDCHHLLKLRATSRGITIHEVFEQGMPRIWGDERAVRQVVLNLLSNAIKFTPQGGEIWLKAGWTASGGQYLSVKDTGSGIPEEEIPIVLASFGQGSNSIKSAEQGAGLGLPIAKSLIDMHGGTFTLKSKLRIGTEVIVTFPPERVMSALAPLADEAPPLQPDSVDTSENARARRQPIMNAGTGL

SEQ ID NO: 16138 - protein, 385 aa, Rhodopseudomonas palustris
MACDRWAPRSGRRLPVSVTQQQILDSLAKVATPRGVPLTQAGVLSEIAITDGKVYFSINVDAAEARAWESVRSDAEAAVRGTPGVKSALVALTAERQPGSAPAQRPGVAPVSAHRPAGAPGAGLPKQAGIPGVGAIIAVASGKGGVGKSTTALNLALGLRDLGLKVGLLDADIYGPSVPRLTGINEKPQLDDSRRMIPIARFGLSIMSIGFLVDEEAPMIWRGPMVMSAITQMLRDVDWGKLDVLVVDMPPGTGDAQLTLAQTVPLKGAVIVSTPQDLALIDARRGLAMFTKVNVPVIGIIENMSYFLCPECGTRSDVFGHGGARHEAERLGVPFLGEIPLHMEIRATSDAGRPVVESEPNGPHATIYRAIAGKVRDRINSLATN

SEQ ID NO: 16139 - protein, 339 aa, Rhodopseudomonas palustris
MCRCFVPGCGIVARDTAPRARRVTGCGRISYDPGNTARLVPDEGTETTMKPADTALAVLVAVIWGLGFVFTRYALTEMSPSLLNLLRFAITALPCLLLPRPKLAWPVWIGISLLLVWQYLTQTYGIAHGVPAGLTAVIVQSQALFTVGFAALLLGERPTGAQLAGIAVAACGLLMICLTVGYDFTVLAFAVTMTAPISFAFTNLLLRRARDVPMLDLFAWISLASLPPLALAAWVSDGVPAIIQSLTHLSPGVMGAMLALSIGSTTIGYWIWGRLLHAYSAAQVVPFALLVPFIGAGASSLVFGETFGPLRLAGMLIVVAGLAIMLLFGRARPPLPEVG

SEQ ID NO: 16140 - protein, 282 aa, Rhodopseudomonas palustris
MVTGDMRRFGRMGPKLAPIGQGTWYIDQGDRASALAALRRGLDLGLTHIDTAEMYGDAEPLVAEAIAGRRDEVFLVSKVLPSNASRRGTIAACERSLARLRTDRLDCYLLHWRGHYQLSETVAAFEELVAAGKILSWGVSNFDAGDLRELHRIAGDGKIACNQVLYHLLERAIEHTVIPWCEAHGVAVTAYSPFGHDEFPAPRSAAGQLLQSIAGAHGAKPRQVALAFLTRRPSVFAIPKAGNPSHAADNAAALALRLSEEEIDAIDQACPLGPEPASLPML

SEQ ID NO: 16141 - protein, 529 aa, Rhodopseudomonas palustris
MPCSARAGDFICRSRIWRWSIFRTVRTEARASRDGADPDHTHHQPPAIKQEVPMVNRMQFYIDGAWVDPVVKKSTPVVNPATEEAMYEVALGSKADVDKAVAAAKRAFETFSVTSREERIALLEKVVAIYKSRMKEIGAAISDEMGAPLPMAEKMQAGAGLGHIMSTLDVLKNYQFEEPLGSAMIVREPIGVVGMITPWNWPLNQIACKVAPAIAAGCTMVLKPSEFTPTSALLFAEILHEAGVPKGVFNLVNGLGPEVGAAMSEHPDIDMISFTGSTRAGIDVAQRAAPTVKRVSQELGGKSPNVILEDADLTKAVTGGVMHMFNNSGQSCNAPSRMIVPLSKMKEVAAIAKGVAEKTKAGDPRGEGTTIGPVVNRIQWDKIQTLINKGIEEGATLVAGGPGLPEGVNKGFYVRPTVFADVTKDMTIAREEIFGPVLVIMGAKDENEAVELANDTPYGLAGYVSAGSVDRARAVGRKIRAGNVNLQGVPNERTAPFGGYKQSGNGREWGKFGLEEYLEVKAIAGFNAA

SEQ ID NO: 16142 - protein, 498 aa, Rhodopseudomonas palustris
MASVSASPQFIEALTFDDVLLKPGLSDVLPSEVDIRSRITRAIPLNIPIIASAMDTVTEARMAIAMAQAGGLGVIHRNFDPEGQAAQVRQVKKFESGMVVNPLTISPDAKLADALALMNQYGFSGIPVVTGAQGHGPGKLVGILTNRDVRFATDPAQKVSELMTHENLVTVREGVSQGEAKKLLHQHRIEKLLVVDDQYRCVGLITVKDMEKAVAHPLASKDAQGRLRVAAATTVGEGGYERTERLIEAGVDVVVVDTAHGHSARVLDAVTRIKRISNQVQVIAGNIATRDGAQALIDSGADAVKVGIGPGSICTTRIVAGVGVPQLTAIMDAVQACKKADVPVIADGGIKYSGDLAKALAAGADIAMVGSLLAGTDETPGEVFLWQGRSYKAYRGMGSVGAMARGSADRYFQQDIKDTLKLVPEGIEGQVPYKGPVGNVVHQLAGGLRAAMGYVGAKDLGEFHTKAEFVRITGAGLRESHVHDVTITRESPNYPGGV

SEQ ID NO: 16143 - protein, 513 aa, Rhodopseudomonas palustris
MRSSTRGWRSWSAASPLSTGRVRAETGMIEMLMPSDPGLLAERCLIGGKWCGEPVDAVFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLGGLDR

SEQ ID NO: 16144 - protein, 412 aa, Rhodopseudomonas palustris
MRQPRPPTTDNSVGKTNSERPQQRNNSSRPTLINSTTDAIFDEASTACRPVRIIRSSRHSWSQSMTASPSQLPVLDLSRFRSDTAERAEFLRDVRDAAFGPGFFYLVGHGISDRLIRDVLFASRNFFALPEADKLDIEMINSPHFRGYTRAGREFTRGQPDWREQLDVGAEREAFPLSRSAPPWTRLQGPNQWPDALPELKPLLLRYQQEVTELAIKVLRVFAAALGQAEDVFEPIYVPSPNQLIKIIRYPGRAADESDQGVGTHKDSGFVTILLQDTVAGLQVETADGWIDAPPLPGSFVVNIGEILELASNGALRANVHRVVSPPPDTDRLSVAFFLGARLDATVPVLTLPPELADYARGVTQDPQNPLFRDVGRNYLKGRLRSHPDVAERHHADLLDEYAIKPGLAAAY

SEQ ID NO: 16145 - protein, 334 aa, Rhodopseudomonas palustris
MSTTISVPPQLLLERILTLEIVRVTERAAVSAARLRGHGNEKGADQAAVDAMRRELNKMPIEGTIVIGEGERDEAPMLFIGEKVGAGINAGPKVDIAVDPLEGTTLCAKNMPGSIATMAMAEGGTLLHAPDVYMQKIAIGPGYEKNLIDIDAPPEDNILRLAQAKGVPTSGVTVLVLDRPRHAELIAKIRATGAGVQLITDGDVAGVIHCADPDNTGVDIYMGTGGAPEGVLAAAALRCIGGQMQCRLLLDTHSKRNRAESMGIEDPNFVYQIEDMVKGDCLFAATGVTDGSLLSGVKFRKGVIQTETVVMRSVTGTVRYIKADHRQLEKFHLD

SEQ ID NO: 16146 - protein, 391 aa, Rhodopseudomonas palustris
MAQRAVRTGDPMTPATQDQPLRIVHAVRAPVGGIIRHILDLANGQADRGHHVALITDSLTGGDRAVAALDEIAPKMKLGVYRLPIRREPSITDLFVWGRFVRLIATLRPDVLHGHGAKAGIFMRVVPRPTGSIRVYTPHGGSLHYPTTTFKGQLYSRLERLSMNRTELFLFESEFARSTYERMIGKPEGLVRCVFNGVTAGEFDPVSLAAEATDVCYVGEFRHIKGADLLVDAIARLRAEGRSVTLTLGGDGEETAALKAQVARLDLGGAVRFIGHVKARHGFAQGRLLVVPSRGDSMPYVVIEAAAAGVPMVAANVGGIPEIFGPDHRDALFAPSDPAAMAKAIAAALDDLNAARDRARQLRERIFLHFSQKAMVEGVLAGYREALAQQR

SEQ ID NO: 16147 - protein, 469 aa, Rhodopseudomonas palustris
MPIQVLMPALSPTMEKGNLSKWLKKEGDKVKSGDVIAEIETDKATMEVEAADEGTLGKILIPEGTNDVAVNTPIATILGDGESAADADKASDPAAQSKASQSAPPSAEPEAAQAKSAPAPAQHAPEAPTVSAAADPDIPAGTEMVTVTIREALRDAMAEEMRRDPDVFVMGEEVAEYQGAYKVTQGLLQEFGDRRVIDTPITEHGFAGVGVGAGFAGLKPIVEFMTFNFAMQAIDQIINSAAKTLYMSGGQLGCSIVFRGPNGAASRVAAQHSQDYSAWYAQIPGLKVVAPYSAADAKGLLKAAIRDPNPVIFLEHEMLYGQHGEVPKLDDYVIPIGKARIVREGKDVTLISWSHGMTYALKAADELAKDGIAAEVIDLRTLRPLDTDTIIASVKKTGRAVTIEEGWQQNGVGAELSARIMEHAFDYLDAPVTRVSGKDVPMPYAANLEKLALPSVAEVVEAAKAVCYR

SEQ ID NO: 16148 - protein, 427 aa, Rhodopseudomonas palustris
MTAIVDIIGREILDSRGNPTVEVDVVLEDGSVGRAAVPSGASTGAHEAVELRDGDKARYLGKGVQKAVEAVNGELFDALGGMDAEQQVQIDQTMIELDGTPNKGRIGANAILGVSLAAAKAAAASYDMPLYRYVGGTSARTLPVPMMNIVNGGVHADNPIDFQEFMIMPVGAPTFADALRCGSEIFHTLKGELKKAGHNTNVGDEGGFAPNLPSADAALDFVMAAIGKAGYKAGGDVMLALDCAATEFFKDGSYVYGGENKTRSRSEQAKYLADLVARYPIVSIEDGMSEDDMDGWKELTDLIGSKCQLVGDDLFVTNVTRLADGIKNGRANSILIKVNQIGTLTETLAAVEMAHKAGYTAVMSHRSGETEDSTIADLAVATNCGQIKTGSLARADRTAKYNQLLRIEQELGAHAHYAGKAALKALR

SEQ ID NO: 16149 - protein, 407 aa, Rhodopseudomonas palustris
MSPVPLKNAEPAHGGVRTVSVLGATGSIGDSTMDLIRAEPERYQVEALTGNANVAGLAKLAKEFSARFVAVADPARLGELRAALAGTDVACGAGESAVIEAAARPADWVMAAISGAAGLKPALAAVDRGTTVALANKECLVCAGDFFMSRATAAGAQILPADSEHNALFQALASGNRHELTRVIITASGGPFRTWAAADIEQATLAQALKHPNWSMGQKITIDSASMMNKGLEVIEASYLFALSPDEIDVLVHPQSIVHGLVEFADRSVVAQLGAPDMRIPIAHCLGFPDRITGRAAKLDLAKIGQLTFEAPDFTRFPGLRLAYDALRTGNGATTVYNAANEVAVAAFIAQKIRFGAIARLVEDTLNSWVRAGNQAPLGSADDAIALDQQARNLAATLLPQIAAKAS

SEQ ID NO: 16150 - protein, 112 aa, Rhodopseudomonas palustris
MKKIEAIIKPFKLDEVKEALQEVGLQGITVTEAKGFGRQKGHAELYRGAEYIVDFLPKVKIEIVIADDLVEKAIDAIRRAAQTGRIGDGKIFVSNIEEAIRIRTGESGLDAI

SEQ ID NO: 16151 - protein, 775 aa, Rhodopseudomonas palustris
MSSRSDPGQPMASATDPSGRLALDLTECDREPIHIPGAIQPHGYLFVVSETDLRIASVSANVEDLLRQPPASLLNVPIAHYLTAASAARLTHALHGGDPAAINPIRLDVVTPDGERAFNGILHRHDSIVILELEPRDESRYTNEFFRSVRVAIRRLQTAADLPTACWIAASEVRRITGFDRIKVYQFAADWSGQVIAEDRDSGIPSLLDFHFPSSDIPAQSRALYTINPVRIIPDIGYRPSPLVPDINPRLGGPIDLSFSVLRSVSPTHLEYMVNMGMHAAMSISIVRDNRLWGMISCHNLTPRFVSYEVRQACELIAQVLTWQIGVLEEAEIVRHSVRMRAIQNRLLHELGDEQGLTAGLSRVSEEMLALMGASGFALCSFDGVAAFGRTPSDDEIQALASWLSHRESRGIFQTQQLSASFPEAEVYSDIASGLLAVPLGRASTTLMLWFRPEVAQTVTWGGDPHKPVQIGPRGRRLQTRASFEAWREEVRDRSRPWRSHEIVAAEEIRDLVVDVILGRAEELENANRELSRSNDELESFAYVAAHDLKEPLRHIEAFAGLLNDLLLPEARSRLSLMVNGIEASSRRLRALINDLAEYSRIGRQARPLQPVDLNQILTEVLSDLKPMLQDARAEVVSEPLPTVLCDGSQIRQLLQNLISNAVKYRDAERLPHVTIAATIDSPPPAAPAGANVRRARITIADNGIGFDEQYREQIFEPFQRLHGPDEYQGTGIGLAICRKIVHRHGGTISATSRVGEGSVFTFTLPLCDQDAAES

SEQ ID NO: 16152 - protein, 271 aa, Rhodopseudomonas palustris
MAPTTSCRRKTRWRPDARLKPAQGGEMFDLTGRTALVTGATGGIGGAIAQALHGQGATVAISGTRREALDALAAKLGERVHVLPCNLSDAADVEALVPAAAEAMGGLDILVCNAGITRDNLFVQLRDEDWDEVIKVNLTATFRLTRAATKLMMRKKFGRIIAITSVVGVTGNPGQGNYTASKAGLIGMIKTIGAEYAKRNVTANCIAPGFIATPMTDVLNDKQREAILGKVPAGRLGTPDDIAAAAVYLSSNEAAYVTGQTIHVNGGMAMI

SEQ ID NO: 16153 - protein, 277 aa, Rhodopseudomonas palustris
MQTADAHFVEAHGAKIPALGLGTWELSGHSCSRIVEQALRLGYRHIDTAQIYDNEREVGEGIRNSHIRRDQLFVTTKVWTTHFAPNDLVRSAKESLVKLRLSEVDLLLLHWPNAHVPLAETLGALAQARALGLTRHIGVSNFTVALLAEAVAVCPAPLVCNQVEYHPFLDQQKVLAACALYGMALVAYSPIARGNAKKSEVLTRIGNVHGKTAAQVCLRWLIQQNVAAIPRSSRLERLAQNIDVFDFELSDAEMQEIFTLGSPKGRLTTMPTAPVWD

SEQ ID NO: 16154 - protein, 291 aa, Rhodopseudomonas palustris
MNRNAEHLAGRAAPAVFVVLWSTGFIGTKYALAGAEPLTYLSIRMIAVVSLIAVIAAIARPRWPNLAGVGHSIVAGLLVHGVYLAGTSIAIAHSVPAGLSALIPGLQPILTSTLANRWLGERVTPLQWLGLGLGLGGTLLILHSRSLTGDVGWGWLASACSLIGITIGTLYQKRFCSGIDWRAGNIIQFLAALALFAVGAVLFETRVVNWTTEFVLAVGWLVVVLSIGSIGLLYWLIRHSAATSVASLFYLVPGTTALMAYVLFGEKLDVVSIVGMVICAAAVFLVNRAKV

SEQ ID NO: 16155 - protein, 255 aa, Rhodopseudomonas palustris
MNLFDLSGKVAVITGSSRGIGKAIAERMAEHGAKVVISSRKQDACDAVAKSINDTYGAGTALALAANISSKDDLKRLAQEATQTFGKIDALVCNAASNPYYGPQAGINDDQFRKILDNNIVANHWLISEVVPQMIARKDGSITIVSSIGGLKGSTVIGAYCISKAADMQLARNLACEYGEHNIRVNCIAPGLIKTDFARALWENPETLKASTARSPLQRIGEPDEIAGAAIFLASKAGTFTTGQTIVIDGGATIS

SEQ ID NO: 16156 - protein, 275 aa, Rhodopseudomonas palustris
MVMHQINPQSANVTALDPIWERVRNEAEDIVRREPELASFIFASVLHHDRLEDAVVHRVAERLDHAALSGDLIRQTYEDALRDQPDIGNAFRADMVAVFDRDPATSRFIDPLLYYKGFHAIQTHRLAHWLFGKGRKDFALYLQSRASAVFQTDINPAAKIGRGIFLDHATGLVVGETAVIDDDVSILHGVTLGGTGKEHEDRHPKIRRGVMIGAGAKILGNIEVGHCARIAAGSVVLKSVPHNMTVAGVPAKVVGEAGCAEPSRTMDQMINAIGL

SEQ ID NO: 16157 - protein, 773 aa, Rhodospirillum rubrum
MIKWSSFRLEKMEADVGRQDHSPQSLAVLRSHPMVRAILDALTLPAAVIMARDGRVLEGNAAFFEALGRPADAVLDHPAPFDVSIADAAATAGGPASPPPSRRRCAFLRADGVLVQATLGVGVLEGVAGLVLVTLDGIAGADGCPLRRRAEATVPCAADRFRSLFDLAPIGMAMLDGERRWRQANSVMCRLLGVPFEGLAAKRWSDSVHPEDRGRDERFFASLLRNDDKASTTNLRLVAADGRVVPVTLSLGVMRDGPKGQSDQILVLVQDISERVDWEATKAENEARLRSLINATTDAIFLLDPDGAIRVINRAGARLLGTTARAAAGRSFYEFLDAPQATERRALFGEVLATLLPVNGIERWGERWLDMVVFPVVDGDGKAMGVTLFTRDITSRREAEDRARAAERHLLEATELMSAAMLLFDPQGILVLINSACRAALPDLEDILHPGLSFIELRAAIVARRLFVQAITESQGGIKGGTPGPAPIEVRGKDGRWLLIRQSATSSGYTLILGTDITELKRRERALADAKEVAEYANRAKSEFLANMSHELRTPLNAIIGFSDITRHQMFGRLDNPVYVDYARNIYDSGTHLLEIISDILDLAKIEAGELGLDEEEVDAARLVDSAIQMVTPRATSKRIALTNLLTGDLPRLWCDPLRLKQVLINLLSNAVKYTQEDGAVAVTARLAGGDGLAISVIDTGIGMDEAGIQVAMTAFGQVESPYSRRQGGTGLGLPLTRKLTEAHQGCLTIASRPGEGTTVTILLPAHRLRAAS

SEQ ID NO: 16158 - protein, 269 aa, Rhodospirillum rubrum
MTFAAGLACEGLKPFVALYSSFLQRGYDQVVHDVVLQKLPVRFAIDRAGFVGADGATHGGVFDMAFLGCLPNLVVMCAADEAELARMVVTAAGHDSGPIALRYPRGEGVGVEIPEDPQPLAIGKGRIVREGKGVALLSIGTRLQSCLEACEILAARGLTPTVADARFLKPFDEELVADLAARHEVLIVVEEGAIGGFCAHVATWLANQGLLDGGLKLRALHIPDRFFEHDAPEVQCAKAGIDAQAITTAVLDALKLETSATIDAGALKA

SEQ ID NO: 16159 - protein, 354 aa, Rhodospirillum rubrum
  unsure (1)..(354): unsure at all Xaa locations
MFPPVKGRFSYEENSAVTSRPITPLLDTIRGPSDTRGLSVAQLEQLAREVRAEMIDAVSVTGGHLGSGLGVVELTVALHHVFDTPDDRIIWDVGHQCYPHKILTGRRDRIRTLRQGGGLSGFTLREESPYDPFGAGHSSTSISAGLGMAIGSALAGDARDVVAVIGDGSMSAGMAYEAMNNAGAAKSRLIVILNDNDMSIAPPVGAMSAYLSRLLSSKSWLSIRTLAKEIVARLPDALERTAKRAEEYARGMVTGGGTLFEELGFYYVGPIDGHRMDHLVPVLRNVREAGRDGPVLIHVVTQKXXXXXXXXXXXXXXXXXRHRRTARRDLRRRSGLRGAEALRRPLFQLFAARL

SEQ ID NO: 16160 - protein, 349 aa, Rhodospirillum rubrum
  unsure (1)..(349): unsure at all Xaa locations
MNDKRILLIVAGGIAAYKSLDLIRRLRDQGARVRCVLTRGGSQFVTQLSLAALSGEPVYQDLFSLTDETEMGHIRLSREADIVVVAPATADLLAKMAGGHADDLASTTLLATDKPVLVAPTMNLFMWAHPATRANMALLESRGIHRVGPGSGDMAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLESAENLLGGMDKGGFRLHPETVKALRGNRGPLSGVITVAPWLIAIVLGVLLFLKES

SEQ ID NO: 16161 - protein, 238 aa, Rhodospirillum rubrum
  unsure (1)..(238): unsure at all Xaa locations
MGDHRQNRRVRRPCAVAARPQTEPHSVNDKRILLIVAGGIAAYKSLDLIRRLRDQGARVRCVLTRGGSQFVTQLSLAALSGEPVYQDLFSLTDETEMGHIRLSREADIVVVAPATADLLAKMAGGHADDLASTTLLATDKPVLVAPTMNLFMWAHPATRANMALLESRGIHRVGPGSGDMACGEQGEGRMAEVPEILAAIKRVLGLSPAAPGPLSGXXXXXXXXXXXXXXXXXSPIGR

SEQ ID NO: 16162 - protein, 533 aa, Rhodospirillum rubrum
MVVSDLLARTLPIPVPRPLYQIALGGVIGLFADLRVVLEPDIFFLLFLPPLLFLDGWHIAREEVFKDRFVILELAFGLVFLTVLGAGLFIHWMIPAMPLAVAFALAAVVSPTDPIAVSAIAKHAPIPKRMMNILEGESLLNDASGLVCLRFAVAAALTGGFSLTDAALEFLWVALAGIAVGISLTWAVTRSKNMLARRIGESSATQTLISLLIPFGSYLVAEHLDCSGILAAVAAGVTMSIEESSGQAQAATRIRRNTVWDTIQFAANGVIFVILGEQLPAILESAAETVRVTGHHEPWWLGIYVVAICLGLAALRFLWVWASLQVSLLRTGQKRPPRHWRLITAMSLSGVRGAITLAGVLTLPLTMTDGTAFPARDLAIFLAMGVIIVTMVVATVFLPLLLNGLEMSQDSTADDQEAAARIAAAEVAIAEIERVQHSMAEGAKDADLFVTVGASLMDVYRERVRSRSQEGEAAVLVRRVDWIEREMRLAALRAERSEIFRRVRKYQLGSERARKLIRELDLLETRYSAEPKG

SEQ ID NO: 16163 - protein, 1041 aa, Rhodospirillum rubrum
MNMDRSNDLAGTLPAPPSVPGPAEDGQSMPIFRWIWRSYLRSALIPLVFIELVFLAIYLLSHQISTSRTLESFGSAVENEFYGAAEREAALLSERLAALGTTASVFAHQAARVLSTPCQPAPRERARLALGANGVLYSTGAPEGSAALFYSGIIPVGPAQIDKAVCSAALDPLMRDISAVEPLVDQIYVNTWDSMNRIYPPIDVLSQYAPHMDIPSFNFFYEADQEHNPERKVVWTDVYLDPAGRGWIASAIAPAYRGTILEGVVGLDVTVGTFIDRVLAAELPFDAYGLLLDRNGGILGAPKVAGEDWGAKPLTEATYGGAITKDTFVDPAFNLFARAEPADLLAALQSQSNGVRPVTLAGKQKVVAWAKVASTGWTYLMVADRDTVFGDILRLDRLFTVIGYLMAGGLLVFYLGFLAFLYIRVREMSVRLSGPLSALNAMIRRIASGSYFQTAPAFDVRELDETGREVAAMGDRLGRANEELIANREELVRARDAAQAAARAKAEFLATMSHEIRTPMNAVIGMTGLLLDGPLEPRQIDYARTIQRSGEHLLGLINDILDFSRIDTGRLVLVDRDFSLSHEVQAVVSLCGVAASAKRLSVRIDLDRALAPGYRGDSQRLRQILVNLVGNAVKFTDKGMVTVQGDVLKIENDIHWLRLRVVDTGCGIPRERFNDLFAAFQQLDGSATRTHGGTGLGLAISRKLARLMGGDITVSSTPGEGSVFSVVVPMVPLSRTPAPDGTLGDGDAERGEEPPAADVPTEAAASRALVVLVAEDILENQILVQAVLEKQGHRVILAANGREALAKLRGADPVDVVLMDIQMPVMDGLDACRAIRGLPPEVHFSDGRPIAGVPIIAFTADALPGDRERFLSAGMNEHLAKPLNARRLRALLGDIAAGRPLTPRSSAAPSPRKSLEAPRRLLDPEALAQLRTSLGEDYPIYLRAAEEALRHRARALPEALARGAFEEASQLLHGLRGTLAAFGMEAEATLCQRLRGDLAGGAGIAIRVEARKLADQALAAADEVRGHRGLPSIDPRAPTPL

SEQ ID NO: 16164 - protein, 607 aa, Rhodospirillum rubrum
MKSDAPSDRPSVDRPPTLPPRALRLSGLGVGPGICVGTVHLHEIGSVPVPEYKIPAARVEDECARLAEAAEQGSRQLGMLRGRARELPGGAGEELGYLLDAYQNMLKGSRLLRGVESRIINEKINAEAAIRNEMDAMADVFSAMQDSYLASRIEDVKDVGWRLIRVLTKAAYRPFTLLPRNAVIVAGELSPADTALLDPKQVAGMALSSGGADSHTAIMARSLGLPAVLAIADLMRHVRSGDIICLDGRTGEVVIDPDRETLADFRKRRADFLRGRRNLGRLRDLPAETRDGARVRLMANVELPAEVESARQSGAEGIGLLRSEFMFMNRTVLPDEEEQYHFLRGMVAGMAGRPVTVRTLDVGGDKLSDALGLRDCANPALGLRAIRLSLSRPELLEIQLAAILRAGVHGPVRILLPMISTVEELDAVREIHAKVVARLRQRGVPLPEPLPPLGVMIEVPGAALSADALAWRCDFFAIGTNDLTQYTLAIDRSDESVAHLYNPLHPAVLRLIQFTVEAAERAGIPVSVCGEMAGDPRLAAVLVGLGVTELSMSAANIPRVKQNIRRLSMIDVARQIQAIMAINDAPRIAALADALLIESDRVSEKLA

SEQ ID NO: 16165 - protein, 467 aa, Rhodospirillum rubrum
MSFTDYVVTDISLADWGRKEIDIAESEMPGLMATRAEYAKAQPLKGARVAGSLHMTIQTAVLIETLVALGADVRWASCNIYSTQDHAAAAIAAAGIPVFARKGEGLEDYWDYTHKIFEWADGGTPNMILDDGGDATLLIHLGARAEKDASLLDNPTSEEEEVLYAAIKARLAAKPGWYSTVLAAIKGVTEETTTGVHRLYEMEKAGTLPFPAINVNDSVTKSKFDNKYGCRESLVDGIRRATDVMMAGKVAVVAGYGDVGKGSSESLRSSGCRVLVTEVDPICALQAAMEGFEVVTMEDAAPRGDIFVTTTGNIDVITLDHMRAMKDRAIVCNIGHFDNEIQVAALKNLTWNNVKPQVDEITFPDGHRIILLAQGRLVNLGCATGHPSFVMSASFTNQTLAQIELFANNADGKYANRVYVLPKHLDEKVARLHLEKLGVRLSTLSPKQAAYIGVTPQGPFKGEAYRY

SEQ ID NO: 16166 - protein, 384 aa, Rhodospirillum rubrum
MFPLPLSPKRSFMIVSRAAIAWEAGKPLSVEEVEVAPPRQGEVLVRIIATGVCHTDAYTLSGSDPEGVFPAILGHEGGGIVEEIGPGVTSVAVGDHVIPLYTPECGTCKFCRSGKTNLCQAIRATQGQGLMPDGTSRFSIKGREIRHYMGTSTFSEYTVLPEIALAKVNKAAPLEKICLLGCGVTTGMGAVLNTAKVEPGATVAIFGLGGIGLSAIIGCVMAGAGRIIGVDINPDKFEIARQLGATDVINSRDYDRPIQEVLIDMTDGGVDYSFECIGNVGVMRSALECCHKGWGQSVIIGVAGAGQEISTRPFQLVTGRVWRGSAFGGVKGRSELPALVERYLAGDFELDTFITHTMGLADINHAFELMHEGKSIRSVIHYDL

SEQ ID NO: 16167 - protein, 284 aa, Rhodospirillum rubrum
MVDPAVSLVWRFGLASLIMVAWALARGQSLRFSLRDHAWLALQGISLFCANYLLIYTATGLLRSGLVAVACSTIVAMNIVLGAAFFGQPIRPRVAAGAGLGLVGITLVFSPEFSHLSLGDEALRGFVFCLIGTAFASLGNLLAGRNQRTGIGVLAGSGLGMGYGALAMALFAALSGKAFLIDLSLPYLGSLLYLAVFGSVIAFGCYLTLLGRIGADRASYCAVVYPVVALGLSTAFEGYRWSAAGAAGLALVLAGNLLILRRPGAAAPGAGSLTTSLSPRGGGR

SEQ ID NO: 16168 - protein, 661 aa, Rhodospirillum rubrum
MFPPVKGRFSYEENSAVTSRPITPLLDTIRGPSDTRGLSVAQLEQLAREVRAEMIDAVSVTGGHLGSGLGVVELTVALHHVFDTPDDRIIWDVGHQCYPHKILTGRRDRIRTLRQGGGLSGFTLREESPYDPFGAGHSSTSISAGLGMAIGSALAGDARDVVAVIGDGSMSAGMAYEAMNNAGAAKSRLIVILNDNDMSIAPPVGAMSAYLSRLLSSKSWLSIRTLAKEIVARLPDALERTAKRAEEYARGMVTGGGTLFEEMGFYYVGPIDGHRMDHLVPVLRNVREAGRDGPVLIHVVTQKGKGYAPAENAPDKYHGVSRFNVVTGVQEKAKPQAPSYTAVFGKQLVAAAAKDHRIVGVTAAMPGGTGLDKLATAYPQRCFDVGIAEQHAVTFAAGLACEGLKPFVALYSSFLQRGYDQVVHDVVLQKLPVRFAIDRAGFVGADGATHGGVFDMAFLGCLPNLVVMCAADEAELARMVVTAAGHDSGPIALRYPRGEGVGVEIPEDPQPLAIGKGRIVREGKGVALLSIGTRLQSCLEACEILAARGLTPTVADARFLKPFDEELVADLAARHEVLIVVEEGAIGGFCSHVATWLANQGLLDGGLKLRALHIPDRFFEHDAPEVQCAKAGIDAQAITTAVLDALKLETSATIDAGALKA

SEQ ID NO: 16169 - protein, 228 aa, Rhodospirillum rubrum
MALALARAGAWVAVHGRGGADLERAVAAIRAAGGAAEAVAFDLGEPEAGAAALEELTESWGGIDILVNNAGARDRRPLDDLDLAAVRQLLEIDLLAPFALSRRAAQAMPAGGRIINITSIAGQVARAGDAAYTTAKGGLDALTRALAAELGPRGITVNAIAPGYFATSANAAMVADAENERHLERRTALGRWGQPAEIAGAVVFLASPAASYVTGQVLAVDGGYLAHF

SEQ ID NO: 16170 - protein, 700 aa, Rhodospirillum rubrum
MENRMATKATNTAEAVNTQEEGGDSPLLDSMNAAVKKLVNRGKDRGYITYDELNNALPPDDVSSEQIEDTMAMLSDMGINVVEDEEEGEASAAPPAEAGEEEPGREVAATGNVSEDDIGRTDDPVRMYLREMGSVELLSREGEIAIAKRIEAGREMMIGGICESPLTIRALLQWHDALVDGRMLLRDIIDLDATYGSGAGPDVVAEGLEDSVVPLSPLALSPARALPKEADEAEEAVTPGRDDDSEDEDEGDDAKPADGAGDEEAAPSGEDEGDGSENNVSLAAMEQELMPRVLETFEHIATTYGKLKKAQDQRIAALQKGEEPGAALERKYDKLKLELVGLMEDVHLNNARIEQLVEQLNALNKGLITQEGKLLRLAERAKIRRDEFLDHYFGREMDPSWREDVAALPGKGWRDFTTRFADEIKDIRGSIAEIAERSLLPIPEFRRIVSTVQKGEREASRAKKEMIEANLRLVISIAKKYTNRGLQFLDLIQEGNIGLMKAVDKFEYRRGYKFSTYATWWIRQAITRSIADQARTIRIPVHMIETINKLVRTSRQMLHEIGREPTPEELAEKLQMPLEKVRKVLKIAKEPISLETPIGDEEDSHLGDFIEDKNAVQPLDAAINSNLRETCTRVLASLTPREERVLRMRFGIGMNTDHTLEEVGQQFSVTRERIRQIEAKALRKLKHPSRSRKLRSFLDN

SEQ ID NO: 16171 - protein, 896 aa, Rhodospirillum rubrum
MIMSKWVYSFGNGKAEGRADMKNLLGGKGANLAEMSNLGIAVPAGFTITTEVCTAFYDNDHAYPAGLTDQVVTALARVEEIMGARFGDANNPLLVSVRSGARASMPGMMDTVLNLGLNDQTVQGLIKQSGDARFAYDSYRRFIQMFSDVVLGVEHYHFEEILENHKEDKGLSLDTELGADDWKLLVERFKAKVQQELGKPFPENPEEQLWAAVGAVFGSWMNQRAITYRRLNDIPQEWGTAVTVQSMVFGNMGDDCATGVCFSRDPSTGENTFYGEYLVNAQGEDVVAGIRTPQQISIAGKEKNASALPAMEEVMPGLYKELVATRDVLEAHYRDMQDMEFTIQGGKLWMLQTRTGKRTAGAALRIAVEMAREGIITSDEAILRIDPEALDQLLHPTLDPKAAKIVLTKGLPASPGAASGKVVFSAEVAEDWVQRGEKVILVRIETSPEDIGGMHVSQGILTTRGGMTSHAAVVARGMGTPCVAGAGEIRVDYKAGLFTVGGKTVREGDIITLDGAAGTVMLGAVPTIQPELTGDFGVLMDWADAKRTMKVRANAETPVDAEAAKRFGCEGIGLCRTEHMFFDPRRIINIRRMILASDEAGRRAALAELLPYQRGDFVELFRIMAGLPVTIRLLDPPLHEFLPHTDGEIAEVAAIAGVDESLVRHRASVLSESNPMLGHRGCRLGVTYPEIYEMQARAIFEAALEIAQEVGEAPVPEIMIPLVATKRELDLMKAVVDAAAKAVFAEKGGEVTYSVGTMIELPRAALQAGSIAQTAQFFSFGTNDLTQTTLGLSRDDSASFLETYRVKGIYERDPFASLDVEGVGELVKIAAERGRATRPGLKLGICGEHGGDPQSIAFCQSVGLDYVSCSPYRVPIARLAAAQAALRSVVKQPAMV

SEQ ID NO: 16172 - protein, 508 aa, Rhodospirillum rubrum
MGVLDPNRRKGLTMPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 16173 - protein, 368 aa, Rhodospirillum rubrum
MPRPWSAGGAPRVRPTDGRSDLGRSGCGRRPNLAIVRMRGARPAGRSCRLPWFPRSPGFSMTAAPSPSASLSLRVAPAVFVLLWSTGFIGARLVLPHAEPLTVLCLRFAATVALLGPLCLVLKARWPTSPHQLLHVAVAGILVHALYLGGVFAAISLGMPAGLTALVVGIQPLLTAALAGPVLGEKTTARQGLGLVLGLAGVAAVLGDKLAPQAGTLFDGFGAAAMICALAALCGITFGTLYQKRFCQGVDLTSGSLIQFIVSGVVLLPFAYTFETMRVDWTAEFIFGLAWLVVGLSVGAVTLLLAMIRHGAAGRVASLFYLVPPTTALMAWGLFDERLGPLALAGMAVTVAGVALVVAPRRQTLAQR

SEQ ID NO: 16174 - protein, 407 aa, Rhodospirillum rubrum
MRGWVLPDHAPGMPCGLGPGCYTAADWPSAVTGAGRMVERRIPTLRQPQRPPRQSRQRSIDQSRPRSPKRESDVTSMHEPRFDVAGIGNAIVDVLSHADDAFLATNDLPKGGMTLIDETRAEVLYASMGPGIEASGGSAANTMAGLASLGARTAFIGKVRDDALGAIFRHDITSIGVTFPTAPLTEGPSTARCLILVTPDAERTMNTYLGACTQLAPDDIDAEVIADSAITYIEGYLWDQPAAKTAILQAAAQARKAGRKVALSLSDSFCVDRHRDTFLELVDNHVDILLANEHEVMALFGSADLDQATAALRGRCALAVVTRSAKGCRIVSAESVTDVPAETVDHLVDTTGAGDQFAAGFLFGLCRGYEPKLCARIGAIAAAEVVSHFGARPEAASLADLVKAKLG

SEQ ID NO: 16175 - protein, 487 aa, Rhodospirillum rubrum
MEFPEALTFDDVLLVPAASSVLPAQADTRTRLTRTITLGIPLISSAMDTVTESQMAILMAQSGGIGVIHKNMTIAAQAEEVRKVKRFESGMVVNPVTINPDASLSTALDLMAHHKISGIPVTENGSGKLVGILTNRDVRFAENTAKPVSDFMTRDNLITVGEGVSQGEARRLLHTNRIEKLIVVDESYRCIGLITVKDMEKAQTYPNACKDEKGRLRVAAATGVGADGLARAEALLDAGVDVVVVDTAHGHSRGVLDAVTAVKKISNYTQVIAGNVATPDGAKALIDAGADAVKIGIGPGSICTTRIVAGVGVPQFSAITEVAEAVRHTGVPIIADGGIKYSGDLAKAIAGGAETVMVGSLLAGTSEAPGEVFLYQGRSYKAYRGMGSLGAMARGSADRYFQEEVTNSLKLVPEGIEGQVPYKGAAGTVIHQLIGGLKAAMGYTGNQTIPEMQKNARFRRITASGWRESHVHDVTITKEAPNYRGGM

SEQ ID NO: 16176 - protein, 245 aa, Rhodospirillum rubrum
MEAMTKGRVALVTGGTRGIGAAISLALRDAGYRVAANYYGNDAAAERFTEENKIPAFKFDVAEYAAVQEGVKQITAELGPIEVLVNNAGITRDGTMHRMTPEQWEEVIHTNLSSCFNLARGVIDSMRDRGFGRIVNIGSINGQAGQYGQVNYAAAKSGIHGFTKALAQEAAAKGITVNAIAPGYVDTDMVRAVPYHVLEKIIAKIPMGRLGRAEDIARGVLFLVADDADYITGATLSINGGQHMY

SEQ ID NO: 16177 - protein, 274 aa, Rhodospirillum rubrum
MHRVSANGIAIPALGFGTWQIEGDDARVAVAEALALGYRHIDTARAYGNEAQVGAGIAQSGVPRGDIFLTTKIWTSEFKPEALTAALADSLAKLGTDYVDLTLLHWPNPEVPLADSLGALAALQQEGLTLAIGVSNFPVALVEEAVAVCGRPLAVNQVEYHPFLDQSKVIEACRRHGMAVEAYSPLARGKVMEDATLRRIAEIYGRTPGQVALRWLIQQDGVIALPKAVRPEHAKANLGALDFALSQSEMAEISALARPDGRLINPSWAPAWDD

SEQ ID NO: 16178 - protein, 525 aa, Rhodospirillum rubrum
MWWPLTLRAAFPRCSRPWARSIRNSSMTQAAPPIDWTARARALRLPNHALIDGAPASAGDGATFDCVSPIDGRVLTRVAACGAADVDRAVAAGRAAFEDRRWCGLSPAARKKILLAFAERIEAHRDELALLETLDMGKPIADSLAVDVPATARCLRWYAEALDKVYGEVAPTGDDVLATITREPLGVVGVVVPWNFPMIMAAWKIAPALAAGNSVVLKPAEQSPLTAIRLGELALEAGLPAGVLNVVPGLGPVTGRAIGLHPDIDGAFFTGSTAVGKLFLSYSSQSNMKRLGLECGGKSAHIVLASCKNTTAAAQAAASAIFFNQGEMCTAGSRLIVERAIADEVIEKVVAEAAFWRPGPPLDPATRMGALVDAEQTERVLGYIALGQDEGARLATGGSRAMAESGGCYVEPTIFTGVAPTMRIAREEIFGPVLSVITVESADEAVRVANDSDYGLAAAVWSDDVTTLHRVAKRLRAGMVYANCYDADDITVPFGGFKQSGIGRDKSLHAIDKYTELKTTWLRLG

SEQ ID NO: 16179 - protein, 620 aa, Rhodospirillum rubrum
MMMVGAGSFQTPGGVPPLPPPPREGATGRSLSAKARAPTVLGLLAAVVLVMLTLGLGANLVFLYRDGVERGEAQVLALRDGAREQAAAAVSRIDLLLSGLTEGLALRPEVERWGDAGIHALLVRQRALLPMVRGIIVTNEAGRLTHDSEAAIPANMDLSDRDYVRALRADPQSGLYIGEPVRGRTSGRWFISMSRRFTDQQGAFKGVVTAVVDPVALGTVFSPFLPGAGGELEVLRDDGRVLLHLPDFERFMGAARGHQSFFRDVLAAAPSGSIRVAGSTEESVYRLEGGEAGLFFTWATVPGSPLLVTVSASYDGLLRSWWQVLPYHLGAIACIILVILALVLKVHRQIRHLNGLIVALSNREAALVAARRSSEEANRAKTLFLANMSHELRTPLNAIIGFSDMLANGIHGALADRQQDYARDINLSALHLLDLINDILDVAKIESGGYLLHERPCNLAAIIRAAERMLGPRVREKGLVMDTVCVDGEAWVMADERAMQQVLLNLLSNAVKFTPEGGRITVSLGLNEGGGMVLVVGDTGPGIPAEHLALVLEPFYQVGEVETRSHEGTGLGLPLAKALVEKHEGALRLDSQPGQGTRVSVTLPAARVLPPQRPPVEAKP

SEQ ID NO: 16180 - protein, 320 aa, Rhodospirillum rubrum
MVGKVIMAKELALLLMLATLWGASYTFIKIGVETIPPLTLIALRTLIAGTLLAAIIGGRGLRLPNDRGTWARFLVQACLNSAIPFTLIAWAEQTTDAGLAAILNATTPVFAFLMTALITRHEAVSGRKLLGVIAGLAGIGLIVGVQALGGLGRELWAQLAIVAATLCYAAAAIFGKTFKGLDPMMPAAGSLICGAALLVPLSLVVDHPWTLAPSGRSLLALLALSVFSTALAFALYFRLIQTLGSIGTTAQAYLRVPIGVAIGVVVLGEDLSATAWLGLGCVVAGVIAMTLPGRKPAEGAAIRRGRHPSERRFRPGVDGR

SEQ ID NO: 16181 - protein, 260 aa, Rhodospirillum rubrum
MRKDGWADPSIRRSPMFDLTGKKALVTGASGGLGASIAKALADRGASVALSGTREAALNETAVFLGKDVPILPCDLSDTAAVERLIPAAEAALSGLDILVNNAGLTRDMLSMRMKDEEWDQVIAVNLSAAFRLSRSAVKGMMKRRWGRIVNITSIVGVTGNPGQANYAASKAGLIGLSKSMAAEVAARHITVNCVAPGFIATAMTDKLNEKQKEAILPHIPAGRMGAPEDVAAAVVYLASEEAAYVTGQTLHVNGGMAMI

SEQ ID NO: 16182 - protein, 299 aa, Rhodospirillum rubrum
MATVAPGLSIGPESNLTRYLQNIRKFPMLAPEEEYTLAQRLRDSGDSEAAHRLVTSHLRLVAKIAMGYRGYGLPMGEVISEGNVGLMQAVKRFDPERGFRLATYAMWWIRAAIQEYILHSWSLVKMGTTAAQKKLFFNLRKMKGQLQLMDEGDMHPDKVTQIATKLGVPEQDVINMNRRLSSPDHSLNAPVRMDGDGEWQDWLVDESDDQETTLAESQEMGQRRALLSGALKSLNERERHILTQRRLRDDPVTLEDLSQHYGISRERVRQIEVRAFEKLQKWMHGAMTGAAPAVAAVAC

SEQ ID NO: 16183 - protein, 280 aa, Rhodospirillum rubrum
MSLVALRTAARSNGSSWERGSMKGKCAVVTGSTSGIGLGIARALAGQGVDIVLNGFGAPEAIEDIRKDIETSFSVRAIHIDADLAQGEACRALIAQAIAEMGQVDILVNNAGIQHTSDIVDFPPERWNSVIAINLSAVFHCTAAALPGMRERDWGRVINVASAHGLVASVGKAAYVAAKHGVLGLTKVAALENATRHITVNAICPGWVLTPLVQAQIDARAARDGVTVERATVDLLSEKQPTRRFVTPEQIGAMAVYLCSEAADTLTGVPLSIDGGWTAQ

SEQ ID NO: 16184 - protein, 390 aa, Rhodospirillum rubrum
MNVGSTGLGEPKVQFASICGWLRHPQEGAVENDRELADFSFATPPSHFRHLSEKRMNPRVRDPGTGFNPPRFLGRPDAKGVATVMSTYRYKLPAVSDEGGLSRYLTEIKRFPMLTPEEEFMLAKRLQDEGDRDAAHRLVTSHLRLVAKIAMGYRHYGLPVSDLVAEGNMGLMKAVKKFEADRGFRLATYAMWWIKASINEYILNSWSLVKVGTVAAQKKLFFNLRRLKAKLGVYEEGDLSPEDVKTIATQLKVTEADVVMMNRRLAGPDASLNVPVGEDQSMDRMDLLMDEGDNQEEVYAAHEEQSLGNRLLKDALSTLTERERHIITARRLRSEPVTLEELGGEYGVSRERVRQIENRAFEKLQTAVRKAARALNDRQPHHGGVEPAMA

SEQ ID NO: 16185 - protein, 337 aa, Rhodospirillum rubrum
MATWKLAPALAAGNCIVLKPAEQTPISILVLTELIADLLPPGVLNVVNGFGLEAGKPLASSKRIAKIAFTGETATGRLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 16186 - protein, 491 aa, Rhodospirillum rubrum
MSRRSAFWRCLRKSGPTVLALGAVLILGVCPASAGNRALLIAIDDYEGDDYDLLPGSSRKDQNDIQSLALQKLGFAASDIRHLTNEQATRDAILAALDALIEETAPGDKVLLQFSGHGTQIKDDSGDEPDHYDEALVPWDIGTDPLGHLIRDDLLEPRIAALRGRDVLVIIDSCNSGSATRGFSREGLRRNAPGLFAARRDATPGAGATSPAFLPQDAAETFIDVPTRSGMRVWSAVAASEVAMVDRDAHQGVFTRLLMEAVVARKADINGNGIISNAEVLSFIREQSQAYCQKERECTSLTPTLEASGEAMHRDFSTGRQDGEIAGIALDALGKPESSAVQVTLTPASPVRLGSTVSFSITSPVEGYLVVFDINAARQITQLFPNLYSEKRGKDHHQVRSGETITIPDASYGFSFQAEEPLGAGVIMAVVTSDEVSLSSLTARHRGFKVVEDPVAYVDSLSAPLQQALTNQMAGRPVKWTYGLLPYSIQP

SEQ ID NO: 16187 - protein, 288 aa, Rhodospirillum rubrum
MRSTLGRLTVIAGTGGDGVPPSEGFLDALWLRLRQEAREAYAHAPMLAPLFVESILNQPTLEAAAFHRIAARLKNDLVGLGIIIDAFNRAVEAMPEIAQDLRTDIAAVVERDPACARFIEPFLYFKGFHAIQTHRLAHWLWHHDERDFALYLQSRSSDVFQTDIHPAARFGRGIFLDHATGLVVGETAVVENDVCLLQNVTLGGTGKDSGDRHPKVRQGAMIGAGAKILGNIEIGASARVAAGSVVLRSVEAGTTVAGVPAKLITRAAAPTEDQILNDLLYESFAYTI

SEQ ID NO: 16188 - protein, 345 aa, Rhodospirillum rubrum
MTMGWDGARQGPPVLSLKAGEGEAARRDEFLATLRQAARDPGAFYLEGHGIDPSVIDQVEALSRRFFALPEDEKRAIDMVNSPHFHGYTRVGAELTRGAPDWREQLDIGSERPLLPQGPDTPAWARLQGPNQWPAALPDLRAAVLRLQAELTAVALALLERIALALGERADFFADLYEGGPDQLLKIIRYPGRAAGEGDQGVGPHKDSGLLTFVLQRDRGGLQIEREGHWVDVPPRPGTFAVNIGELLELATNGYLKATVHRVVSPPADSDRLSIAFFLGARLGSKVPLLDLPPDLAALATGPERDPDNPLFLDVGENRLKGRLRSHPDVARRHYADLLGPDGPS

SEQ ID NO: 16189 - protein, 404 aa, Rhodospirillum rubrum
MTASPPPGFGVSGSDLTIGGQRVSHLARIAGGTPFYAYDRGAVSARIAALRAALPAGMAIRYSLKANPMAALLAHMAPLVDGFDAASAGELRAGLAVGMAPAALSIAGPGKSPADILSAVAAGALVVVESLAEVGRVAQAGNASGLRPRVLVRVNPEAEIQGAGLRMGGGARPFGIDADQVPGVLAAIAAHDLDYQGLHCFWGSQALDAERIARAFAVVGQTLLDLAGPRPPRQIVIGGGFGIPYTPTSAPLDLARAGAAVAETAGLLGDHLPGVSLGLELGRFLVGEAGVYVCAIRESKRSRGNLFLVTDGGLHHNQAATGNFGQVVRRPYPLVIATRMGEPVSERATITGCLCTPLDVFAEALAIPAAAEGDLVAIFQSGAYGASASPSAFLGHPPAVELLV

SEQ ID NO: 16190 - protein, 778 aa, Rhodospirillum rubrum
MSAIDGPGLDSRLIDIFDHLDEGVALYGPDHRLIRFNRPFASLVETAGGRPAPGQRMVEILRDLVAPDTGEENRADSGPDDDGRGTEDDAAERLEGALLGTPTEIRLGRDRWGLVHGHRLKDGALFCVLRDITASKAGAARIAESNRRIREAESRLERALESIDQGFYLCDASDTVVLRNAKLAHLLPGLPPLEPGTTYGAMMAAACDNGAIPAATRHRTRWLSLCMARHHLPRGAWDFENGRGRWVRVSESLTPEGGRVGLLTDITETRKASEQVRQREQRLDGIMKTVVDGIVVIDENGIIESFNPAAERLFGYRAEEVVGASINRLIPGGESGRHDRSLRRYLQTGQAGIIGRGREELALRRDGSLLPVELAISELRLDDRRIFTGLVRDISARKEADRQLRENEERYALAIAGTHEAIVDWDIDSDTITYSDRITAIVGLDPKDLDRSASWIALIHPDHRKDYLTRMDALLRGESSFFSCDFRLAGRAGAEERWLRHRATALRRPDGQIYRLSGAVGDITDSRRGEDRLREAKEAAEFANRAKSEFLTNMSHELRTPLNAIIGFSEVLHSEMFGPLGATQYLDYAASIRDSGRHLLDVINDILDVSRIEAGRATLFPEPLDFAEIVASVHRLVNQRAEAAGVRLKITLDPALPPLLGEARRLKQVLINLLGNAIKFTPAGGEIALSARGDEDKGQMVIEVSDSGIGMAPEDIPLALEPFRQIDGQLARRYEGTGLGLPLSKAFVELHGGTLRVDSTPGAGTRITVRLPAGAVES

SEQ ID NO: 16191 - protein, 341 aa, Rhodospirillum rubrum
MVFRASPCAPFPLANSAVVLLVDRSQAMDLGYLKSKESGFIAGMILCTAFMGSSFPSGKYLISEEAMPAFYAGGWRFLLAGGLILAFCAAKDGLGAILPASGGSVIKGALFVLVVGCLQTAGTMGFLNLALTTLSASMASLLLFTNPLWVAILAHFALGETLSWHKVVALVCGILGVSLCLGGGADHGLGGIVIALAGSLCWALCTLISKKHKFDKSVFVFTGWQLTLGALVMLAISKLSGEAYDIDRITGWGIACFIWLVGPASIGSFGLWFTALSRRGATVTSSYLFLVPLFSAVFSMMVLGEAVSPHSLIGGAIIIVALWLINLPQTVSAVWRERLGL

SEQ ID NO: 16192 - protein, 288 aa, Rhodospirillum rubrum
MNAPGSRLGIGFSLDRIGAVMKILLVFAHPEPRSLNGALRDVAVTELRAQGHEVRVSDLYAMGWKAAIDRDDFPALPPKARLQVAAASGEALAAQALTGDVTAEQDKLLWADLLILQFPLWWYAMPAILKGWVDRVYAYGFAYGVGEHSDRRWGERFGEGRLAGKRAMLIVTTGGWEEHYSARGINGPIDDLLFPITHGILFYPGYAVLPSFVAYRVDRLDGPGFDALAERLRQRLRGLSTTPPIPFRRQNGGEYAIPSLELRPDLGAAGAMGFALHQEDGDHVDKAR

SEQ ID NO: 16193 - protein, 425 aa, Rhodospirillum rubrum
MEKLMHNQAIRANQPEEPPDAFIAAESRPPGGAPTLALVAEPPRWVATGITEKMAAFLAEEPETPCLVVDLDVVEGNYRALRGALPQAEVYYAVKSNPAPPLVARLIALGSSFDTASLPEIDLCLGLGADPAKLSFGNTIKKSKDIAAAYERGVRLFAFDAEEELEKLAEHAPGSQVFCRLFVDNVGAEWPLSRKFGCSVAMAGDLLIKAQALGLEAHGVSFHVGSQQKDLGQWDVALEKAAELFRDLAAVGITLKMVNLGGGLPTSYGNRLPYGVDEYGAHVLGAVDRLFDGPRPRLIVEPGRYMGGNAGVLETEVVLVSRKDAADDRRWVYIDAGRFNGLAETEGEAIRYPIISDKDDGETGPVIIAGPTCDSVDILYDKAGYTLPLSLKAGDRLRLLSTGAYTTSYASVGFNGFLPLKAHYL

SEQ ID NO: 16194 - protein, 400 aa, Rhodospirillum rubrum
MSGTANGTPRRVSILGSTGSIGKNTLDLIGRSPERYQVVALTANGNAEALAAQAKATRAEIAVVADEAAYGRLKEALAGSGIEAAAGPQAVCEAAARDADWVMAAIVGAAGLAPTLAAVERGATIALANKECLVCAGDLFMAEIRRAGATFLPVDSEHNAIFQVFDFEKKERIERIILTASGGPFRDWTREAMAKATPEQAVAHPNWSMGAKISVDSASMFNKGLEFIEAYHIFGIAPERIEILVHPQSVIHSMVGYVDGSVLAQLGSPDMRTPIAYCLAWPDRMVAPVPHLDFPKLGHMDFRAPDPDRFPAIRIVRETLRRGGVAPTAMNAANEVAVAGFLGRQIGFLDIPAVVEATINDVMAGPLGNQAVDHLDAVMAVDGEARRIAAGHALAHAAAA

SEQ ID NO: 16195 - protein, 1240 aa, Rhodospirillum rubrum
MPVAVRRRGRLFPLLYPEPCRSGSRRLSHAGPAPGRHSHRLASRARSGRGDHRPWSFRMSRFLDHLRNRVLLCDGGMGSLVQAMDLSVDGDFMGRENCTEVLNLSRPDVVRDIHTRYFAAGADCVETNTFGGSTLTLAEFDLADRTREINRRAAEIAREAAESFADGRDRFVLGSIGPGTKLPSLGHIDYDTLKDAITVQCEGLIEGGADAILVETCQDPLQFKAAINAAKAARLALGSDTAILLQVTVETTGTLLVGADIAAAATVAHALGVDSLGLNCATGPQEMSEHVRWLKENWPGLISLQPNAGLPELLDGKTHYPLTPAELADWHGRFIREDGVNLIGGCCGTTPDHIAAVNAMLETLGQGRRPAPVKRSVHWVPSVASLYGAVPMRQENAFLSIGERCNANGSKKFRTFQDNEDWDAIVGMAREQVKEGSHTLDVCTAFVGRKEGADMTEVVSRLRGGVNAPLVIDSTETPVLTQALKLYGGKAIINSINFEDGEESAAQRLALAREFGAAVIALTIDEEGMAKDAEAKLRIAHRLYDFAVTQHGLPASDLMFDPLTFTICTGNTDDRRLGLETLDAIRRIRTELPECQIILGLSNISFGLKPVARHVLNSVFLDKAVEAGMTGAIVHISKILPLHKIPADEVKAAEDLIFDRRAPGYDPLHAFIALFEDRSETKVAVKRAETVEERLKQRIVDGDRLGLDADLTEAMGKYPPLEIINSLLLDGMKVVGELFGAGKMQLPFVLQSAETMKAAVAFLEPHMEKIEGQEKGIIVLATVKGDVHDIGKNLVDIILSNNGYKVINIGIKQPIAAILASARENRADAIGMSGLLVKSTVIMKDNLEEMAREGWNTPVLLGGAALTRAFVEEDCVSAYAGSGRVAYARDAFDGLDLMAKVAEGRFDTHLSAVQQKRAGRPSRRPKAPPLWPANDPSSKIAPRTLDDQDTAIHKISERPVDAEEILLRRAELARDHVVPTPPFWGAKVLESISLKSLVPYINEATLFQFQWGFRKGGRTREEWKDWAASEIRPIMFDMLKTCAQEEILKPRAVYGFWKAASQGDAIVLFAEDGTTEVGRFDLPRQTIEGGICLADFVRDIDSGERDVIALQAVTVGARASDVCRDWFAANRYKDYLYLHGISVEVAEAMAEYVHKRIRAELGFAAEEARDIERMIKQEYRGSRYSFGYPACPNLGDQRQLLDLLGAERIELDLSDEDELVPEQSTSALVLLHPQAKYFRI

SEQ ID NO: 16196 - protein, 283 aa, Rhodospirillum rubrum
MIDGPAHGGGTLVGDGSNRKGRAMGVQGLLRDKVALVTGGANGIGRAAARALYGAGARVVIADLDQMAAERAAEAMGGDVLGLPVDVRDRTSMQTCVDRAIASCGGIDILVANAGVSSMRKAVELTDEDWAFNFDVNAKGVFLANQLVVRHFLATGRKGVIVNTASLAAKVGAPLLAHYAASKFAVLGWTQSLARELAPEGIRVNAVCPGFVRTPMQDREIIWEGELRGMTPEDVRKEYVALTPLGRIEEPEDVADVILFLASDLSRFMTGQGINVTGGIKMD

SEQ ID NO: 16197 - protein, 811 aa, Rhodospirillum rubrum
MIALEKLLRENEDWLVRRVIDYAREQGYMAYTSTLEEAWRAGMVGLIDAFLAAEADGTPAAPPRASLSYTEDPVAGYGIETANRHRARGIPLALFLGLLKYNRRALLDLAARDPRPAADQAEIKNRIDNYFDRVELGLCAAWSRFEREQEVGKLRERNRDLVNEKNKYLTAFESLTDPVFLINDAGGLENLNRSAGILIGFGPSPGAGYYGSGIPPSAQRLVDDLLARFAQKAAEAEGAESDRIDYRMDTVEGPRDFEVRRQAMLDVSERYSGQVLIFSDITAYKRASDRAEEANQAKSTFLATMSHEIRTPINGILGLSTLMRDELRDERLRHHADAIALSAEMLLSMVNDVLDFTKIEAGILDLDPVDFSVEELLNGVFALVAPSAHRKGLEVYRSVSPAVPERLHGDLAKLRQVLLNLFSNAVKFTHAGALSIHIDRLAEAPEGKVILHITVDDTGIGIAPSALKAIFEPFAQADGSISRRFGGTGMGLAINRRLAEVMGGEVWAESREGEGSRFHVTALLEAARLPPPPPDTANGQPPAFLADRPLSVLVVDDNDVNLMVAEGFLKRFGHDVVLARNGREARALLEHRRFDAALLDINLPDANGLDLLAEVRRHEAAVGLRSMPIIVLSAHVMQADIARSARLDVRFLGKPFNPERLRRMLRDLTRQDDDPRAGEGDGEGPVAEDFTAGPVLVDPAVLRGHVEMLGATAAGKILAAFHGSAPRTLATLCSHVEAGRIAEAEDDAHRLKSASANLGLECLRRRAAELEAACGQGESAAVGVLVEHLPTLFDSSLRDLDRLWDEITAKG

SEQ ID NO: 16198 - protein, 924 aa, Rhodospirillum rubrum
MNRDRLPTFLSDGASRGVLASGVAFGLIITLLVGFWGWISYRDSLARAASVTEGYTLTYKAFSEQVFGRIAGVVDEVDHRFESSADDQAKLGHYVREQAILFPVLSDVVILDARGRVRLAGKAPPRLTDRVFPMADRLLGGRDEPGMVVTPLFRSDTDGGPWVFAVGRTLVGADGTVAGAVAAVIDQKRFNDSFAVLLENDMATVVLALADGKILARAPEAGFHPGAALLSVAERQGVVVERRSGITRSSLDGVMRIFNERRLSGYPLLVIGTIAKSAALSDWSGWMVLGGLLVATVLIADGWVTIQLMRQLGRRRTAEARLSLQNAVLTSQRETSPDGILVADLSWRLISWNQRFLDIWRVSDDLMRQADGRTLLTQIEPLLEDAPVFRADVVDQMTQAASQFLAVMSHEIRTPMTGILGMGDLLLTSGLNEEQEKYGRTLMRSARTLLGLLDDVLDFSKIEAGQLELEVVDFSPVEVLQDVIGLFLPKASERGLVLSSRLPEGPPPILRGDPTRLRQVLFNLVGNAVKFTARGGVEVRMDVGEAVGDQIPLTLSIIDSGVGMDARQRARLFNPFTQADVSTTRRFGGTGLGLTICKRLVEMMGGTIEIDSTLGEGSTFRVRVTLTRGDASKVVSLEGHGLGHPLDLPGPRPAGRRILLVEDNDTNRLLIATVLERSGHNVDTAADGRQGVDAVSAATEPYDLILMDMQMPEMDGPDATRAIRALSGPAAHTPIVALTADVRAEDRDRYLASGLDDLLTKPVDWTRLREVIERLTGPGQTRPQVRPGGDEVLKRAAWEEEPAFDGSVLASLAEQLGTNRLRPLITSAMANLSRHFDLLEKTMANGSAQDVRRSAHALKGMAGQFGARRAQALSLAIEEEADRPQAARALLPFLRIAIEGARGGLEALVDPTTAPGEKRGREAR

SEQ ID NO: 16199 - protein, 123 aa, Rhodospirillum rubrum
MPTNQPERPDFMKKIEAIIKPFKLDEVKEALHEIGLQGITVTEAKGFGRQKGHTELYRGAEYVVDFLPKVKIELVIEDALVERAIEAIQQAAQTGRIGDGKIFVYAIEEAIRIRTGERGGDAI

SEQ ID NO: 16200 - protein, 575 aa, Rhodospirillum rubrum
MTSEIRLGTRIYLLTAVPITHDRYVNIYASDVTDRVKAEIALRSLNESLEAQVLTRTRDLAESEARTRAIIATMVDGLIVMDDQGRIDLFNAAAQRIFGYDESEVVGQNAALLMSAEDAAGHAEPFGLHLWDGRSPLLNGTRKVIGRRKNGASFPLAVAISALPAPPPGGAPARRLFTGVVRDISDQIRHESDLRKVKDEAEVANRAKSDFLAVMSHELRTPLNGVLGMADLLCDTPLDAEQRRYTRTIAISAEALLVIINDILDLSKIEAGHLDLESRPFDPATLLEGVRTLMEGPARDKAIALRTSIEGAKPPLRLGDEGRLRQILLNLANNGVKFTEKGSLTLRLKAGTGGALRFEVEDTGIGIPKEKQDTLFHDFTQVSASTARRFGGSGLGLSICRRLVGLMGGRLGFDSTPGVGSLFWFEVDLPEVVASQSPPPPPFQGPPLSILVVEDNEINRQVALGLLTKLGHRVTCVDDGAAAVRVVDTMPFDLILMDVQMPGMDGYEATRLIRGKPAPVGGLPIVAMTANATSGDVAAAMAAGMTGYLSKPITRKRLAEALMAHGPGATVSTTG

SEQ ID NO: 16201 - protein, 281 aa, Rhodospirillum rubrum
MPATGGLRDGLDIQWRFAGQAAVDDNIMSGPMVFKRLREDIDAIMHRDPAARSRLEVLLCYPGLHAVLIHRLASALWRRGWLTTGRFVSYLAKIVTGVEIHPGATIGRRLFIDHATGVVIGETAEVGDDVTLYQGVTLGGTSLLPGKRHPTVEDGVIIGAGAQILGPLRVGAGARVGANAVVVTEVPADATMVGIPARIASRSLRKEDGEFCSYGIPEGVPDPIAGTLNGLMDDVRRLNARIAELEGRLDETGSGVGDPPAERRGPALVEDRLKDGARVNG

SEQ ID NO: 16202 - protein, 388 aa, Rhodospirillum rubrum
MSAMIEGLRSGLSFDDVLLVPGRTRARSRADITLASRFSRRIALALPLVSANVPWCTQAPMAIALGRLGGLGVLHRMCAIEDQERQVALVKAAPVDGEDAARATVDDGGALIAAAAVGAKPEDLERADRLVAAGCDALVVDIAHGHADYALDTIAALKSRHPQIDVIGGNVATAEGTADLIAAGADAIKVGIGPGGICTTRRVAGAGVPQMTAIADCVGVARARNVPVIADGGIRFSGDIVKALAVGAASVMLGSLLAGTDESAAVFIDHQGRRCKATTGFVTLGVGLTRKRLRGEKINAEDLDAYVAEGVESTFEASGPLARLIGQLAGGIRSGVSYGGALSIAELQDKARFIRVSEAGRAESRPHALDRAPAPPPDYARLFVEEEA

SEQ ID NO: 16203 - protein, 159 aa, Rhodospirillum rubrum
MSATRPPDPALVLADPMGLALDLARAAAATGEVPVGAVITDAGGRPLAACANRTETDHDPTAHAEILAIRAACARRGDARLPDCTLWVTLEPCPMCASAIVHARLARVIFGAYDPKGGAVDHGVRLFAHPGCLHRPEVIGGMAESAAATLLRGFFQALR

SEQ ID NO: 16204 - protein, 468 aa, Rhodospirillum rubrum
MISSSVSLPRSGHGAWRTELGATLSLAWPLILTNLAQAALTTTDLLLIGSLGSRSLAAAAMAAGLFQALMLFGLGLVSATLPLLATALGRNRHSVRDVRRTVRQGLWSAGLISLPLWLILWHTEAVLIAFGQEPALAAEAAGFMHTLQWGLLPFLGYIVLRAFLSALERPMWPLLVAGLAIGFNALAAWALIFGHLGLPALGLPGAGVSSSLSSLFMVAGLALVITRQRRLKRYRLFGRFWRPDWPRLVTLWRLGLPMAISFAFEVSIFQASMMMMGILGADALAAHTIALQIATLTFMVPLGLGQAATVRVGRALGAGTIPALRRAGWVAYGAGVAFMGGAALMMLSVPRLLIGAFLDADLAENAPVIDLAVVLMALAALFQIADGAQAVCNGMLRGLHDTKVPMLLAALGYWGLGLPLGALLAFPLGVGAPGVWIGLAGGLSVVAVLMTRRWIRLVAALERASVTA

SEQ ID NO: 16205 - protein, 351 aa, Rhodospirillum rubrum
MALTARPGVPLSGVRPLSSVASFSADPVLSAALDRNLALDVARVTEAAAIAAARYMGRGDERAADLAATAAMREALTTVPMAGTITLGALADPDDGLFRLGEGVGNGTGLLIDVGVTPLEGATICAMGAPNATACMALARKGELLAVPPVYMEKIAVGPGVPEGCLSLDADPAENIRALAKVRGVPAEALLICVLDRPRNEALVDRVRSTGARITLISDGDVSGAVAVGLPETGVDMYMGSGGAAEGVLAAAGLRCLGGVLQGRLMVRGDSEKAAVRAAGITDPDRILTMADMVPGETMFAATGVTDGALLRGVRLHAGSARSSTLVMRSRTGTLRFIDTRHDLSKLSADR

SEQ ID NO: 16206 - protein, 369 aa, Rhodospirillum rubrum
MSVLSQDRPRERPPMLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 16207 - protein, 1560 aa, Rhodospirillum rubrum
MTGTTGLGRRIVWWWIVGAVLAGIGLSGFAVWWVTQRNAELAETAASLELTRLSDAIAERITLYQYGLRGARGVIVTFGERGITREVFRGYSKTRDIGAEFPGARGFGFIRRVPADREERFLAEARADGWPDFAIAQFTPHEGERFVIQYIEPAQRNLKAVGLDIASEKNRREAALAAIDTGQVRLTGPITLVQASGDKSQSFLILLPIYRTLSTPETLAERRAQAFGWSYAPLNMPEVLSGLVPNQDRLALTLRDVTNPAEAETVFTSNTDCAAAECVTKTLTRSIFGRVWEISVTVSPAYGHAVQRIAPWVVVSLGIGASILAAGFAAVIGLNQARRREIAQAQARLSTIVENSGDAIIGEALDGTIVGWNRAAEALFGYKAPEVIGKALAPLLIPADRMAENQSIVLSALSGEAVMAFDTQRIHADGHLFDVSMTACPVHDRLGHVVGVANLIRDIRKRKAAEQSLLEFNAQLEKQVASRTAELEKARRALQTVLDSVPSMIGYWDRDLHCHIANRAYCSWFNVDPSGLIGKSMRSLLGEALFTANRPFIEAVLRGQPQTFERMIPRPNGQGVRHSLAHYIPDVVDGEVLGFYALVHDVSELVEGRQKLDAALRENEALLRTIDEQLLCSITDRNGNIISINDNFCKLMGYTKDELLGLDHRIMNSGLHDKTFWADVWATISAGGSWRGEVCNKAKDGALYWLDSVLTPFFGEDGSIDRYVALRIDITDRKKAEAERNRSNTLLRSVLASAREFSIIATDPDGVITIFNSGAEKLLGYSAEEMVGKQTPALIHLADQVAERGRSLSDEFGVPIEGFRVFVHRSERDGVEAQEWTYVRKDGGHLEVLLVVTAIREDDGRIAGYLGVAQDVSRRKEFERALVLAKQAAEEASVVKGQFLANMSHEIRTPMNAILGMLTLVQRTALTPHQADYVCKAHSAAGSLLGLLNDILDFSKIEAGKLHLEPHPFRLETVLRDLAVVLSGSYGDKGVEVLFDIAPHLPDSFIGDDLRLRQVLLNLAGNALKFTDQGQVIVSVGVLAREDDRLTMRMAVSDTGIGIAADQLASIFGAFEQAETSTTRRFGGSGLGLTITRHLVERMGGVLRVESQPGRGSRFWFDITLPVSGEGSESAESGRPLRVLVVEDNPVAGGILAQTVQGLGYDCDLVQESAETKARIVAADAAGRPYDAVLLDWRMPEVDGLTTARILREMGVTLCPQSIIMVTAYGRDVLSLAEQTGDAPFDAVLTKPVTPGQLRDALLRRDRATSEGEATALAPRGLPTPLAGRRLLVVEDNAINRQVAAELLAGAGAEIDLAEGGERGVMMVLRGEIAYDAVLMDIQMPDIDGFEATRRIRADARFKALPIVAMTANASRADREACLAAGMTEHVGKPIDITATIDVLVSLMTEGMTEGEPIAPPSPMGGTGREVPSDEPLLEDLDSIAERLGGQVDLLRRLLPTFAERTGELLDEIEDLIGRGDWSALSMAFHTIKGSAASMGAVALASHAALWEERLREDGPGTLDALRRDQALCDQMRALLAASLEALSSHLDAMAGPYAKEPAG

SEQ ID NO: 16208 - protein, 114 aa, Rhodospirillum rubrum
MIMKFVIAITKPFKLDEVREALGALGIQGMTVTEVKGFGRQKGQTEVYRGAEYVVNFLPKVKIELAVPDNLLDQVVETIQSTAQTGKIGDGKIFVFDLGEAVRIRTGERGEEAL

SEQ ID NO: 16209 - protein, 112 aa, Rhodospirillum rubrum
MKLIMAIIKPFKLDEVCEALTSLDVHGLTVSEVKGFGRQKGQTEIYRGAEYQVNFLPKVKIEVAVSDGLADLAVEAICNAARTDRIGDGKVFVYDLDKIVRIRTGEIDADAL

SEQ ID NO: 16210 - protein, 242 aa, Rhodospirillum rubrum
MNTVIITGASRGIGHATAVRFLNEGWRVITCARADVPPECKRDKNWTAHFPVDLSDPAAIDVFARQIVEHLNGDPLHALVNNAGVSPKTTFKERLGVLNGSIDRWREVFELNFFAPLRLARAFATPLRKSRGAIVNITSIAGHYVHPFAGSAYSTSKAALSGLTREMAVEFAQLGVRVNAVAPGEIKTEMIAPEYEALIPRIPLDRMGSTEDVASCVYRLCTEEFGYVTGTEIYVTGGQHLL

SEQ ID NO: 16211 - protein, 468 aa, Rhodospirillum rubrum
MPVQILMPALSPTMTEGTLAKWLKKEGDTIAAGDVIAEIETDKATMEFEAVDEGVLGQILIEAGTQNVPVNAPIGILLEEGETIDDVHKPSASAPAPAKDVSLETTPAPAEPRRDPVPADTPLAAGGRAEAGRQEEKRYDKFVTLSVREALRDAMAEEMRRDDKVFLLGEEVAQYQGAYKISQGLLDEFGEKRVIDTPITEMGFAGLATGAAFSGLRPIVEFMTFNFSMQAIDQIINSAAKTLYMSGGQMGCPIVFRGPNGAAARVGAQHSQCYASWYAHCPGLKVIAPWSAADAKGLLKAAIRDPNPVVFLENEILYGQTFEVPDDADFVLPIGKAKVERAGADVTLVAFSRMVGVALEAAKALAGEGIEAEVINLRTIRPLDVETILSSVRKTNRCVTLEEGWPFAGIGAEIGMTIMENAFDYLDAPVIRITGEDVPMPYAANLEKLALPSIEAVVKAAKAACYKS

SEQ ID NO: 16212 - protein, 425 aa, Rhodospirillum rubrum
MAEIIDIHAREILDSRGNPTVEVDVLLDSGAFGRAAVPSGASTGAHEAVELRDGDKTRYAGKGVLKAVEAVNGELFSALSGLDATDQLLIDQAMIDLDGTPNKARLGANAILGVSLACAKAAAEEAELPLYRYIGGARSHILPVPMMNIINGGQHADNPIDVQEFMIMPVSAPTVADAVRMGAEVFHALKKKLKDAGHNTNVGDEGGFAPNLASADEALAFIVKAIEAAGYKAGEDIVLALDAASSEFYKDGKYVLAGEGKTLDAEGMVKYYAELCKRYPILSIEDGCAEDDWAGWSLLTAELGAKVQLVGDDLFVTNPLRLAEGIRKGVANSILVKVNQIGTLSETLEAVEMAHKAGYTSVLSHRSGETEDSTIADIAVATNCGQIKTGSLSRSDRLAKYNQLIRIEEELGPVAVYAGASILRG

SEQ ID NO: 16213 - protein, 639 aa, Rhodospirillum rubrum
MGVPMIRGGRVIGVLAVQNRESRDYEEFEQEILETVAMVLAEMLAGADLVGKDELGPVAGNAVLPMRLEGDRLNGGIGLGTAVYHRPEVMVHRLVGDDPETEMERLRTALSEMRQSIDSMLALHRDVPGEYHDVLETFRMFAEDAGWIGRISEHIQTGLSAEGAVRKVDDDMRLRMSQVSDPYIRERLHDLEDLANRLLRHLTGDGSTAALSDLPEHVVLICRSLGPAELLDYDPSRLRGVIMEEGSSGMHAVIVAKALDIPVIGRVPDVFQRVAPLDQVVVDGDHGHVFVRPGEDVREAFLNGVLARKQRRAFYQSFRDQPAVSRDGYRIKLMINAGLLFDMEGLVESGADGVGLYRTEIPFMARPSLPSVETQTELYDKVLELAGDKPVTFRTLDVGGDKLLPYWNRAPEDNPAMGWRSIRITLDRPAILREQLRALIRASGQRELRVMFPMVANVAEFRAARKVLMAELAREAARGTPPPRRVRVGTMLEVPSLIWQLPALLKDGVDFISVGSNDLMQFTFAADRANSRLAGRYDPLSPAALSILHRVVTLCDAAAVPLSLCGEMASRPLDAMALVALGFRFLSVAAPGVGPVKQMLLSTNIDQVRPYVETLLDLPDASVRENLRSFALDHGISLS

SEQ ID NO: 16214 - protein, 630 aa, Chloroflexus aurantiacus
MLTPETVLQGRYRVISQIAKGGMGAVYHARDLRLRIDVALKQTLFNDDAYRQAFEREAQILARLRHQALPRVIDHFIEPQGQFLVMEFIHGEDLGNQLARLGRRFASPQVLPLVVKWTDQLLDVLHYLHTRPVPVIHRDIKPKNLKLTPNHDIILLDFGLARGGMTVVADIDGSGTRKVYGFTPPYAPYEQMRDGEPDPRSDIYSLSATLYHLLTGVLPPDAMTRMASLVNGQPDPLRPIRSLAPHVPEGLAQLIEQGMATLINQRPQSAREMREALHRLRGRPTTSGSPAAIRPIAQTASSSSNDTTATPASSKPATPTQAAPVSQPQTSSPTPVGTLLRRMITGSQVRSLSFDPNSRWLLAGYDDYTVGVWNLSSGEQIHTLRGHESTIRAVAVSPDSTLAATGSDDETIRLWTTDNWQMVQLIHQTGCPVESVCFSPDGRYLAVGGWGEAITLYEIRKGKIEPIGLFTCPFVHSLSFSPDGSMLAAGCYDGAIYLWQIADHQPLKPIEGFNTFIYSVAFNPAGTILAACSGTTIRLWRVKDIHALDTLHGHTAPVRGLAFSPCVPLLASASEDRSARFWLAEQGQPHPPILEHSAGVSCLSFSPDGQLLATGAHDGRICLWQAPVAI

SEQ ID NO: 16215 - protein, 178 aa, Chloroflexus aurantiacus
MSMRMSHALCVLRDDIRAIFRNDPAARNLAEVLLYPGLHAIILHRLAHALYRRNIPFIPRLISQISRFLTGIEIHPGARIGRGFFIDHGMGVVIGETTEIGDWVMLYQGVTLGGTGKQTGKRHPTVEDEVVIGVGAIVLGAITIGKGARIGGGAVVVKDVPPHSTVRGSAGTDRGSPR

SEQ ID NO: 16216 - protein, 115 aa, Chloroflexus aurantiacus
MIAGFDMPRRCVKPSLCGVCTMLVKLFVGNLPWNVGDAELGSIFEPHGELQSARVINDRDTGRSRGFGFVEIETNNVAAVIRATDGLEVGGRNLRVNEAEDKPRNAPRGGFGRRY

SEQ ID NO: 16217 - protein, 708 aa, Chloroflexus aurantiacus
SVITVWNRSQSKSGARPAGVKSFEQIAHHIEHIFAALRQNQLTLTADICDVIYQALDVIGALMEQAVPGQIDDQDALDDLLAHLMAIGQNMRDGDATSLSPSSFTPEDHTRQSAPSLAAETSVRVDVAVLDNLMSEMGELLTSTLRTRQLARDLQELARLPERWQRAWRRTAPFLRHGSSLHANGQLIPQSQQQIVIDMLRQANDVISALGTRLSQLAYQARDNHDLLADISTRMQAQVQRTRMSPLSRIVGSLRLHVRDLARSAGKEVTFVVEDSGAEADRQVLDQVYEICLHLLRNAVDHGIEPPEVRKARGKPPTGLIRLTANASSDRLNLVISDDGAGIDREDIKRHALQLGLLSQHDSEHADDAMVLDLIFTPGFSTKSHVSELSGRGVGLDVVRTTVERMGGSVTVMSVPGQDTTFTLALPLTLMRTRGLLMYVNNQVFALPVDSLRRVVQVNRTQLHTLEGRPVVLVDGRPLQLISMARLIGFSSETVIDFPGPKPALLIGSNERQIACIVDSIGEEIDLVVHRLPPPLQRVRFVSGAAILADGSVAPILDAVDLLRAALTVEHAVMLPTANPTPAHSPTILVVDDSITTRTLEKNILEAAGYRVVLATDGQEALERLHNLQNQGGCQLVLSDIDMPRLNGFDLTRQIRTDPAFRHLPVVLVTSLDSPADRERGLAAGADAYIVKRAFDQQALLETIARLL

SEQ ID NO: 16218 - protein, 331 aa, Chloroflexus aurantiacus
MAKRLLIAGTPFIMLFLVYGVVWEYRGWGVVLTILTIILMIGLWQYFQHRITIQQQRIRELEQELADAQAVAALATRTKSAFLTNISHELRTPLNTIIGYSELLHEDVLDERLAVDEVRERLERIQAAARQLLSLINDIIELARLEAGDVPLNYEPWPIGLLIKEVCATIEPLVEQQQNRLVVDVQPDPEMVVHIDRKKVRQVLLHLLDNAVKFTRQGEIKFIVTIRRSDDGTELLICNISDTGVGMTAQQLDLLFAPFTRFDEPLTQRSSGVGIGLAIAHRLCLLMNGTIAVTSQPGSGTTFLITLPLPSDQTDTLSDTYDYQTELNASS

SEQ ID NO: 16219 - protein, 256 aa, Chloroflexus aurantiacus
MDFQGKIAIVTGGAQGIGRATALALAREGAAVVIADRDEAATTALVSGINAWGGRALAVIADVSDEADAARIANETVLTFGGIDLLVNNAGIQQPGTIESTTVQLWQEIIAVNLTGVFLVSRFVMPELRRRGGGAIVNVASVYGLRAEAGWAAYSASKGGVIALTRAMALDGAADGIRVNCVCPGMIDTSLLRANAALLNAQRPDEALRSFARRVPLGRLGTPEEVASVILCLLSPTAGYLTGAVITADGGWEARL

SEQ ID NO: 16220 - protein, 523 aa, Chloroflexus aurantiacus
MSQMTDLRLRQREYLLQISRALTAQLDLGSVLNLVITYAVELLAGTLGFIALFDEEDGVLRIRASAQLPRELWPAFAPLLRIPIADLGRYGPQVLRDVSLDAGIPLRQMIALPLTVRDTPLGVIYVFRAALNVAFSADDRQILQDFADQAAIAVGNARLFQSVLREKQHLNALIEQSADGVMIIDGRWRITTFNHTMEQLTGWSREEAIGRPCAEVLGIRNAHGVNICLNECPLQRRPDLANPVVEGWITTRDGRDLFIQNRYAPQRGSHGQLLSAIANVRDITAQKMEEERQNTFISVISHELRTPVSIIKGFAETMLRPDGQFTVEQYREALQVISEEADRLARQIQDLLDVSRIAAGGLRLERSDVALHLLVSDVVRRFAAQVGERIEFEIRVPDDLPPVYADYERMRQVLTNLIENAVKYSPNGGVIRIGARAEGDMAIVYVSDQGIGIPPEEQDLIFERFYRVDTRLRRDQPGSGLGLFITRAIVEAHGGRIWVESQVGRGSRFFFTIPLSRRQLPGE

SEQ ID NO: 16221 - protein, 549 aa, Chloroflexus aurantiacus
MSGHLNTTYNRKWSMSTSHTCAASSMRRARPTRSTPFEGSVTDWRLNVFRGLRWQFTLFYACAAVAIIALIGGGTYVSVAGYFERITDLALQHKMVHEFHALNAPLPPELAHADADWSLLRSANTTNRNRRLSADEAAQIALSVRGGEIREVKLDDSYYEVKLRDGSEIEIDAYSGKIIEIKLKGEATTTIPTSPALPSAYDAELASIFVLPLDEQGRILFNPNPAALPMPAHQEALAAALRNGSDIRTIETTTGQRVRLLTYRLTRPDGPAALQLGRLLTDQEQVLRQLVSGLIGLGLFGAVIIGFAGWWLAGRSLRPAEEAWVRQTRFIASASHELRAPLTLIRASAEVALRHADDPDQRELLSDVLSESDHMRRLVDDLLTLSRLDSGALVLQRQPVSLPSFLADLHRQVRRLGEEKGIAIQLAPITGTVLADPDRLRQVLLILIDNALRYTPSGGVITIATEPAGKQIRLSVSDNGCGIAPEHLPHLFERFYRVDVARNRSDGHAGLGLAIAKGLVEAHSGAIGIESEVNRGTRVWFTLPVAATG

SEQ ID NO: 16222 - protein, 537 aa, Chloroflexus aurantiacus
MSLSVEQRVLIETGSAYVVVDPDLRIQSAGGMLALLGGKPPIGGHLLDLLPELFGNEAALDEILHGERDRLYLPLINRQMPDGSTLYIDLLTIPLTDKDGRITGLIQIVTDTTQRSVIEQLRSQQRNELQLLKDRLQRQNVELARINASLLKTTKIKDEFLASMSHEIRTPLTAILGMVDLLRAQLVGPLSDEQMGAIDGIKKGSQHLLSLINDYLDIAKVEAGRMELDLTPVSVQDVCMSLRPLVADLIRRANLSLIFDIDSAVQVILADARRLRQILINLLSNAIKFTPAGGKVGLEVRGEPERGAVRFTVWDTGIGISAEDAVRLFEPFQQIESERQKEVTGSGLGLALVAKLVRLHGGSVRVESEVGVGSRFHVTLPWEPDEQYRFLEQLDQQEREEDTHPTELPAASPRAGDRPLLMVEDDVASATLIADYLRRCGYRVVHVESGEEALAYIQGELPCLILLDVRLRTMSGFEVMQHLRSQVATRDLPVLVLTALAMPGDRERCLEAGADEYLAKPIRLRLLAERIAALLER

SEQ ID NO: 16223 - protein, 298 aa, Chloroflexus aurantiacus
EIMQSLHDEAVLAELARRDRSPLAAIETVRQLIPLLVNEAMDYLPISTISVTEDMSTSMRLHACGWRSVYHDEILAHGLAPEDLRSALQQRLRWAQGTIQVFLRENPLFLPGLSIGQRLAYLDTMWSYFSGLPTIIYLIAPVLFLIFGLLPVNALSAEFFWRLTPYLLVNQLLFAVISWGRPTWRGQQYSLALFPIWIKAVVTAAANVWFGKKLGFIVTPKTRQAGRYFGLVRWQLLMMVLLAVSIGVGLLQLALGWRTDGMPVLVNVFWAVYDLVMLSVVIDAALYQPAEESSSEYA

SEQ ID NO: 16224 - protein, 384 aa, Chloroflexus aurantiacus
MVIHKQAVEAGKIHTMHIVQFYKDYPPIQGGIEHHLQSLSEALAARGHRVTVVFAAPGRRGWRTQRNGVDLVATPRQLTLARAPISLPLLWQVPRLHPDLIHFHHPYPFGDLALLTVQSPLVVTYHSDIVRQRVLGTLTAPLIERTLRRAARIIATSPSLVHSSPWLQRHRERVRVVPFGIPPLPLPDPHLVATLRQRFPGPNALFVGRLRYYKGVDRLIRALALLPFGHAIIAGGDATVRGADLIRLATELGIHHRVHVLGEVDQATLRALYALADVLVLPSVARSEAFGIVQIEAQLAGLPVICTELGTGTSYVTAHRRTGLVVPPDDPPALAAALTELWCNPERARAFGLAGRERAVTEFQFADMVTRIEQVYAEALTVSP

SEQ ID NO: 16225 - protein, 376 aa, Chloroflexus aurantiacus
MLGASVGILRVSGGIFVVSCHSCIVRQECPPMLKRRLSTWEKEEVSLHTHERDERFGHEEEILSPDLSDIEQVEPTLDAVQHYLQEIGRVSLLTAAEEIELAERIERGNEAEAQLATATDLTPRERYELLQAVQQGEEARRHLIQANLRLVVSIAKKYVGRGLALLDLIQEGNIGLMRAVEKFDYHKGNRFSTYATWWIRQAVTRAIAEQGRTIRLPVHMSESVGQVKRIAERLAQSLERQPTAEEIAMALGQPVERIQRILEAARRPVSLETPVGDEGEHTLGDFLTDEELPTPGEMAAQKLLRRDLCAALDRLNDRERRIIDLRYGLVDGRRRTLEEVGRVLGMTRERARQIEAEALRRLRSPEVGQHLRDYLE

SEQ ID NO: 16226 - protein, 486 aa, Chloroflexus aurantiacus
MTATAEDVLSTLPLRLLINGEWRDANNGATFAVINPANGTVLGYVPNAGVEETRTAIAAAVAAQPGWAATPAGERAALLRRVAQMMLDRQQELATIMTLEQGKPLAEARGEIAYAASFLSWFAGEAERIYGMTIPASTNAKRILVLRQPVGVVAMITPWNFPSAMITRKLGPALAAGCTVICKPAEQTPLSALALGQLFSEAGAPPGVINILTCQDPRPFADTIFADTRVRKISFTGSTEVGKELMRRSADTLKRVSLELGGNAPFIVFADADLDAAVRGAVASKFRNAGQTCVCANRIFVQRPIYAAFAERFAAEVNRLTVGDGLQPGVNIGPLIDDQARQKVERHVHDAIAAGARVLVGGGPAPLGGNFWLPTVLLDARSDMLVAREETFGPVAPLIPFDDEAEVIRMANDTPYGLAAYAFTRDVGRVWRLAEGLEYGIIGINDPIPSTAQAPFGGVKQSGIGREGGPTGIDEYLDIKYVSIGI

SEQ ID NO: 16227 - protein, 917 aa, Chloroflexus aurantiacus
MHSLRRRLHHLFTHFNTSLQAKLVLFTSLMLTAILLIAAYGVFLFIESIEQEGWAGRQREAAQNAVRTIDDFLLRVEDTLVLLGSLSAEQIHQSPDLAPELLNRIPAWVEIVRVDPDGQVIASATRDRALLADLVTIPLSNWFREARSGKSYLGPLYITADSEPYLIMAVPASDGGVVASRLRANLLWETVAAIRFGRTGNAYIVDEYGTIIAHPNPQLALSYTSISERPEFRSFPPDGEQRFYINLFGEETLGVALAIPGTPWRLFAEIPEAEATELSTQAGITFTFSLIIFGVVMVLAVNYLLNRFVFRTLEELQQGAERIGSGDLSHPLPVPPEQELAQVAQSFNTMMHQLRTRNTEIARQTANLKAEIQERRRVEQELIKARDAAEAASRAKSTFLATMSHELRTPLTAIIGYSQLLEQLVSKGIYDTVAHDVGRIRAAGTHLLALINDILDISKIEAGRMTVSVEYADVADLVRSAVNTIIPQIEKNRNRLHVHCPPDIGILNSDATKVRQALINLLSNAAKFTEDGEVTLTVSRYQKDHQTWFRFVVADTGIGIPADKHDKLFKAFSQVDDSPTRKYGGTGLGLALSQRLCELIGGRITMESAVGVGSTFTMEIPEIPGDPLTTSTLDLDELPSQMTSEQPVAIDASVPVMPVSNAIILVIDDDPTVGTMIQRLMAAGEAYVVTATTGAEGLRLATDLVPDLIVLDLKLPDLHGLEVLARLRDNPELTNVPIVVLTIDEQSRRSITFPIAEYLVKPVALETLLEVVKRYCRPQSTSSTDHILLVEDDQRLAELLERTLRTAGWSVEVTFDGEAGLAAALARPPGLILLDYMLPKLDGLQFLAQLRADPVGQTIPVILMTARDLSTAERQQLAASADAIQYKAELDIETLITHIRNMLTHARSTSADSTISG

SEQ ID NO: 16228 - protein, 331 aa, Chloroflexus aurantiacus
MPVITYRQALNDTLGEELARDPNVFLMGEEIGVFQGSYRVTEGLLAEFGPKRVVDTPIAEEGFVGVAIGAAMLGLRPVVEIMTINFILVAIDQVVNHASKIHYMFGGQVSVPLVIRTPSGGTGQLAATHSQSFENWFAYCPGLKVVAPATPYDAKGLLRAAIRDDDPVIFIESLALYDTKGEVPEDDDYVVPIGVAEVKRQGTDVTVVSYSRMTAVALQVAQRMEQEGISVEVVDLRSLRPLDRPTIIESVKKTNRAVVIAEDWYSYGVTAEIAATIQEEAFDYLDAPVYRVAGLEVPLPYAKELSAASKPNANSLIYAIRQVMRGTRRMR

SEQ ID NO: 16229 - protein, 726 aa, Chloroflexus aurantiacus
MTHEPEDITTGYLSVLSAASRLLQEELPLVQRIHRLFGLLRLAIRYRDARLTCWLQSARPGAHRQQIFSPESWAYPWDDTLTRSVALGGKTVIKTIALGSAGQPDKNLPVIPAGYLGAPIFWGGRLWGVLELRNDDLRRFTGRISELIEALKPLLAAAIAQEGARLPQLPTPRFAGETPIGLTLTPSLRQKMIALNEQLDRTIDLHELTGVILRRALEGSGAEAGAVALVDYDKRELVLHLYEGYEAERSRRALPALPRQRWSWEIGLAGQAVQMRRPLLVRDAGREPGLPNAMPFLAELAAPIIVDDRVLAVLILHSRRSTTFTEEVLAFITTLCERAAHPLARAMSYQAAYETSYHLGQVFSSLPIGLALLDLNGRVIRANPAWNQVWRLDAQPQRPSFYVGIDLVEHLLARLNDPFRLSEFCDLGQRTPDQTFETSLQLRNPYQELHVLSVPTRDSQQQLTGRLWVVSDRTRERESDRLKDEFIGIVSHELRTPLTSILGYTEILLNRQDLDYESQREFLQTVSNEAERLFKMVKDLLDVSRLEAGVVKLNRWAVGLWQVIEELTLQLHTQLIHHKLLIDARTPLPPVFADRDKVKQIIFNLLSNAIKYSPEGSEIQLTVRRANADDLPATHPPGQWMLIVVRDEGIGIKPEDQARLFERFQRVDNSNTRQKSGVGLGLYISRLLVELHGGRIWVKSVEGSGSSFSFTLPIWTAPANEQGQEP

SEQ ID NO: 16230 - protein, 165 aa, Chloroflexus aurantiacus
MAGRHVAWLLVKESLPAMTVSYDIKDINLAEQGRKRIEWAEKEMPVLRLIRERFARERPLAGLRISACLHVTTETANLMRTLAAGGADVVLVASNPLSTQDDVAAALVAYEEIPVFAIKGESNEVYYSHIRGCARSQSAVNHGRRRRSGDRCAEGSPRSDPTHGR

SEQ ID NO: 16231 - protein, 337 aa, Chloroflexus aurantiacus
MTLLLLWWPMKRFRFSQSKAKATRCITATSGAALDHNPQLTMDDGADLVTGVLRDRPDLIPHMVGSTEETTTGVIRLKAMAKEGVLPFPVIAVNDSDTKHMFDNRYGTGQSTLDGIIRATNILLAGKTFVVAGYGWCSRGIAERARGLGANVIVTEVDPIKALEAVMDGFRVMPMEEAASQADFIVTATGNKHVIDSNAFAVMKDGCVIANSGHFNVEINIPALEALSVEKRQPRAFVDQYILRDGRAINLLGEGRLINLASAEGHPSAVMDMSFANQALASEFLLRNQGKLPVGVHALPKELDREIAALKLAAMGIKIDTLTAEQEAYLNSWQEGT

SEQ ID NO: 16232 - protein, 497 aa, Chloroflexus aurantiacus
MEVTMGIAWEEKFTREGLTFDDVLLIPAESDVLPATVDVSTWLTRNIRLNIPIVSAAMDTVTEHRLAIALAREGGIGIIHKNMPIASQAEMVRKVKRSESGMITDPITLPPDRTVGDALDLMAEYKISGVPVTTADGDLVGIITNRDLRFETDRNRPIRDLMTSRNLVTVPEGTTLEEAKEVLHRHRIEKVLVVDERGKLSGMITVKDIMKRIEYPHACKDDMGRLRVGAAVGVSGDYIERATELVRAGVDVLVIDTAHGHSRGVLNAVVKLRELFPRVQIIGGNVSTAAATIALIERGVDGVKVGQGPGSICTTRVVTGAGMPQITAIFDCARAAEPYGIPIIADGGIKYSGDIPKAIAAGAHSVMIGSIFAGTEESPGELILYEGRSYKSYRGMGSIGAMQRGGGDRYFQTNVTEARKLVAEGIEGMVPFKGPLSDTVYQLVGGLRAGMGYVGAANIEALRRDARFIRITTAGQIESHPHDVVITKQAPNYGGRQ

SEQ ID NO: 16233 - protein, 493 aa, Chloroflexus aurantiacus
MADYANSSPERPRILIVEDEVNIREFCRLLLRRHYDVVAVGDGLAAIELLSTQTFDLVLTDLQMPNLDGIALVQYLRAHHLETDAVVMTAHATVETAREALKLGALDYIAKPVDAEQLQKTVRTALELRRVRREKERLSDLVLMYQFSQVITASLDVQEQSAHLLEFVGRRFAPSNIGLSLIDADGDTLVVLIGPEPGQSLSLSERDEQSLRAAHYQLIECPTTSSDRLIEVVLRSRDHAIGFLNLTRNSEQPSFDAADRHLIEIFASQIAAALDNARLYRALKDQYEQMIAALAGAIEARDAYTYGHSRQVSRYAVRLAQELGLSPAEIERIHYAGLLHDIGKIGIRDDILLKPGPLSPEELTQMRRHPQIGVRILEQISGLRDILPIIAAHHERFDGTGYPYGLKGEEIPFEARILAVADTFEALTADRAYRSAMSPEAVLQIIQDGRGTHWDPQVVDAFLRLMRRERLWEQSPRLRQVIQPPLSVESISS

SEQ ID NO: 16234 - protein, 384 aa, Chloroflexus aurantiacus
MARKHPYEPLPWNDLPSVSWNFVWREPIGVCAQIIPWNYAFCMAAWKLGPALATGNTVVFKPSSLAPLSTLAIFQTIHDLNLLPKGVINLVLGPGGDVGEYLVTHPAVDKVAFTGSTEVGRKIMALAAPHIKRVTLELGGKNAMLILPDADLDLVVDGVLWGAFYHSGQLCEAGSRLLVPHALHDTLVERLVERVRGMRIGDPMDLETDIGPLISERQREKVEYYIAVGREEGATVVIGGGRPIGEAFANGHYVEPTIFTGVRPEMRIAREEIFGPVLSVIAYDEIGEAIRIANDSIYGLAASVWSRDLQHALSVVRRIRAGTVWINEHHVLNPRAPFGGYRQSGFGREMGRYGLDEYTEVKHIHVDLMQRRQGRLWWDTLLPE

SEQ ID NO: 16235 - protein, 350 aa, Chloroflexus aurantiacus
MRFWRQLRWQMIGAQMLVVVVGVVTLNLTANILIEQSIAPDQVATVRTAVVQALTVAAVAATIAGLTTSILLVQVILRSLRSIARSSRRIAAGRYDERVTVPASDELRAVAESFNQMAEALEQIEQRRITMIGNVAHELRTPLAGIEGYLEGLIDGVLPNTADTFLDMKQEVRRLRRLVDDLQTLSRVEAGQIALHFTTFDVNDVIRRVVAQIQPQVLDSCLQVQFAPDQQPILVHADADRVAQILLNLLGNAVRYTPEGGCITVRSELNNDNVQVIVEDTGIGISAEHLPFIFERFYRADPSRARTSGGSGIGLTIARHLAWAMGGDISAASAGIGKGSTFTLTLPRAG

SEQ ID NO: 16236 - protein, 183 aa, Chloroflexus aurantiacus
MIDLFLQDVRRWVIPGQISTEPLRLRQILRLLLTHLPLRAMLWFRFGSWCKQRGIPFIPGYVQRRIYRRYGLEIVVGADIGGGLYIAHPVGTVIAPQRMGRNCSVIAAVTIGMRNEWKFPVIGDDVFIGAGARVLGGITVGDRAQIGANAVVIRDVPAGATVVGIPARVVKSGAELANSTVFD

SEQ ID NO: 16237 - protein, 327 aa, Chloroflexus aurantiacus
MPEMNLLEAIRQGLDEAMAADSRVFIFGEDVGKRGGVFRVTEGLYDKYGPMRVIDSPLAESVIVGACIGAAMNDTLPIAEIQFADFIAPAFNQIVQEAARIHYRSNGDWEVPLVIRVPYGGGIHGALYHSQSVEAFFAHVPGLKVVTPATPYDAKGLLKSAIEDPNPVLFLEHKKTYRLIKGFVPEEDYRVPIGPADIKRPGEDMSVFAYGLMLHYCLEAAQTLAAEGVSVEVVDLRTLRPLDTETILASVRRTGKVLIVHEDNLFGGFGGEVAAIIAEHAFEYLDGPIVRIGGPDVPAMPFAHSLEAAFMPSPASIAAAMRRLAAY

SEQ ID NO: 16238 - protein, 1197 aa, Chloroflexus aurantiacus
MSRPTYLQALAERVLIFDGAMGTSIDTFDLTAADYGGEATFGCRDYLVITRPDVIEAIHTSFLEAGCDVLETCTFQSTRPRLAEWGLGERTVEINRAAAALARRVADRFAARDGRPRYVAGSMGPTGKLPSSDDPALSDITFAELSDIYYEQAIGLIEGGVDLLLVETSVDILEVKAALDGIRRAKIDLQRPDIAVQAQVFLDLSGRMLLGTDVPAMIATLEAMPVDVIGLNCSTGPEHMRAAIQYLTTHSRKPISCIPNAGLPLEVDGRTVYPMEPEPFAAILGEFVREYGVAVVGGCCGTRPAHIARLRQILGDAPRPKQRQVEYIPSVSSGIRAAALRQDATLTMIGERLNTLGSRKVKRLLLRDDYDGALEVAREQVESGAHMLDVCVAMTERNDEKEQMTRLIKKLTLNIELPLVIDTTEADVLEAALSIYPGRALINSVSLEGGRGAKIDKVLPLAARYGAAVIAMTIDEEGMAHTAERKVAIAERIARIAQEEYGIPAEALVFDVLTFPITTGQEELRYSAIETLEGIRLVKQRIPGCFTTLGVSNLSFGVAPHARAALNSVFLYHAVAAGLDTAIINPAHVTPYAEIDPAQREVCEDLIFARREDALARFIAYFEQHAASQDNEREDPTAAMTVDQRLHWKILHRKKEGIEDDIDQAVDQRLQASGLRLSDPAAALRNEHGTSPQGQAAVDVLNTVLLPAMKEVGDLFGAGQLILPFVLQSAEAMKKAVARLERYLDRIEGASKGKVVLATVYGDVHDIGKNLVYTILSNNGYTVYDLGKQVPINTIIEKALEVQADAIGLSALLVSTSKQMPLCVQELYRRGIHIPVLVGGAAINRQYGQRITFVDDEEPYPAGVFYCKDAFEGLETMDRLSDPATREQFIEQTIREAANVLHRRVTGRVALTELGEAAKASADGVRSAVRTDVPVPVPPFWGWRATSRIRLSDVVECLDRNSLYRLQWGAKNAKGAEWERLRTEFDQKVRELIAEAERDGWLQPRVIYGYFPVQSDGLELIVYDPADRRRELTRFVFPRQPARERLCISDYFRSVESGEYDLAAFQIVTMGSAVDELVETLQQRGDYSRSYYIHGLGVSLAEALAEYTNRIIRQGLGLDERRGKRYSWGYPACPDLAEHAKLWQILPGEEIGVTLTEAFQLVPEQSTAAIVVHHPEAKYFSIGSALERAEMDQRGDD

SEQ ID NO: 16239 - protein, 323 aa, Chloroflexus aurantiacus
NGSVSAGLSTCSLKCDRIDAMREMILADTVEERRAALAKIEPLQQGDFEGLFREMAGLPVTIRTLDPPLHEFLPHDDEEIEALANKLGVDPRKVKARVESLREANPMLGFRGCRLGILYPEITEMQARAIFKAAVKVKAEGIDVHPEVMIPLVGHVSELKLQEEIVRRVAAEVFAEAGIEVPYLVGTMIELPRAALVADEIAQVAEFFSFGTNDLTQTTLGLSRDDSGRFLPIYVEKKLIPDDPFQTIDQRGVGQLVQIGTERGRSTRPDLKVGVCGEHGGDPASVEFFHRVGLNYVSCSPYRVPIARLAAAQAALGEAKRDK

SEQ ID NO: 16240 - protein, 252 aa, Chloroflexus aurantiacus
MGDKVALITGAASGIGLACAERFAADGYRVVLVDLPGAAGEAAAERLGGIFAGVDLATQAGCRQAVDAALNAYGRVDVLINNAGFQHIDAIEDFPEERWETMIAVMLTAPFRLTKYVWPGMKANRWGRIVNIGSVHSLRASPFKSAYISAKHGLLGLTRTAALEGGPYGITVNLIAPAYVRTPLVEKQIADQSRTRGIPEDQVIEKIMLEPAAIKRLIEPAEVAGLAAFLCSDAAGAITGSVYEMALGWTAR

SEQ ID NO: 16241 - protein, 485 aa, Chloroflexus aurantiacus
MMDYPFFHVSHYIDGQFVDGGSRFDILYPATNQVIGSAPEAGADEVDAAVAAASRAFRQWSRMPAAERRLILKRFAQLIRDHEAELAAIETWDVGRPITENRSGYIPRIAANIEFFADFAVTHGSESYPMDNGYINYVLRQPVGVAALIAPWNIPLLQATWKMGPALAFGNTVVLKPAELTPIGTWRLAQLAHAAGVPAGVINVIHGFGPNSAGALLTRHPDVKLISFTGETTTGKIIMATAAPTLKRVSFELGGKGANIIFADADLDRAVAISLRSSFFNQGEFCLAGPRLLVQRPIYEAFLTRFQRATSQLQVGDPFDPQTRVGALISREHYERVTGFIDLARADGAHILTGGTDPVLPEPFAQGNFLQPTIITDVKPHDQVCQDEIFGPVVTVVPFDDEEEAIAIANGVSYGLSAVVQTRDVGRAVRMGSALEAGTIWINDFFVRDLRVPFGGMKQSGIGREGGHYSLEFYTEAKTICLSNQ

SEQ ID NO: 16242 - protein, 250 aa, Chloroflexus aurantiacus
MRLEMEMARGEEARRRLIQANLRLVVSVAKKYIGSPMAFMDLVQEGNIGLMRAVEKFDYTKGNRFSTYATWWIRQAVTRAIAEQSRLIRLPVHLSESIVHLRRAIYRLEQELEREPTAEELAHALNMSVRKVKRLIRASTQPISLEQPLNNEQEGRVSETLADETVASPMEIAEQKMLHAELTAALNELPERERKILQLRYGLIDGQRRTLEEVGATFGITRERTRQIEAEALRRLRHPSVGQRLHSYLD

SEQ ID NO: 16243 - protein, 780 aa, Chloroflexus aurantiacus
MCPLHHTYARELSIWSTGMAALPFVMIYLIPAIIATGLAIVMWQRRYYRGGRPFTLLLAAIAWWNLCHALSIADTTFEGTLFWSLLQNVGIVLIGPCWLLIALAYSGEWWRVDRRIRRGIFIPELIALIFALTNNLHYLWWSTVVADTSRPFLWLSVTRGPAFWFHSIYAYVCLAIGIIILFRASAHAPPVHRYHSRLMLAAALIPAVGNIAFLSGLKVPWNDDPTPILLLISAALAMYTTMRYQLYDLAPLAEQEVIAGLPDGLIVLDSRGLVAEINQHAPRLLGIQQGRWIGRSLTSLIVNSPFERDLQRLLNTPVTGPSRPVICENGTQAIEVRLRPLQSAAGITTGSLLLIRDVSERMRAEQERARHIAALRLINSIARSANTAQETSTLLKTIAHIIVQEGHWERVSIGLIDNAQNIHVTIDYTTAGYGRLHDQVISGVAASALIERIQHGRPELINLSELTVTDPLAETMQQEGLQSLLLAPLRHDQHAAGILGLASSETKSMTPTLTELVIAIGELITDALIRIRLYEEVQRADRLKTGFLATVSHELRTPLTTIIGYTDMLRRGVLGELSPEVQETLHYMRQASLNLMRLISDILEFSRMEAGQLIIDIEPVPVSVIVQNVVGQMQPQIREHQLHLMVNIPPDLPMIQANAGRLEQVLINLLSNAIKFNRPQGLIEIKAETRGEWVRISVRDTGIGIAPADQERIFEEFERVKQKNGHSVSGVGLGLAICRRLIQHMGGKIGVKSTPGEGSTFFCDLPVVPVSRTVGAEADV

SEQ ID NO: 16244 - protein, 956 aa, Chloroflexus aurantiacus
MEWRMSVDLLTLSIALNLANLLQSAALTGLALANRDRVGPVWWAAGMGVLAAGLILTTLRDVALLALELHAISNALVGIGMLLLHYGVCRFFGDSGGRRWFWLAGGLIVAANLMLVFTGDAPPLRRILFSVVVALVSMLIAQRLLRELRTDTRPVVLFLAIVFLVNSTFFALRAVASVAESDWLTVSPPWQTATYLVAIATTTLWTFGLILLVNQELVNRQHEAVQQLEQIFAAQPDAVLLSRLTDGVFVKVNHGFTTISGYSADEAIGKDALTLNLWRSPEDRRRWAEIMRREGACSGMEFDLRRRDGTFRTCILSSQVVMIRGVPHAISIVHDISERKRMEEALRRSDARYRLIAENTTDVIWLYDPFKSQFTFFSPSIEKLIGYSAAEALDLPLSAFLKPDSIQHVKTALDYMLHEWEGELTNAPPWTAEIDLIHRDGQIVQAEIVTSFVRDEEGQLMVLGVARDITARKQTEIELRLARQQAEAANRAKSAFLANVSHELRTPLHAVLGFAQLMSRDDNLTATQHEYLAIINRNSEHLLHLINEVLDLAKIESGRYTYTPNPLDVRRLLADLQALFGPQAEAKQLQLIVTCEEQVPPMIVSDEAKIRHILINLLGNAIKFTHGGSVRLRADTDKQQMYFIVEDTGVGISPLEQPYLFRPFFQGKQTANASSDTGVGLGLSISYEFARLIGGDLSVYSAGEGQGARFTLTLPLRTPVTSSFVLPAEPVKRAIQVRADQPVYRMLVADDQPTHALLLISLLRRLGFAVQSVTDGEQALAVWREWQPHMIWLDLRMPQMDGLTVARQIRAICATEPGLLQPVIIALSAHVLGDTAASVLAAGCDEFLAKPFPEHEVVRLIEQHLNVQFEYASVVIREVPETAIHDQGYHPAWCQALRQAVQVAHFQRLQELVGMIEDQRPDDARQLRNWIETFDYEAVRQWLDRLVSSQTVDRVV

SEQ ID NO: 16245 - protein, 955 aa, Chloroflexus aurantiacus
MEERRQRIRGMVAFLIVPGEVIEQALRPVTTPDLEFVLVDATEESLRPLAVLTGGRAVPSPYISDLDIVIRDAVAISDIPRYGRVWSIAFCLGTNYLPFWWSADAISRTVLAIASVAIFFLFVAIRQRHEARQRRLTRTYALLSAINQMIIRERDPQRIFQEVCQVGIGEGGFRLVWIGRHNLVTSRFETIAIHSAKELDQSLVHLLTGEQLAMTLSPVCQGDRVVINDLATDPRCAAWRSQAVAYGLRAMAGFPLVVPDEPPAVLCFYAGQPAAFDHDEIQLLDELVRDIIFGLLVSQQEAQLRTSEQRNHLIVSALPDLVLRLRPDGQVVDVVAAESMVLPMAPTAMINSTLEQLFPAAIATQYRQALSAAFASGELQTLAYQLIVEAKEYFFEARIKAALPAEEAIAIVRDVTAWRNAELALQVERDLLAQRVAERTAELHRANAELLRAARTKDEFLANMSHELRTPLNSILALSESLLEELYGPLRDQQQKAIRAIEASGRHLLALINDVLDLAKIEANRIELVKEVVAASDVCEASMALVKEQATKKQIHLSIQLDDPHARFVADPRRLKQILVNLLSNAVKFTPAGGAVSLQVTTDTTQGTIAFTVSDTGIGIAEEDLSRLFQPFVQLDSGLSRQHEGTGLGLVLVRRLVELHGGKVEVESMPGVGSRFTVTLPYQPVTHIAASSSADELPPVQLALIIEDSATTADQLARYLEELQIQPVICSYGKGAVEQVQALRPDLILLDVQMPDRSGWEILADLRRDPDLRQVPVIIVSVVDEPERGLAAGAAAYLVKPINRLMLRRALSQITVTKTTSSTAPRRPLSRRILLAEDNEVNRVTLSDYLVAQGYEVRVACQGKEALQIAAEWRPDLIIMDIQMPGLDGLEVIQRLRADAAFAATPIIAVTALAMPGDRERCLSAGANDYFAKPIRLRQLVERIEQFLASSQHAI

SEQ ID NO: 16246 - protein, 554 aa, Chloroflexus aurantiacus
MRFPIRVKLLGALAIDLLLMMILGVFAMHQMAVMNERAVFIERHTIPSLDTVGDMTAAINRYRARQLEFLIYTNNGDRARILDQMRVIETEMAGYVQAYRALVDSESERRQLNAVEAAWHEVVRANHERFIPAVRLVSDGSVQPFYSRMNPVYATLDREMNLLVQENQQQARASLDVVASSYATARTFILFDTAVAIIISAAIGLFLSARIARRLRRLAHASNRVAAGDFVGSINERTRDEIGDLARAFDQMLSSLRAQRAELEERNRALQESLSRQAQLMEEIVRGKQAEAEAERARAAAEAASQAKSAFLATMSHELRTPLNAILGYAQLLHLSNAVSEPHADYLERILSSGRHLLTLISDVLDFARIEQGALELEYRQVAIAPLVEDVATMTLPLAQRNHNQVITCYPADIGSIETDDRRLRQVLINLLGNAAKFTERGTIRLNVVREQRHGIDGIRFDVIDTGIGIPRDKQDKLFKPFSQIDESVTRRYEGTGLGLALSKQIVLALGGTIDVESDFGVGSTFTVWLPTAPLAAADSTSLPSQPHLIGEPA

SEQ ID NO: 16247 - protein, 398 aa, Chloroflexus aurantiacus
MTQSQPETDRAAPAINPADLQALIAQGRQQGFVTFEDIQRLVPNPDESIELIDSIYAALAEAGVPVQEGDETALDDEPSSPATMDLDLDDELSDALLSDSVRLYLREIGQVPLLTAEQEKRLAQLIEQGQEAERKLATLPPDSPEAARLKQLKAKGEEARQQMAAANLRLVVSIAKRYRDRGLPLLDLIQEGSLGLLRAIEKFDYTKGYKFSTYATWWIKQALSRALADQSRLVRLPVHLGETLNRIQSARRQLTQSLGREPTDTELANHLGMSEEKLRELRRTAQDPVSLATPVGEEADSTLADFIPDPHALDADDAAASGMLRQQITAALDQLSERERRVLELRYGLVDGQPRTLEEVGKAFGVTRERVRQIEVKALRKLRHPRLGKLLKDYLDQI

SEQ ID NO: 16248 - protein, 479 aa, Chloroflexus aurantiacus
MVARTLNPARTPVATPDEGLVTDLLPPMLILLATLAGAATGILLLNRWSGNFWPYLIIGLLLVCLAVSDRLRRRGDLRMASIVVVAAITLLPVLSCAAFGFTNNIFIYLSVLGVFAAGIIVSSRAPFRAGQAAILLYLLLLLGADLIGQPRPTWFEVIGHLLLLIALLFGAATLSWAAAYVVRGTISWAIDTAQKSERREQLLRETQATLERALLERDLLNEQLYRTTLELEEARAAAEAAYRSKSNFMATMSHELRTPLNIIIGFSTAMLEHPEMYGDVRIDEQVLQDIAEIRRSGQHLLGLINDILDLAKVEAGKLELNKTNLALGPLLEETLRTAQALINDRPIQLRREYREPLPTVFADEVRVRQVLLNLVSNACKFTHAGEIAVGARVDTNEIVLWVRDTGIGIAPADQERIFQQFEQIENADTRQHAGTGLGLSICRWLVELHGGRMWVESELGKGSIFFFSLPRTRAGSEPA

SEQ ID NO: 16249 - protein, 426 aa, Chloroflexus aurantiacus [sequence omitted]

SEQ ID NO: 16250 - protein, 390 aa, Chloroflexus aurantiacus
MKPHTLLIVDDDDTVAEMLELVLRGAGYEVRRAASGEEALQQIYKNLPDALICDVLLPGIDGYTLCKRVRQHPLTKTLPILMLTAQGDISAKIAGFEAGANDYLAKPFEPQELVYRVKNILARTTIETPTTPVQRGKVITVFGAKGGVGKTTIAVSVALALRLRSRRRVVIVDADLTFGDVAVHLNIAPTRSIIDIVRSGDEIEQEMVKQVLLSHPSGLQALLAPPRPEEAELVSAEHMTRILDLLAVNADYVVVDCQTSYDDRTLSVFDRTDHVLLVITPEIGPLKNTSLFLSLANQLGIDPRAISIVLNRSNSGVGIGVNEIERVLRRKINYHVMSGGQPVVTAVNRGTPLILEQPKHPFVQQILYLADQMMKQLDTNQNVQTDTVTR

SEQ ID NO: 16251 - protein, 373 aa, Chloroflexus aurantiacus
QVITNLISNAIKFSPPGGKVEVAIGREPRGRIRITVTDHGPGIPVEFRDRIFQKFAQADSSNTRRQGGTGLGLSISRAIVERHGGQIGFVTASGVGTTFYVDLAEYRPNTNTTVSLPPQSDRPRILICEDDHDIAALLSLMLQQAGYATDIAYSLTEARDLLAQREYRAITFDLLWPHEDGVVFLRELRTQPHTRTLPVVVVSARAGEEQLTNGHDLDVVDWLPKPIDQQRLLAALRRAARRTGAGRPLILHVEDDSDVIAVVSLLLAEIADVKAATTISEAQALLQAQAFDLVILDQHLPDGNGVDLLPLIERLQPPVPVIFFSVHDLEPEIVNRVGVTMVKSRTTNTELLTTVSRLLDQPISSPVTPNEAR

SEQ ID NO: 16252 - protein, 430 aa, Chloroflexus aurantiacus
MTLASHVWPETVSVVDGRLWIGGCDTVALAEQFGTPLYLLDDLTLRGAMRAYRQAFATAYPGPSIVHYAGKALLNTALAQIVAQEGLGLDVVSATELLVAQRAGLPMDRVHLHGNAKSDQELERAIAWRVGAIVVDNLDELQRLCALTSHLTTPQGVLLRVAPAIEADTHAHIATGSATAKFGLPLEALDEAVAQTLAAPSLRWLGLHAHIGSQLFALEQVTATVEVLVALAARIRDRFGVAPVELSPGGGLGVPYTADQPATDIGRYAQVVSAALCAACERYRLPLPRLTVEPGRSIVARAGVALYRVVGRKGEHWVHIDGGMADNIRPALYGARYSAVLANKPASPPAMTVNVGGRYCESGDVLLRDIALPTVQPDDLLAVAKSGCLHAEYVPSTYYLVPRPALVLVADGTGTSDPASGTEPCAGSRL

SEQ ID NO: 16253 - protein, 250 aa, Chloroflexus aurantiacus
MLLDLSGRVAIVTGGSRGIGRATAERLAGSGAAVVVNYRGNAAAAEATVAAITAAGGTAIAVQGDVSQPADVEQMVKTTLERFGRIDILVNNAGITRDTLLLRMKESDFDEVIATNLRGVFLCTRAVLRPMTKQRFGRIINITSVVGLTGNVGQANYAAAKAGILGFTKSTAREMASRGITVNAIAPGFIETEMTEALNEEARKAILATIPLGRFGQPAEVAGLVCFLASDAGAYISGQTLTIDGGMVMS

SEQ ID NO: 16254 - protein, 325 aa, Chloroflexus aurantiacus
MERNLGMDLVRATEAAALRSGRWMGRGDKNSADQAAVDAMRMALNSVPMNGIVVIGEGEKDEAPMLYIGERVGNGEGEEIDVAVDPVEGTTLLAEGMPGAIAIVAVAERHSFYNWRGIPYMDKLAVGERAKGVIDINAPVAYNIRAVARTLNKQVEDVTVVVLDRPRHKDLIRQIREIGARIKLIPHGDVSAGIMTSIENPPADILMGIGGAPEAVLTAAALKCLGGEIQCKVWPRNDEERARLAELGLDPKQVLTTRDLVRGENVVVAATGITSGEFLRGVEYFGGGARTHSVVMRSRSGTVRYIEATHRWDKLMRISDMPYAR

SEQ ID NO: 16255 - protein, 962 aa, Chloroflexus aurantiacus
MAGHIVQVSERAVLLAILCRQMYRATSRDMVWQVLLDGARSVAAADMAVIYQLDPEADLLQRFVDRGTTVFPDYITVPNYLLHDLRLLRQPIRFIPDQQSTPLALALTSAIWPDRPPREVVILPLIEQGRLEAVCVCGWLSPVSDEEISALQFLVDDATYARAMLASTDRRQSDQGVISDAITNLTLLYTHTFDQLIEAALDQLVVIGEAAAGALYLYDDEAQSLRLQSVKVNALATAFAPTLRQLWQNDLGRHCQVLAESLLESSNEVVYLVADPSSSHEIAPLHRFLCEHAIDGILSLTIVAGGWQAGVVQLVPWPGNGFSERQWQWLRSLVRQIGVAIEHSRLFERLRAELDHAQAVVETTNDGIVLINARRRVVMVNRRACYFFGVAEHDLKGRPYDDLLQVFNRVFAHPARLGLWLGQLLGSETDRANEEFQVVWPQVRRLQCFSAPVVDRREQYLGRILIFRDVTREREVEQMKNEFVSMVSHELRTPLASTQGALQLLLGDSERGKSGLIRDMSSVERDLLQRALTNTNRLLRLVNDVLDIAKIERGQLQLQRHPVAPEEICRNAIDDLASFARQQQVTISLDVPPNLPLVDVDRDRIVQVLVNLLSNAIKFSPAGQQVVVSVAHEQGMVRFSVRDWGPGISRADQLKLFQKFQQLDQSKSNVRGGSGLGLAISRQLVELHGGRIWVDSDVGFGSTFSFTVPLAAVQRIASADQRPLILIGSDGHPLTDVLHARLMAKPDWEVVITPIADLQTTLPARQPAVTVLLHPVNAEEVIGRLRTLALYQLTSIIIVSDESAVKLPKDVVVFPGTISVDQLVAEIHYQTTRYKPLIMVVDDDPNVRPVLTRLIQRHGMRVLAAGDGEEALAIVQHVRPQAILLDLRMPGLDGFEVLRRLQADQATASIPVVVLTANDLAPDAPSQAFALGARGFLEKPVSAERLIATLTSVIPADEGSHE

SEQ ID NO: 16256 - protein, 878 aa, Chloroflexus aurantiacus
MNPTLSQWLHTRQTAILDNWPDRNEAMTGHVVIQPRLETQRLVSALIAAAEGNELPLRDLFSEWIAAETDVGLPVMVRNFQNLHRTIRASLIQDTSSLTLIDDLADLFDQAIAILVELWTEHTSQLIHEREFIAASLDAASAAADQRALQLKALNDISQRLSATLDRDTLIEIVIDSLHRLTEAHHAALWLVDDKQRIRVVASRGSDDGPPVGYILPDANPTVQAAFHKGVFWPALPADNMQEWMIAGCSVLIIPMTGGERLIGAVTLQELHNPLDLRFMQDLAQSIASQAAIALQNAELYHTIRTLNADLEQRVIERTRELEEEKDRLATLHAIAAQVNQTLDLDQILNNSLTMLARIVQAEHASILLTEEDNPSLLVTRAILGTKVSPDNTVRFAIGQGIAGWAAQHGQTVLVPDVAEDERWVTIPGSSRKREGSMIAVPLFVQGEVIGVMTLSHSQTHFFHEGHVRLLNACAGAIAIGINNANLFRMISTEAERRYELLDRQQKETSQIAAILQSLLDGVIVCDLYGGVISINPAASRILHRPLEELLLWNLRDVIQRYLGSHAAELPLDDLLRRPLSVNGEARTFTTTAIVGGKTVNFSLSPVLKENDELLGALLVLRDITREVEADRMKNEFIGTMSHELRTPMTAIKGFTQLLAMGGLGQLNDTQREFVNTIYSNTERMINLINDVLEITKIESGSIDLEWRSLHLAEALSGVIAELQPQITQHRHQLTISIPPGLPLIRADAMRLHQILYHVLLNAVKYTPAGGSITIAAREVMNIDIPEPIRSTLSDNRRYLLLSISDTGVGIRPEDLPRIFDRFFRGENLLKVEAGGTGLGLSIVKPLVELLGGRIWVESTVGVGSTFSIIMPIAGEHA

SEQ ID NO: 16257 - protein, 243 aa, Chloroflexus aurantiacus
MTDRLRLYLSRQASSLPRYLAEQVLQSVCGWVPGLVGIGLRALAYRALMQIEGIVAIEDGVRIRFADNVRLGRGVYLDHGVYLHACPGGISIGAESMVMKNAILHVYNFRNLPHSHITIGQRSLIGESCILRGQGGITIGDDVYLGTLVQVLAVNHVFHDTTRPISAQGITAQGITIGDGSWIGSGAIILDGVRIGRNVVVGAGAVVTKDIPDYCVAVGNPARVVRDLRADPLPHERLTVPVY

SEQ ID NO: 16258 - protein, 498 aa, Chloroflexus aurantiacus
MSTPRVFHNLIGGEFVPAQSGKTFERRNPADTRDVVGIFADSDERDVHAAVEAAKAAFPQWSKVPAPKRGEILLRAAELLQARKEQYSRDLTREMGKPLFEAGGDIVEAIGMAQYAGSEGRRMHGVTTPSELPNKFQMSIRQPIGVVGLITPWNFPMAIASWKMLPAIVCGNTVVIKPGEDASVSTYNLVQCLMEAGLPPGVVNIVTGYGPRAGQPLVEHPDVPVISFTGSTETGRLVYELGARRIKRVSLEMGGKNPLIVMPDADLDLALDGVLWAAFGTTGQRCTATSRLIVHRAVAKELVERIVARAQSLRVGNGLDPATEMGPLVNEKQLQRVLNYIDIGKQEGATLLCGGYRLTGGDYDYGYFIAPTVFTNVTSQMRIAREEIFGPVLSVIEVDSLDEAVAIANDVAYGLSSAIYTRDINAAFRAMQALQAGIVYINAPTIGAEIHLPFGGVKATGNGHREAGPTMLDVFSEWKSVYIDYSGALQRAQIDNAD

SEQ ID NO: 16259 - protein, 1001 aa, Chloroflexus aurantiacus
MLAIDSLLNGHYRITVALDAYPDAGLYRAIDQRSSLRVLITALPQPNQAAVDDVLRLARELAQIQMPGLLALRDYFVLDQVCYLVADDPGGSDLERFARERGSPLPESETLAIVDRLLMVLDRLHHHQPPLLLGDLRTCDLWSSPEGGLSLAPFACVRHIGAETTPYRAPELYDHSVEPAQVSDIYAIGAVLYHLLTGWPPPPANQRQSGMPLNSPRALNPQVSVLAEQLTLRALEMKPANRYQRASEMRSALETVRLMAGRPMGATAPIEKPVAPSATVPAAPPPQPATIATAAPATTLPPAPPPTTTAAPAAGVAAPTAPPRPLISTSCLLAIVGGLAVVAVGVCVLLAVLVGLYMTNASLFGLPGNTVATQSTVAPAPTTNEAPAVDLLQQVNAITQTAQLREDSLGAAAYSPDGLLVAVAVGSAIQLRDASSFLVQATLSGHEGDVSSLAFSPDGAILASGAQDDPVVRLWDTGTGREIAQLRGHSDWIRSLAFSPDGRLLASASVDQTIRIWEVTSGQTTAILRGHTDLPGNVAFSPDGQWLASASRDGTARLWDVSSGQQIDAFSFSAPVDPTTNAPFWLTGIAFSGDGRQIAVGSVNGNVYLLDAATGNVQRELRGHDGWVVIRGVAYSPDGRLLASASLDGSVRLWSPTSGAERGVLQQRGLRLLGLSWSPDGTRILSSSDMGGNLVIWDVESTQVLQSFQVTQGVVTGVRYSPDGQRLVASGANGAVRVHMLDSGRTTSLDGGAATAQYIDFIGDAEVVAISEAGEIVTIDLTGSRPNEQLSGMNGFPLNLTVSPDRSMIAVGNEQGEVYLWETSSRQFLRRLSGLSGPIYSLAFSDNGAYLAAVTNQPADAPQIAVWEMARGGQPQILRGHNGPVTSLIFVNNLLLSASSDGLLRVRDVTRNNNEVLQIEVPQNWGWFTSLAVTPDHTLLIAGTISGHLLFYRLDDGTLLREIDLAEYGAVLAVAVTSDGTQLAVSTRDEGILLFDLMPDR

SEQ ID NO: 16260 - protein, 425 aa, Chloroflexus aurantiacus
MMLLEWMLMVATIALAVGFIVSMYRRHQKSHSSLVDHPSPPGTQEHSMISSARSETITSDSHLALLAIHRQPLFLALAAAIDTGVIVINTERRIVFHNDTALHLLATQSPMQDSGLITLLRDHQADQLASDVLSDGEHRELTIRPIATGRTLHLHYVPLREGGGKPVGALITIRDLTQISMLERARRDLVANVSHELRTPLASLKLLVETVQSAPPPDIASRMLEQMAQEIDAVTQLVDELHELSRLESGRVSLKLEPLPVWPVIERAVERIRPQADRKQQVICVEPAADLPLALMDGDRIGQVLLNLLHNAVKFTPEGGTITVAAEVLTLRDDEQPSRPDRPPHPAGTWLLIRVSDTGIGIPNRDIQRIFERFYKVDRARTRHAGGTGLGLAIAKHLVEGHGGRIWASSQEGHGSTFWFTLPAA

SEQ ID NO: 16261 - protein, 408 aa, Chloroflexus aurantiacus
MPELRRVALFTNEYPPYIYGGAGVHVEYLSQALSRMVPVEVRCFGDQHVDTANLKVRGYPRWEEARQNTDPRFAGAVDAVARSLAMAKDTLDASVVHCHTWYTDLAGLFASKLWGIPYVLTIHSLEPLRPWKVEQLGNAYHLSSWIERTAIEQAHAVIAVSKETRADILRLFNINPERVHVIYNGIDLNEYRKTSATDALERYGVDPTRPFVLFVGRITRQKGIIHLVNAIPHIDPTAQIVLCAGAPDTKEIGIEMEERVAAVSAHRPGVIWIREMLPRQDVIQFYSHAAVFCCPSVYEPFGIINLEAMACETAVVASAVGGIKEVVIPEETGLLVDPNLKPGSFDPVDPAAFSADLAAAINRLLANPDLRYQFGQAGRRRVEQVFSWDAIARQTIELYQAVIESFAG

SEQ ID NO: 16262 - protein, 322 aa, Chloroflexus aurantiacus
MLKMSSPNPITAALAQRPLLILDGALATELERRGCDLADPLWSAKVLIENPSLIQAVHADYFAAGADVAITASYQATIPGFMARGIAPDQAILLLQRSVALAQAARDQFWADPANREGRLRPLVAASVGPYGAFLHDGSEYRGNYGLSVAELIEFHRPRMAALAAARPDLFACETIPCLDEARALVALLPEFPHLTAWISFSARDGAHTAQGEPIAECAAEIAAHPQVAAIGVNCTAPRFLPDLIRAVQAVTDKPIVVYPNSGEVYDPVGQCWIGTTEIDDFVAQARQWYAMGARLIGGCCRTTPDHIRALAAWAAAGVNHD

SEQ ID NO: 16263 - protein, 304 aa, Chloroflexus aurantiacus
MTTTTTRVEQPVLFAGLTPTDLTMLLVVLIWGANFSIVKAALTEIPPLVFATLRFTSASVLLVGFMFWREGKRALPDRRTFWKLTWIGVVGNTIYQALFTYSLTMTTAANGSLIIATTPALVALAAALLGIERIRRVMAVGIALAISGVALVVAERGLSLGGQGLLGDLLMLGAAFCWMMYTLGVRTLGQGLSPLAITTWTMVTGVPGMILISLPDWSTVVWDQVSLQAWLALAYSTLLALVLAYVLWNNSVRVAGSARTAIYGCAIPLVATLIAWPLIGEQPTWVQGIGGLLIVSGVLLTRRP

SEQ ID NO: 16264 - protein, 279 aa, Chloroflexus aurantiacus
MGIPSNLCETIYLWYDTACRDWLEEELMEPPFIGKVALVTGAAAGIGRASALAFAREGAKVVVADVNVEGGEETIALCRALNTDAMFVRCDVSQRDEVERLIALAVDTFGRIDFAHNNAGIEGVQAMLADYPEEVWDRVIEINLKGVWLCMKYEIRHMLKQGGGAIVNTSSVAGLAGSRGVSAYVASKHGIVGITKAAALEYARNGIRVNAICPGTIHTAMIDRFTQGDPQLLAQFAEGEPIGRLGSPEEVANAVIWLCSDKASFVTGATLAVDGGRLA

SEQ ID NO: 16265 - protein, 248 aa, Chloroflexus aurantiacus
FVTFDCSRLDLYGTIVQQISAALNAARLYRAATEGRRLSEEANQLKSRFLSMVSHELQTPLNLIVGMSDLLLRESAEGTQHLPLQVRHDLKRIYDNARHLSRLIGDVLDLTSSDAGQLRLVCDVVDLGQVMRAVADIGQQMAADKHLIWHDAIPAEGPWVWGDRTRLQQIALNLVVNAIKFTNRGSVSLTVTTEADAVTVTVRDTGIGLSPEEQARIFGEFQRTERSIERGYSGIGLGLAICKRLVAL

SEQ ID NO: 16266 - protein, 246 aa, Chloroflexus aurantiacus
MRLSGKVALITGAGQGIGRATALLFGQHGAKVAVADINEEAAQATAQAIVDAGGEAKAFFMNVGQAASVEAAVKAVVEWAGRIDVLVNNAGITRDARMIKMTEEQFDAVINVNLKGVWLCTKYVAPIMIEQGGGSIINAASIVAFEGNFGQTNYVATKAGVIGMTKTWAREFGPSGIRVNAVATGFTQTEMIAHVPEKVLEEFKGRTPLRRLGTAEDMAYAYLFLASDEASFITGEVLPVDGGLTL

SEQ ID NO: 16267 - protein, 242 aa, Chloroflexus aurantiacus
  unsure (1)..(242): unsure at all Xaa locations
MIEPSLHPLKQQLDVSDPLAALKAEVTRLRLQNHFLRTVVNEMTSGVIVADAQPDYPITFVNRAFCTITGYAPEEVIGRHCLFLQGPGTDQAAVTRICEAIAAARPVHERLLNYRKDGQPFWSQIAISPVRDDQGRVTAFIGLQTDVTAQVLVEQALAEREQKTPRSAIRWLRSGDGNLIWSPTPVCPQRFGILSADGELQPICLWCFPQNHFGSISVXXPPIDFSFPHGHRVIDPRKRIMG

SEQ ID NO: 16268 - protein, 392 aa, Chloroflexus aurantiacus
MLSKATPESEAMIEQLLAAARVRGYITHADILATFPNPEHDIAEIDQLYAMLQAEGIKVIESSDELDGPTDFEPDPDADLIADLPDLGDIAFDDPVRMYLQEIGQVPLLTAEQEVELAKAMEAGAAARQRLDREEYTSARERFELERAVQQGQDARHHLIQANLRLVVSIAKKYTSYGLTMMDLVQEGNIGLMRAVEKFDYKKGHKFSTYATWWIRQAITRAIADQSRTIRLPVHMGEAISQVKRTSHRLQQTMQREPTPEEIADAMGISAGKVRRTLEASMHPLSLEMPVGQEGEGRMGDFIEDDRISTPAEAAAASLLREQLEEVLMKLPERERKIIQLRYGLKDGRYRTLEEVGIEFGITRERIRQIEAVALRKLRHPHLGKKLRGYLD

SEQ ID NO: 16269 - protein, 383 aa, Chloroflexus aurantiacus
MLGLCTAPRVPTSHTAIIARSLCLPAIVAAGTAVLDIEDGTPAILDGYSGRLYLRPSAADVEAARALRAGLDQEQAVAFATRHQPAITRDGVHIEVAANVNRVADVVRALENGADGVGLMRTEFLFLERDSAPDEEEQYQAYRAMVEAMNGRPLIIRTLDIGGDKEAPYLNIAREDNSFLGIRGLRLCLRRPDLFEPQLRAIYRAAMHGPLKMMFPMVATLEEVQQAKAIAERIRAELNAPPVEIGIMVEVPSAAMLADVLAQEVDFFSIGTNDLTQYVLAMDRLHPDLARQADSLHPAVLRTIARTVEGAASAGRWVGVCGGIASDPLGAAILVGLGVQELSVSIPSVATIKAHLRGLSAADLRDLARRALACRNAAEVRAL

SEQ ID NO: 16270 - protein, 114 aa, Chloroflexus aurantiacus
MTALINQRGGSGTGMYVKLFVGNLAWSVDDATLEAFFQDYGDVRSARVINDRETGRSRGFGFVEMEVADVATVISQTNGRPINGREIRVNEAEDKGSRGPRSGGDRGGFGGRRY

SEQ ID NO: 16271 - protein, 298 aa, Chloroflexus aurantiacus
MQQTGDTGTTTYDLRCTTLRDLDASPPGRIFVLRDITLFKQAAQALQEAKEAAEAASQAKSAFLSMMSHELRTPLTAILGYSEFLREDLLNRDLHSLTSDLDRIITAGRHLLTLINDILDYARLEANAVTIHPEPVHMSTLINEVVMTLQGLAKQGQNTITVTVEPDLPPVLADPVRLRQVLLNLVGNACKFTGQGEIRVHCYRSTTAEIQIDVSDTGIGIAADQLQHLFKPFVQVDNGPTRRYGGTGLGLAICQRLCQVMGGAILVTSEPGRGSTFSVRLPITGVPSAPCEVSQEDG

SEQ ID NO: 16272 - protein, 343 aa, Chloroflexus aurantiacus
MTWDQGLHKSTTVLSDDQGTRELTYLEAIRAALRYEMQRDPRVLVMGEDIGVYGGAFKVTQGLIDEFGEDRVIDTPMTELAMLYAAIGMSFEGFLPVVEMQFADFISTGFDALVQFAATNHFRWRQPVPITVRAPGGGGLRAGPFHSQSNEAWFIHTPGLKVVAPATPADAYGLLLSAIRDPNPVIYYETKYLYRSLKGMVPEGDAPVPIGQAALRRTGEEVSIITYGAMVQEALSAAQTLEQEGHSVEVLDLRTLKPLDEDAILTTARKTGKVLIVHEANRTCGVGGEVAAIIAERAFEYLDGPIIRLAAPDTPVPYSPPLEDAYRPNATKILAAARDLLAY

SEQ ID NO: 16273 - protein, 463 aa, Chloroflexus aurantiacus
MVTWRPDPTFYPSPRMAVKAPAEKLAYVVRLNPMANGKPDAMCVVDVDSQSSTFGQVVGVTDMPYTGGELHHFGWNACSSMLCPNAPHPHVERRYLVVPDIRSSHITILDTKPDPTQPKVVKVIDPNELAERTGYARPHTVHCGPDGIYISALGSPEGEGPGGIFILDHDNLEVLGRWEIDRGDQYLHYDFWWHLGYDTLLTSEWGTPRMVESGVLGDELLAGKYGHRLHVWDLYRRRHLQTLDLGAEYQMALELRPAHDPTKAYGFMNCVVSLKDLSASIWLWYRDNGSWHLKKVIDIPAEPASEDQLPPILKPFKAVPPLVTDINLSVDDRFLYVSCWGTGELHQYDVSDPFNPRLTGKVQIGGIVRRAGHPATSAELNGGPQMVEISRDGRRVYFTNSLYRAWDEQFYPDGIKGWMVKVDVNPDGGMQFDPNFFVDFGEQRVHQIRLQGGDASSDSYCFP

SEQ ID NO: 16274 - protein, 590 aa, Chloroflexus aurantiacus
MLRKSRSPASLSLQAHQDFTKLPCSRRKQVMTKKWVYLFREGNASMRDLLGGKGAGVAEMTRTGVPVPPGFTITTEACNAYYENGQQFPEGMWEQVLEGLKDIEAQTGKRFGDPSNPLLVSVRSGAKFSMPGMMDTVLNLGLNQQTREGLARLTNNPRFAADAYRRFVQLFGKIVLGVDGDRFEHEMDEAKGHGQRQDTDLTTEELLALAEKFKAIIKEDVGVDFPEDPFEQLRAAIAAVFRSWNGRRAVDYRRVNKIPDNLGTAVNVQAMVFGNMGNDSATGVAFTRNPSTGEPEIFGEYLVNAQGEDVVAGIRTPQPISKLAQEMPEVYEQFHQIAKQLERHYKDMQDVEFTIERGKLWMLQTRTGKRTGAAAVKIAVDMVNEGLIDRATAVQRVDPHALDQLLHPMIDPAARKDAHPLTVGLPASPGAASGKVVFDPDEAEELAKTGEKVILVRVETAPEDFHGMVAAQAILTARGGMTSHAAVVARGMGKPCVAGAGDLRISYADQLMTVNGTTIRKGDWITLDGGSGEVFAGKMPTVEPELSGDFATLMSWADEFRKLGVRANADIPRDARVARQFGAEGIVYAG

SEQ ID NO: 16275 - protein, 334 aa, Chloroflexus aurantiacus
MESGHRHWPPGTQWYLSRVKMTPLATLRFAELCCDHLPPGVLNIITGFGDVGRELVVSPRTQMIAFTGSFATGREIARLAAERVKKTHLELGGKDAFIVAEDADLDVAVPGVAWAALLNAGQVCTSTERVYVHESIARPFTERLVEFVRSLRLGPGMDPDTDIGPLIGEKYRAKVEDHVEEARARGATILTGGRRPPQFSRGFFYEPTVLTNVDHSFRIMREETFGPTIPIMTYRTFDEAIELVNDCDYGLGANLYTNDPRKVKQYYEEVKAGTCWVNDPLTDNDAGPFGGMKFSGGARELGEEGLEEFLETKHVHWDFTMVRKPWWYPYGKGK

SEQ ID NO: 16276 - protein, 354 aa, Chloroflexus aurantiacus
MSGTWLVNWPSAVMRLIFWVGSGIRRETAPGVRVLTFPFISRRFWQAFPLLRRAYAEAKLLERLTMAVAALPTLVREKYQIIHLQKPYDLAPALLARRLSGARVILGCHGEDFYRGDTWLARRVDAAVSCSRFNAQTIAGRYGFMPEVVFNGIDTSLFRPQPPDPTLRERLGVSSTVPLLLFVGRLQPWKGVETAIRALCHIDQAILVIAGDGEDRPRLAAIARELGVSERVRFLGSVPRQHLPALYATVDLLLATSYASETFGIGPVEAQACGLPVVATRFGGFPEVVAEGQTGLLVPPRDPAALAAAVNSLLSDPARRAALAAAAPAWAAQFAWPAVVDRIEAVYRAVLQTN

SEQ ID NO: 16277 - protein, 127 aa, Chloroflexus aurantiacus
MADSDILLIEDSPSQALNFRLMLERAGYQVQVAPDGLTGWRTARTQLPRMILLDIDLPALDGFQVLSRLKRDQQTRNIPVVMLTHRDRIDSVQRALDLGANDYLFKDDVPYELLNVVSQILALSGQE

SEQ ID NO: 16278 - protein, 449 aa, Ralstonia metallidurans
MSSALQDIRRITHLAAPVLVGQLAVIAFGVIDTIMSGRASATDLAAVGLGGSIYVTVYVSLMGVLQALAPVAGQLYGANRSAEIGAEVRQAAWLGVALAIPGMLLLLFPAPLLEFAKAPPELVEKASHYLHIGAYGLPAALGFRIYMALNNALSRPVMVTVLQIAGLALKIPLNAWFIEGGYGLAPMGGPGCALASTLISWIWFLSGLAILLRGAAYRSLEIFTRWEWPRWDRIQPLLRLGLPMGLTYLIEITSFTLMSIFITRMGTDTLAGHQIIANLSAVAYMMPLSLSIATSTLVAQSIGARDMAAARRIGWRGIRLGAGLALLTGTLLWLLREPLLHAYVSDPAVIAKALPLMLFVAFYQAFDAVQVMSAFILRAYKIALIPTLIYAGSLWGVGLGGGYVMGFGLIDALPAFTRGASGFWLANSISLAIAGTLLVRYFMRVSRVG

SEQ ID NO: 16279 - protein, 339 aa, Ralstonia metallidurans
MEHTIALQFEDGVTRFITCGDNETLSDAAYRQQINIPLDCRDGACGTCRGLCESGHYDLPESSYIEDALTAEEAAKGYVLACKTRPRSDCVIRVPASSAACKTGVTRFEGAIAAVAPLSDSTIGFSIDLDDPAALSFLPGQYVNVEIPGSGLTRAYSFSSPPGASQAAFVVRNVPQGRMSGFLAGEAQTGQRMAFSGPFGSFYLRSVTRPVLFLAGGTGIAPFLSMLDVLAASGSTHPVRMVYGVTHDIDLVATERLEAAAASIDGFTYRTCIADAASTHERKGYVTTHVDPTWINHGDVDIYLCGPVAMVEAVRDWLRDAGITPANFYYEKFSASAEA

SEQ ID NO: 16280 - protein, 297 aa, Ralstonia metallidurans
MQAKDRLLALAIIVVWGVNFVVIKVGLVGVPPMLLGALRFCLVAFPAVFFIPRPRIPLRMLVAYGATISLGQFVFLFYAMAVGMPAGLASLVLQSQVFFTVAIAGFWLGEPVRWHNIAGMAIAACGLALIGSGAAHGPGGMTLAGFLLTLCAALCWATGNIVSKKIGPVDLLGLVVWGALIPIVPFALLSLWFEGPARMTQALTNISGMGVFAVCYLAFCATLFGYTMWGRLLTRYAASKVAPLTLLVPVVGLVSAHLLLGEALALTQWAGALVVMAGLLLNVFGGRLWAGRMLAGR

SEQ ID NO: 16281 - protein, 271 aa, Ralstonia metallidurans
MPQHILTRPTEASMLKGKTALVTGSTSGIGLGIAQALAAQGANIIVNGFGDVDGAKAEIAKSGSGIQVGYHGADMSKAAEIEDMMRYAEKDFGGVDILVNNAGIQFVAKIEEFPVDRWDAIIAINLTSAFHTTRLALPSMKAKNWGRVINIASTHGLVASAEKSAYVAAKHGIVGFTKVTALETAQTGVTANAICPGWVLTPLVQKQVEARAQKEGIPVEQAKRELVIEKQPSGQFVTPEELGALAVFLSSEAARQVRGAIWNMDGGWVAQ

SEQ ID NO: 16282 - protein, 261 aa, Ralstonia metallidurans
MGLSINLEGKVALVTGASSGLGTRFSNVLAAAGAKVVLASRRVERLKELRASIEADGGSAHVVQLDVTDPDSIRAAVAHAETEAGAIDILVNNSGVSTTQKLTDVTADDFDFVFDTNTRGAFFVAQEVAKRMIARAKGAEKLGNPLPQARIVNIASVAGLKVLSQIGVYCMSKAAVVHMTKAMALEWARHGINTNAICPGYIDTEINHHHWDTDAGQKLIQMLPRKRLGQPEDLDGLLLLLASDASRFINGAVVTADDGMV

SEQ ID NO: 16283 - protein, 247 aa, Ralstonia metallidurans
MFTRLKEDIDTIMLRDPAARSRLEVLTCYPGLHAVVFHRVANACWRGGFHWLGRWISHWSRFLTGIEIHPAVKLGRRVFIDHGMGVVIGETAEIGDDCTIYQGVTLGGTSLYKGQKRHPTLGVGVVVSAGAKVLGGFEVGAGARVGSNAVVLKPVPAGATAVGIPARIIMPDAPSTQQGAKQEFSAYGITPNADDPVSLALKSLIDNAAKQHDRIEAVLAALDRLGEHLENTPNDRFDASELRKLMK

SEQ ID NO: 16284 - protein, 338 aa, Ralstonia metallidurans
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 16285 - protein, 306 aa, Ralstonia metallidurans
MSERPTYEVPAATPGATPNTQWLRVAPALFLLLWSGGFVFLKLGLRHADPLTFLALRYACVVGLLIVPCLWIRPAFPPGIKPWLHLGMVGLLIQAGYFSFTYLSLKHGMSAGAVALVTSQQPILIGLLAPAIAGERVDRVRWLGLALGVTGAVIVITSRSSIDVATPAGLIFALLALLAMTGGTLWEKRFGTTVHPVASNLVQYAVGLVVTAPLAYALEPMHVAWTPELFGSLAYLVIGNSIIAISLLLAMIRHGEASRVSALFFLVPPMTAVVAFAVLGESIPLAAWPGMAMAAIGLYLVMGRRS

SEQ ID NO: 16286 - protein, 425 aa, Ralstonia metallidurans
MSKVAEIRGLEVLDSRGNPTVEVEVVLDDGAVGRAIVPSGASTGAREAVELRDADPRRYLGRGVLRAVQAVNTELCEALLGRDAGDQPEIDTIMIDLDGTPDKRRLGANALLGVSLAVAHAAAMSNGLPLFAYLGGERASLLPVPLINVINGGAHADNALDFQEFMIVPAGAPTFTEAVRASAEVFHTLRAMLKAAGYTTNVGDEGGFAPEFHAAEEALDILVAAIAKAGYRPGEDIALAIDPAASELYVNGSYVYQGEGVERSREEQVAYLVRLADRYPIVSIEDGMAEDDAMGWQLLTRQLGKRCQLVGDDVFCTHPTLLRQGVEQGMANAILVKANQIGTLSEMRETVRVAHGYAYSAVMSHRSGETEDVTIADLAVALRCGQIKTGSMSRADRTAKYNRLLRIERELGSRAEYAGALLRRR

SEQ ID NO: 16287 - protein, 303 aa, Ralstonia metallidurans
MVCAKRSRLGRNLSPRHSAPVATQPLSRSFASAWRSPGPPQAPYPRARPRNEGTAMNTTQRTALVTGGNRGLGAAIARALHDAGHRVIVTHTPGNTTIGQWQQAQATQGYSFAAYGVDVSDYESTQELARRIHADGHRIDILVNNAGITRDATLRKLDKAGWDAVLRTNLDSMFNVTKPFIDPMAERGWGRIVNISSINGSKGQFGQTNYSAAKAGVHGFTKALAQEVARKGVTVNTVSPGYLATEMVMAVREDMRQKIIDAIPVGRLGQPAEIAALVAFIASEAAAFMTGSNVAMNGGQHMS

SEQ ID NO: 16288 - protein, 429 aa, Ralstonia metallidurans
MSAIVDIIGREVLDSRGNPTVECDVLLESGVMGRAAVPSGASTGSREAIELRDGDKSRYLGKGVLKAVEHINTEISEAIMGLDASEQAFLDRTLIELDGTENKGRLGANAMLAVSMAVAKAAAEEAGLPLYRYFGGSGAMQMPVPMMNIVNGGAHANNSLDIQEFMIMPVSQTSFREALRCGAEVFHALKKILSDKGMSTAVGDEGGFAPNFSSNEECLNTVVQAIEKAGYKAGEDVLLALDCAASEFYHEAEGVYSLEGEGLKLTSTQFADYLANLCDKFPIVSIEDGMAEGDWEGWKTLTDKLGKRVQLVGDDLFVTNTKILKEGIEKGIGNSILIKINQIGTLTETFAAIEMAKRAGYTAVISHRSGETEDSTIADIAVGTNAGQIKTGSLSRSDRISKYNQLLRIEEDLGDIATYPGKSTFYNLR

SEQ ID NO: 16289 - protein, 214 aa, Ralstonia metallidurans
MLRIWGRLSSINVQKVVWCARELHLDHERIDIGNQKGELDTEAYVRLNPNRLIPVIEDFRDTDVAGEPFVLWESNAIVRYLCARYGEDTLWPSDVKARASADRWMDWQTTTFSPAMVQAFLQLVRTPADKRDEAVIEKSCERTEPLAKMLDDALEGREFIGGDRFTMADVSLACAAHRWMGMPKAHTARPNLERWLAAMRARPAATGILELPLK

SEQ ID NO: 16290 - protein, 112 aa, Ralstonia metallidurans
MKQITAIIKPFKLDEVREAMADVGVTGLTVTEVKGFGRQKGHTELYRGAEYVVDFLPKIKIEVVVAENQLDTVLDAIVKAAHTGKIGDGKIFVTEIERVIRIRTGEQDEAAV

SEQ ID NO: 16291 - protein, 222 aa, Ralstonia metallidurans
MTTTAVSSGAQDAGFEDATYRKVSWRLVPFLLLCYVVAYLDRVNVGFAKLQMLNDLKFSETIYGLGAGIFFIGYFIFEVPSNVILHKVGARIWIARIMITWGLISAAMMFVTTPMMFYVLRFLLGVAEAGFFPGIILYLTYWYPASRRGRTTTYFMTAIALSGVIGGPLSGWLMQSFDGHNGWSGWQWMFLVEGIPSILVGLWVLAYLDDRITHAKWLTDDE

SEQ ID NO: 16292 - protein, 234 aa, Ralstonia metallidurans
MEMLVHRRWESLDAADHGWLRAKHHFQVDAAGNPAHHPLGSLIVWNDDEIAVGAGFPLHGHRDMEIVTYVRQGTLEHRDTLGSIGTIRAGEVQVMSAGRGIRHAESNRGSEPLRLYQIWLLPRERGGDPRWETRPFPEAGRFGRFAVLASGFPGDGDALPIRANARLLAATLGPGDRLTHSFAPHNNAYLVVASGRIAVDGEFVGLRDGVAITNAASIDVAALEHSELVMVETR

SEQ ID NO: 16293 - protein, 637 aa, Ralstonia metallidurans
MTYTLLNKIDDPADLRKLDRRQLDTLAEELRAYVLESVSQTGGHLSSNLGTVELTIALHYVFDTPNDRVVWDVGHQSYPHKILTGRRDRMSTLRQYGGISGFPRRAESEYDTFGTAHSSTSISAALGMALGARTRGEKRVGIAVIGDGAMTAGMAFEAMNNAGVYKDLPMLVVLNDNDMSISPPVGMLNKHLARLMSGQFYAATKKGIEKVLSVAPPVLEFAKRLEEHAKGMVVPATLFEEFGFDYVGPIDGHDLESLVPTLQNIRQRALEGHGPQFLHVVTKKGQGYKLAEADPILYHGPGKFNPAEGIRPSAKPSRKTYTQVFGEWLCDMAAADKRLIGVTPAMREGSGMVEFEKRFPDRYYDVGIAEQHAVTFAGGLACEGLKPVVAIYSTFLQRGYDQLIHDVALQNLPVVFALDRAGLVGADGATHAGVYDIPFLRCIPNMMVMVPADENECRQLLTTAFQQDCPTAVRYPRGAGVGVATQPELTALPVGKGEIRREGHARAGQRVAIMAFGSMVHPALTAAEQLDATVANMRFVKPLDVELVKQLAANHDFLVTVEEGATMGGAGSAVLEALAEAGIELPTLVLGLPDKFIDHGDPAHLLSLCGLDAAGIERSVRERFSLTAQPVKVASVA

SEQ ID NO: 16294 - protein, 315 aa, Ralstonia metallidurans
MSSLICGSVAYDTIMTFDGRFREHILPDQIHMLNVSFLVPGMRREFGGCAGNIAYTLKMLGGDPIVMATVGQDAEPYLQYLRNLEIRTDHIRVLPETFTAQAMITTDLDNNQITAFHPGAMGQSQLNRVQDALATGNRPAVGIVAPDSREGMLHHAQQFAAEGIPFIFDLGQAMPLFNGEDLRQFIELASYVTVNDYEAQVLLSRTAWTSAEVAAKVRAFIVTHGERGASVFADGKQYAIPAVPAERVVDPTGCGDAFRGGLLHGIENGMDWETTGRLASLMGSLKIAQQGPQNHWMSCDEIGSRFQSVFGYRYA

SEQ ID NO: 16295 - protein, 386 aa, Ralstonia metallidurans
MPRQKTVSSGVVSRTRRPKQPEGKAGVARPDGGIDTEMFGDDPAAELVPVADEPIAPVSRVGLRNTDLNADDADHDDGDEEESEEDEEEGSSETTAEPDDFRTVLHTELAADTVQHYLNRISIKPLLSAPEELHFSTLAKGGDFSARQVMIERNLRLVVSIAKGYLNRGVPLLDLIEEGNLGLMHAIEKFDPSRGFRFSTYATWWIRQSIERAIMNQARTVRLPVHVIRELNQVLRAKRHLEKGGTDGRDASLEDIAHLLGKTPDEVQDVLALNEHTTSLDTPFDLDPGSSLLDFLSDEHNAAPDQEVAHRELENLMKLWLARLSEKHRYVVERRFGLNHIEPATLEELAEEMGLTRERVRQIQQEALVKLKRHFASQGVRKDAVL

SEQ ID NO: 16296 - protein, 249 aa, Ralstonia metallidurans
MSKTLENQVALVTGASRGIGRAIALELARQGATVIGTATSESGAAGISEYLAGEGLKGGGVVLNVNDAARCEAVIDEIIKANGGLNVLVNNAGITQDQLAMRMKDEDWSAVIDTNLTAVFRLARAVLRPMMKARGGRIINITSVVGSTGNPGQMNYAAAKAGVEGMTRALAAEIGSRNVTVNCVAPGFIDTDMTKVLSEEQHAALKTRIPLGRLGQPEDIANAVAFLAGPQAAYITGTTLHVNGGMYMN

SEQ ID NO: 16297 - protein, 392 aa, Ralstonia metallidurans
MQRITILGATGSIGESTLDVVRRHPDRYSVHALSAHRQVDKLAAACVEFRPARAVVGSAEAARELEAKLRAAGVPTEVSYGETALESIAEDAGTDAVMAAIVGAAGLRSSLAAARAGKRVLLANKESLVMSGGIFMDAVREHGATLLPIDSEHNAIFQCLPTSDPRYGAGVSKVLLTASGGPFRTRDPSTLHDITPDQACAHPKWVMGRKISVDSATMMNKGLEVIEAHWLFGAPAEKIEVLIHPQSIVHSMVAYADGSVLAQLGNPDMRTPIAYGMAYPERIDSGVTPLDLTVAGGLHFETPDLERFPCLGLAFDALRAGGVAPAVLNAANEVAVEAFLNGKIRFTDIARVVATVLEQPADGSADTLEGVLAADSAARRGAQAQLGSLAGR

SEQ ID NO: 16298 - protein, 360 aa, Ralstonia metallidurans
MTEAATFHLEMTRQIRAPRERVFDAFTDQAALAAWHCPRGMRVLEASADARVGGRYRLVMGSRDGSQHMVGGEYQKIDRANFLAYTWQWEGGELPEGTRTLIEVTLTDKDGGTLLHMRHSGFPDTATRDAHTSGWQSVFNRLSDYVDAEGSAGTVTVYGDGRSTYVRTVRMALAEKGIAYKLDPLTPRDPELLKHNPFGRIPAFTDGPLEFFETRAILSYIEEAFDGPSLISQAGPTARARCEQWISLINCHAYDAMVRRYVLQYVFPSGENGQPDRKTIDAALPDIAKQLDALEHAYGGRDFLAGNTLTMADLFFAPIVEYLGRFPESAAMLESRPNIRRAHAAMRARPSYAATQPNFG

SEQ ID NO: 16299 - protein, 368 aa, Ralstonia metallidurans
MKTKAAIAWKAGAPLTIEEVDLDGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPAREAMARKFGMTHFVNPKDVDNVVDHIVQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 16300 - protein, 453 aa, Ralstonia metallidurans
MDTPDLPPNPAGPSGLLGIDRSETPAVVAGFLFFFCLFASYFMLRPVRETMGIAGGVQNLQWLFTATFVVMLVAIPFYGACCKWLPRRRFVPWVYAFFIANLVAFALVTRALPDSVWLARVFYVWISVFNLFVVSVAWSLMADVFRPEQAKRLFAIIAAGASAGGLAGPVLGAGLVGHIGLTGLMLLSAALLAATLPGVGYLFAWRRRYGAGAPGSETASAADPAQPVGGGLWAGLSLVLRSRYLIGISLFVILLATSSTFLYFEQARLVAATFHSRAQQTQVFSALDATVQALTILVQIFFSGRVARRYGVTALLTAVPLAVTGGFLLLAMWPTFGVLAAAMIVRRVGEYAMLRPGREMLFTVVDPETKYKAKNVIDTAIYRAGDAVSAWVKTAIDALSGHPATVALAGAVLAIVWGWLGWWLGRQHEGQLTELTVEKSSPAVLARGQTGSR

SEQ ID NO: 16301 - protein, 453 aa, Ralstonia metallidurans
MHTQSLGAAPVLPEIPSHAIPQVLPTQQEDALYRKVWLRIIPFLFICYVVSFLDRINIGFAQLQMKHDLGFSDAMYGLGAAVFYVGYVLCEVPSNMLLARFGARRTFTRIMLLWGVASVGMMLVSQPSHFYLLRFLLGVFEAGFFPGIVLYLTYWFPARRRAAVMAIFFAGVAVAGVLGGLISGWIMRDMAGVLGMRGWQWMFAIEGAPAVLLGLIAAVCLVDGPRQARWLTPAEQDYLVAQHEAESRGAGGHAHSMQALRQALANPRVYLFAFIYFALTCGSLTLSFWMPLMIRDFGIQDVVAVSLYSVIPNAIGAVGLILIARRSDRLGERHGHFLCCTAGGALALAALTLHVPSLGVSLAILSVAAVLIFAALPIFWALPPSHLPAQTAATGIAFISSIGITSGIVSPWVIGQIKAHTGSMDNALYLLAGLLLASGLALWKGVPRTPTAH

SEQ ID NO: 16302 - protein, 316 aa, Ralstonia metallidurans
MARLAPGGFRPLSRAERSIPQARLAVRRRLHTLDGLPCRSGQGLTFQRNGVAMNIDLSGKTALVTGSTAGIGFATARGLAESGAHVIVNGRSQASVDNALASLKKSYPTAQATGFAGDLTDAAVCDTLVKTHPAVDILVNNLGIFEPKDFFDIPDSDWTRFFDVNVLSGVRLSRAYAKGMAERKWGRIVFIASESGINIPVEMIHYGFTKTAQLAVSRGLAKRMAGTGVTVNAVLPGPTLSEGVTAMLKDEIAKSGKSAEEVAAEFVKAHRSTSIIQRAASVEEVANMIVYVCSPQASATTGAALRVDGGVVDTIV

SEQ ID NO: 16303 - protein, 399 aa, Ralstonia metallidurans
MDLRGKHIVLGLTGGIACYKSAELVRLLTKAGATVQVAMTEAATHFITPVTMQALSGRPVFLSQWDTRIDNNMAHIDLSREADAILIAPASTDFLAKVANGLCDDLLTTLCIARECPLLVAPAMNRQMWAAAPTQRNAAQLRADGVMILGPGTGDQACGEIGDGRMLEPEELVEDLIAFFQPKPLAGKRVLITAGPTFEAIDPVRGITNLSSGKMGFSIARAAREAGAEVLLVAGPTALDTPRGVTRTDVRSAQQMHDAVMAQLRDVDVFVAVAAVADWRPAEVAQQKLKKANDTDTPTLQFVQNPDILAAVAARADAPYCVGFAAESENLEQYGEQKRKRKGVPLLVGNIGHRTFGLDDNEIVLFDANGMTRLPRADKLSLARELVNAIGQRLPRKLV

SEQ ID NO: 16304 - protein, 260 aa, Ralstonia metallidurans
MRTIQQLFDLKGRTALITGGSRGLGLQIAEALGEQGARVVLSARKADELQTAQEHLKSRGIAAEWIAADGSRDAEIARLADEALAKLGHVDILVNNAGATWGAPAEDHPVEAWDKVMNLNIRGLFLLTQRIGKLSMIPRRSGRVINVASIAGLAGNPPGSMETIAYNTSKGAVVNFTRTLAGEWGEHNITVNALAPGFFPSKMTQGSLDRMGVDKMCEGVPLHRLGDDDDLKGAALLFASDAGKHITGQILAVDGGVSAV

SEQ ID NO: 16305 - protein, 222 aa, Ralstonia metallidurans
MRARHLPSRRTIASKDVPTMKLYVHPLSGHAHRAQLLLSLLGQPAELIEVDLMTGAHKSPEFLKLNPFGQIPVLVDGETVVPDSNAILVYLSKKLGRTDWLPEAPATAAAVQRWLSVAAGDIAFGPARARIATLFNAPYDLDDAVARAHVVLKRMDDALADRPWIAADHPTIADVALYSYTARAPEGFVDLRDYGKVRQWLARVEALPGFVPIVKSPVGLEA

SEQ ID NO: 16306 - protein, 617 aa, Ralstonia metallidurans
MNNTHPESLVALVALGSERGFLTHGEISDALPDSDFGQIQRVLEELGVQIVERTLANEPIRLEEHADALVVDEAVIEEAAAAVMQADGREARTTDPVQLYLREIGTIPLLTREDEVAIARRHEIAVTEMVAEMVSCPLVVYELLTMADEIERGEMAVDDLIDHWDEVPAAAVNVPAIEMSEAVQDDDPAPGAAGVDLEETDPVSTGASTARSSAALESEVIARLAIVRARFLDWSRQSRQQAATSDAFVALNAIRAELAVYHFSAAAVARLGQVLSTHIAAIQQAERRIAGIVIDRCGIAREQFLQTFPGHEIDLGWSEALAAERISGAADALVRAIPEIQAIQREMRVLENRAAMSLGDLKNLGQRVAKARARAQAARDEMIRSNLRLVVSNAKKYLHRGMPLLDLIQEGNLGLMRAVDRFDYRRGYKFSTYATWWIRQGITRAIADKGPTIRIPIHLVEVVGKVNRASRELFHETGEAPAPEALAARLSLSVKKVKAILDLVKEPLSLEMSVGESGDALLWDTLTDECSASPDESAMRVSLRKDLDEALANLKPREAKIVKMRYGVDAGTDYTLEEIGQQYGLSRERVRQLERQALRKLRNPDRAPRLQAHRDIH

SEQ ID NO: 16307 - protein, 277 aa, Ralstonia metallidurans
MKQVTLPGGERVPALGMGTWNIGDHRQTRADEIATLQLGLDLGLRLIDTAEMYGEGLSESLVGEAIRGRRDQTFLVSKVYPHNASRKGAAAACERSLKRLGTDHIDLYLLHWRGDVPFEETIEAFLALRQAGKVRHFGVSNLDLSDMEELWDVPGGDEVAVNQLLYNLSRRGIEFDLLPWLREREVPVMAYSPIEQARLLRSPGLKRFAQSIGKSPAQVALAWLLSRDDIIAIPKTGNRERLRENVGALDLTLSAEQLAALDELFPPPRHVQPLAML

SEQ ID NO: 16308 - protein, 487 aa, Ralstonia metallidurans
MRLVQKALTFDDVLLVPAYSAVLPRDVSLRTRLTRSIDLNIPLVSAAMDTVTEARLAISMAQAGGIGIVHKNLKPADQAREVQRVKRYESGVLRDPITISPEMKVRDVIALSQQHGISGFPVLEGKTVVGIITNRDLRFEEELDAPVRAKMTPREKLVTVAEGAPLEEAKRLMNRHRLERVLVVNGAFELRGLITVKDIQKAVENPLANKDAHGQLRVGAAVGVGPDNDERVELLVKAGVDVIVVDTAHGHSQGVLDRVRWVKQNFPQVQVVGGNIATGAAALALVEHGADGVKVGIGPGSICTTRIVAGVGVPQITAVSNVAEALKGTDVPLIADGGVRYSGDVAKALAAGAHTVMMGGMFSGTEEAPGEVFLYQGRSFKSYRGMGSVGAMKDGAADRYFQEDNTANVDKLVPEGIEGRVPYKGSVQAIIHQLTGGIRASMGYCGASSIAQWHETAEFVQITAAGMRESHVHDVQITKEAPNYHID

SEQ ID NO: 16309 - protein, 377 aa, Ralstonia metallidurans
MKQVDSTKETQKMKAAVMEKAGAPLVIHDVAIAEPGPREVRVRTAAVGLCHSDLHMMQGTYPLPLPAVLGHEVSGVVEAVGTQVSGLKAGDHVVGCLSVYCGHCSVCASGHQVLCQNPEVKLPPGKANRLRLAGNPLSQVFNLSGFAEEILVHENALVKIRDDMPLDRAALLGCAVITGTGAVFHSAKVPPGSTVVVVGCGGVGLSVINGAVIAGASRVIAVDMLPAKLELARKFGATDVVNAGDGDPVAQVMQLTGGGAEFAFECIGLKQTAEQCYAMLAPGGTATVIGLFRPDARIELPALDFLKEKRIQGSFMGSNRLSLDIPRLVELYMQGKLLLDDLISQRISLEDINEGFIAMQSGSVARSVITFPGVGGL

SEQ ID NO: 16310 - protein, 1156 aa, Ralstonia metallidurans
MQQVLDRTQESLAQAFASLARNARRQRQLYYATVGLLIAIVIVSAILLGGLAAAKQLDIRRSRLAQYVSAISLQLQSDASFLRRTTLTVAHYLNAHSDSPTDPDLLERIRRTGVAVAPDGRYTLLIPSSTQQAWGRSLPERVWQLQQIAIAALTTRLAFELDNPAYVVDANAEYAVILTPSPMSLDAVLLISEQSDPVTVLRDKIVQALQAQTGQELPRSGEQVWIGPVEDPVLHSQVMTSVAATTAGDGHRPALIASSTPVNAFLSQLKRPSGAAMLLLLNRAEDRIDISPSGSSLEVAERILSRTRRLPPDTLRLGRSGLVLVQPLRQEFGSLVYFLSYGKLFSSIYYELIAIGSLSMMLIIAIVISARYWDIHLLRHGQAEATRALENETINHILVNATPIGLCIVGQQDHVIVTSNLVADTLLGFSQGATMPARIIDALRQRPSQAFSDAFGPIAQIRVPGCANADAAQQCNSTTEAAPASKPQFLQITSAPAKYRGECVLFCAIQDVTAQQQLEQKLRSAQQATEAMMRARSNFFAAMSHEIRTPLNALLGNLELLGRSAGLEAHATRLRALQSSSEGLRRIVNDILDFSKIDAGEMKLVSAPFNPLDELESLSLSYAPMVTDRPIRFYAHLSPTLSTLLRGDRMRLAQIVNNLLGNAFKFTASGKISLSAEISRDAQGLATLVCRVRDTGDGMSQALASRVFQPFVQGETSTTAQYSGTGLGLSICARLSELMGGHISVESVEGVGSAFTVVIPFAEPAATAPPHGLTMLGGMVMVLCQETESGATLEAWLTRVGCQVHVLPASCAAHAWLCTSHPQIMVVTGEYGLDTIRSLRTVCPTNAVWITRNGPDRPAELESGIFEVSAYSHTAILAGVKAALVAPPRLVETTNRTASASENARPEAASHSPHQHGTVLVAEDNPLNRMLIAEQLETIGWASIVVNDGRQALAVLDQRVVDIVLTDIQMPVMNGYELLSAIKTKRPPLPVFAFSAVTHAGQASDWQARGFDGYIAKPVSLAELEHALHGVSSQLAVDAARSTPASTGSPTDIVAGADRERYLALLREHLQTDEPKLAGILLSRNTQALGQWAHRCAGAFLIVGATTIVKLCRAVERLCDDGNEWSPLLETEARALQAAVHDFRASPNQPEETSTT

SEQ ID NO: 16311 - protein, 468 aa, Ralstonia metallidurans
MSTLRGVSMSDMQEHKVTPYDQFNYEVPENVFPREGISANAAAAIVISDEWTDTNPMLNMSSFVTTFAEPEAREVAARNIFKNYIDHDMYPRLFAMEGRMVRWLHELWNGPKGVEPYGTCTVGSSEACMLGGLAHKWNWRQRRQAEGKDATRPNMVTGGNVQIVWKKFLRYFDVEPRIVPLKPGNYCLTAEDLDKYVDENTICVVAIAGQTFTGEDDDIQGIHDWLDAYEKRTGISIPMHIDGASGGFVNPFLYPDYKWDFRLPRVQSINASGHKYGLTPPGLGWVVFRERKIFNEELVFYVNYLGGEMPTATLNFSRNAFQVAVQYYQFLRLGFDGYKRVMQHTLDNAIFLRQQLVDSGYFDIMNTTQRIPVVAVTLNKKYKNFNEFDVSNKVREKGWVLSAYTMPPNAESVTSLRVVVRPHVNHNVAQLLANDIINACKFLEANGGNAKPPALHKHAEAQSTSLKC

SEQ ID NO: 16312 - protein, 427 aa, Ralstonia metallidurans
MATPNLPSSKPEPVSSGAWTTLWSSTFAFTICFAVWMLFAVLGIPLKKELGLNDTEFGLLAATPVLSGSLIRVPLGIWTDRYGGRIVFFVLMLLTVIPIWLISYAHTLWQLLVLGLFVGLAGGSFSVGTPYVARWFPRSRQGLAMGIFGAGNSGAALTKFVAPALILAAGTWEIVPRVYSVAMLITAIVFWLFSRSNPAHRVSSATSWRAQLAVMRDPRVWRYSQYYSVVFGGYVGLSLWMTKYYIGEYGFDMKTAAFLAACFSLPGGVLRAIGGWISDRYGAHRTTWWVMWVSWVTFFLLSYPRSDFTIHTANGPESFHIALSPTVFTILMFVVGIAFAVGKASVFKFISNDFTHNIGAVSGVVGLAGGLGGFILPILFGALADLTGIRTSCFMLMYGAVCVSLVWMHYSQRAANARPTPETLQAA

SEQ ID NO: 16313 - protein, 437 aa, Ralstonia metallidurans
MNGKATRIDLLSFKTPQMRAFHLTWMAFFVCFFAWFACAPLMPVLKGEFGLTPNQIANINIAAVAVTILVRLVIGPLCDRFGPRKTYTGLLAIGALPVLGVAFAQNYETFLFFRLLIGAVGASFVITQYHTSVMFAPNVVGTANAASAGWGNAGGGAAQGLMPLLLATILFLGVDHTMGWRVALLVPGILMLVMAVVYWRFTQDCPEGNFSELRARGIAVSGGKGGGGWASFRAASANYRVWMLFITYGACFGVEIFIHNVAATFYVDRFGLSLSAAGMAAASFGLLALFARALGGYVSDKLAMRRGLDARSLILFVFILGEGLGLLGFAHASTATTAVAAMLVFGLFTHMACGATYALVPFIDRKALGGVAGIIGAGGNVGAVAAGFLMKGLGDLQQTLTWLGVAATLAALCAIAVRFSAEHKAQEQALYDSALAN

SEQ ID NO: 16314 - protein, 499 aa, Ralstonia metallidurans
MSELKDLEYWRGRARALPIPAHAYIDGQWTSAADGATFDCINPATGEQLARVAACGAADVDRAVAAARRAFEAGVWSAMPRRERKAVLLRLAALIETHREELALLETLDMGKPIGDTMLYDIPEAARTYAWYAEAIDKVYDEIAPTDAGVLATITREPLGVVAAVVPWNYPLLMASWKVAPALAAGNSVVLKPAEQSPLTAIRLAALAEEAGVPPGVFNVVPGLGAEAGQALGRHPDVDCLAFTGSTATGKRFMEYSGQSNLKRVWLECGGKSPHIVFDDCPDLDRAALAAAIGIFNNQGEICIAGSRLYVQRGIYDTFMAKLEAHAAAMQPGDPLDPRSAMGAIVDGRQFDRVMSYVEAGQREGARLRAGGQAARADSGGWFVQPTIFECPTQSLSIVKEEIFGPVLAVTVFDTEAEAVAMANDSAYGLGAGLWTSDLSRAHRVSRRLRSGLVWVNCYMDGDITVPFGGVKQSGFGRDKSLHALEKYQDLKTTWIRLE

SEQ ID NO: 16315 - protein, 291 aa, Ralstonia metallidurans
MSAIEHLLKPHVRDIGEFTVRRLLPAATTQTVGPFIFFDHMGPVEMEPGAGMDVRPHPHIGLATVTYLFEGEIMHRDSLGSEQVIRPGDVNWMTAGRGITHSERSPDGARSAGPHLHGIQTWVALPKAHENDPPSFHHHPGATLPKLELPGVRMTVIAGDAFGAESPVRVYSRTLYVAIEMDAGASLVIPAEHVQRGIYPVDGNLEVDGETLPAEHLVVLVPGEPVTIKATMPSRVMLLGGDPTDGRRFIYWNFVASSKEAIEEAAQRWQDDQFPHVPGETERIPLPPRRP

SEQ ID NO: 16316 - protein, 311 aa, Ralstonia metallidurans
MNAVLSADQTQVTRRLPTAPQNAAANAFALTFPGTLGNLDSYIQAVHRIPMLTPEEELSLARDLRDNDSVDAARRMVMSHLRLVVSIARQYLGYGLPHADLIQEGNIGLMKAVKRFDPEQGVRLVSYAMHWIKAEIHEYVLKNWRMVKVATTKAQRKLFFNLRSHKQGSHTFTPEQIEAVARELNVKPEEVMEMETRMSGGDMALEGQIEDGEEEFAPIAYLADNHNEPTQVLEAKRHDRLQVEGLEEALTKLDPRSRRIIEARWLDVNDDGSGGATLHELADEFGVSAERIRQIESAAMKKMKGALAAFA

SEQ ID NO: 16317 - protein, 441 aa, Ralstonia metallidurans
MSIVMSGAPGAPESLPAAELAQQRNEAYRKITVRLIPFLVFLFILAWIDRVNVGFAKLQMLQDLQFSEAVYGLGAGIFFIGYFLFEVPSNLLLEKIGARKTLARITILWGLASMAMIFVKTPMQFYTLRFVLGVFEAGFFPGVVLYLTYWFPAARRARINGLFMTSFAIAGVVGGPLAGFIMSAMDGVDGLANWQWLFVIEGIPSVLAGIAVLMYLPEKPVNAKWLTQQEQTIVTRDVEAEARDPNKHSSLKDAFANARVWICAAIYFCVVSGNATIAFWSPSIIKELGVQGNLQIGLVSAIPFVAGTIAMVLNGIHSDRTGERRMHCAMATLVAAVGLTLTGFLLHSAVLALIALTIASIGILAAFPVFWSLPSAFLAGTAAAGGIALINSIGNLAGFVAPYMIGWFKTSTGQLAGGLYFVAALEACATVLVIAFIRARH

SEQ ID NO: 16318 - protein, 325 aa, Ralstonia metallidurans
MSRSACIASSLAAFSRWKRDAARGATYPRRSTRWHLISRWNRAFRRSRVRRSIDGPTNPSLHRRNVYHDLPFIQLNMPIHSLSGKVAVIIGGTGGIGLATGHALAEIGASVVLTGRDADRTASAVATLPAGNHLAAHAEVGDSATLRLLADDVQHHYGRVDILVNTSGFTRAIPHADLDALDDALIDEMFAVNWRGQFAAIRAFAPLLRANGDGLVVNVGSIAGRTGQGSNVAYCAVKAGLDVMAMSLGRALAPAIRVLNVSPGVVDTGFVPGRDSSFNERAAKTTPLRRIGQAQDVADAIVACATSLRFATGTTIVVDGGRQLG

SEQ ID NO: 16319 - protein, 355 aa, Ralstonia metallidurans
PHELAHTNHAPTPGRQPAEAAARPHLILDGAMGTMIQRYKLTEADYRGTRFADHRIDVKGNNELLLLTRPQVITEIHEQYLAAGADLIETNTFGATRVAQEDYKMADLAYEMNVEAARLARAACDKYSTPDKPRFVAGAFGPTPKTASISPDVNDPGARNVTFEELRDSYYEQGKALLEGGADVFLVETIFDTLNAKAALFAIDQLFEDTGERVPVMISGTVTDASGRILSGQTVEAFWNSLRHAKPVTFGLNCALGATLMRPYIAELAKVCDAAVSCYPNAGLPNPMSDTGFDETPEVTSALVEEFAASGLVNLVGGCCGTTPDHIAAIAKSVANKTPRTWPGQYREDTAQSAA

SEQ ID NO: 16320 - protein, 506 aa, Ralstonia metallidurans
MLRLYRRLPPHSRCPWPDVAFAARCTCRPCRPLRRRQPWPIPDWANLMRPEPSSPRAPCRSRRPPRPCPWNRLVTVPPPQHVECRLNMTDFFSRRDGILAVEQVPLTRIADQFGSPTFVYSRAALTAAYNAYAAACKGRNAHVQYAVKANSNLAVLQVFAQLGAGFDIVSGGELLRVIAAGGDPRKVVFSGVAKNVADMELALSHDVRGFNVESIPELDRLNAVAGRLGKRARVSLRINPDVDAKTHPYISTGLKANKFGVAFEDVLPTYRAAAALPNIEVTGIDCHIGSQITEVAPYLEALDKVLDVVEALEAEGIKLEHIDVGGGLGITYNDETPPDITKFATTLIDRVAARGHGHREVLFEPGRSLVGNAGVLLTRVEFLKPGAAKNFCIVDAAMNDLARPAMYEAFHRIEPVAPRNDAGVMYDVVGPVCESGDWLGRDRTLAVQAGDLLAVMSAGAYGFVMSSNYNTRGRAAEVMVDGDTVHLVRERELPADLFRNERLLKV

SEQ ID NO: 16321 - protein, 442 aa, Ralstonia metallidurans
MACTGHPDDGAWRRSRHRPPCDGRPPAGVHCLAAAGHKLPRTGTTMDLTHVTRYIAGRDTREPVCAYLYDLDDLRLRTTRLRAALPEQCALYYAVKANSDAPVLRALLGVADGFEVASFGEIERVRGVDAEVPIAFGGPGKTDAELEGALRLGVGLIHVESTLQLSRLDAVARRQGRCADVLLRANPAYGLPGATLQMGGGATQFGIDEALLPDVLAQSRTMPNVRVVGLHVHAGSNSLDADTHLALIDRHIALAKRLRDLHGLTLEWLNVGGGIGIDYQNPERHFDWDRFCHGLAALLRETAPSTRIVFECGRFISAGCGCYVAEVIDLKRNHDKWFAVLRGGTHHFRLPVSWQHNHPFQVLPNDHWDYPFPRPVVERQPVTLCGELCTPKDVLAREVPVDRLRVGDRIAFTMAGAYGWHISHHDFLSHPHPERVFIGGQP

SEQ ID NO: 16322 - protein, 293 aa, Ralstonia metallidurans
MKRVLGVYSAPRSHWVGDGFPVRSMFSYQSHGKRLSPFLLLDYAGPADFSPGQQPRGVGVHPHRGFETVTIVYKGEVAHRDSTGQGGVIGAGDVQWMTAGGGILHEEFHSEAFTRTGGPLEMVQLWVNLPARHKMTAPGYQAIVDADIPVVPLRDDAGTVRVIAGQYEGKVGPAHTFTPMNVWDMRLNQGGISELPIPSGWNAALIVLRGTVRVNVSTVAGEAQMVLLDRVGEDVSMEASTDAVLILLAGEPIDEPIIGYGPFVMNSQDEILQAFTDLNGGRFGTVAQQTTSA

SEQ ID NO: 16323 - protein, 1453 aa, Ralstonia metallidurans
MNGVRLLTRRIRWIDLLGLLRCVGFLLLMSIWHDAVAQQPIATTAQTIRVGVVQNDWPPFAIVQDGQVSGIGVDFLRAALGDRPVRIVTTTFASMPALLAAACANQVDVVLNVGETAERARCLRFSEAYFDATAAIVGRAGAAGQDAVALEQARIAVEPGSFMDERLRARFPNARFVPVKDAEGGLRAVRDNQADYYPTRQPVADYYLGRPEYKGLAVQAGYREPGGGLHFAFSPAAAALQTTVNQGLATMPQDARRAIIGRWVTPPIVASSPAGEFFLTPEERAFLQSLPVLKVAFDAGSAPYSYVDDRGRPGGMAADYLSYLGRTLGVRFQRERAAPFAQTVEALRQGKLDLMAVAVAEDPALAGLPVTRPYASFPMVIVGRQLDVAVEGLNDLTGKRVVVCEASGVEGLLRAAVPHLQLSVVSSVHAGMEAVANGKADAYVDDLATVDVELQRYFAGTLRIIGSGRQTLDMGFGLSPELGARLLPLIDRAMEYMPQVERLAIQSRYIAASYALEPSWQQVLRRIAPYLVAVIVIIGILLRSQYRLRREASARRLAKQQLQAQLDFQRTLIDAVPIPITVKDAQGRYVEVNAAFQSRAGMTRQQMVGHLPTELNVPGNRAAEALEAGSRRALETQQLQQFAVDYVDADGKQRYYLCWAQPIKRVGPEFAGVISAAVDVTEIRNAEAKAQAAEAMLVDATRHLPATAFRMRERDGVFSYEWVSGNAQQLLGRSSESLIGPANPLLGMANVEDRIAALAAAEEAKTTGRPLSADMRLLIRGQTRWIRIHAVPKTEPDGGVLWHGYYVDLTEERERANALAQAKDAAEAASRAKDSFLAMMSHEIRTPMNGILGLIELLQRTPLTAEQQRMVALAGESGQALGRILDDILDYAKLEAGRLAILRAPVDLRELFDGVLGSLLPQAFQKGLRLKQRVSAEVAAIVQADGIRLRQILFNLLGNAIKFTDHGSVMLRATMEPGATGLPMLVVVVEDTGIGIARTDLARLFAPFMQSERSTARRFGGTGLGLTIVRTLAELMDGEITLKSEAGVGTTAVLRVPCEVVSQGYDLPNLRGRALSVLVSDDSRRAALIAYGEAAGMRCVSPEDETPDDGIAITDRMERAGRKGQFAIHLTDELLPLGYSQDESGVSLGSNPLRWTAFVGALEALLKGIAPASPQASRAGEGKADDLVPQGARILVVEDHPINREVIGQQLRLLGYRSTVCTNGQEAVTALRADTYDLVLTDCHMPVMDGFDLTRSIRASDRPSVRALPVVGLTATVAREEHVLCMEVGMNAFLVKPATLASLQQTIETALQGGPEAPSPKTEVRSREASPARRTPESGGFRPECIDTVGLRSQLEPMLAERDVRQIFLRSLEQDRDALRAQLAAPTPAGLGKWCHRAGGAISVMEQPYLHELLDRLDGLLETGSPAQIQSAGASLSAMYDYLIDWLEKLDVA

SEQ ID NO: 16324 - protein, 681 aa, Ralstonia metallidurans
MRIQHAFRLITLAMVATIVGFGSYLWTEEWRAYAVAQHSEAMLQAFRATLVAAEKVSAERGPSNAALGAAPGVAAGALLRAREQSDASLTAAIAMLHGANCPECGAAKGSLEHARAQLAAARSQIDRLIARPLSERHDVQRAVSGMFTIVDEILRVADGPLSRLQRSAPVAAQHAVSARFAAELREYAGRAGSEFTSALVSNRPMHSEERERLAGDLGRVQTLGDQIQQRVSFQLASKPGLRDADTALHKRFFGDGLAYLQKVEAIGPAEPRPTTAELASTYVPLMAPIVAMRDAVLDVAQAEVQADTTRAKRRLGGLLAILAIITSFVAATFWLFAKRVLRPLTLATEATVELAEGRYDGPTHVWPKTDEIGAIFVALEQLRAGLLRKVALEHERTTLIARLQAAVTHERAQMMALAQARDAAEASARTKSSFLAMMSHEIRTPLQGILGLLELVEYSPLSAEQRRQVRLASEAGQALRQILDDVLDYAKMDAGRLRLALAPLDLRGLFANVLSLLAPRAQAKGLQLQQWVQPDVPVQLVADGARLRQILLNLVGNAIKFTECGSVDLLASVEPTSAGEDVLVVSVADTGIGIAPEDIARLFTPFVQGESGPARRFDGTGLGLAISRQLAQLMGGELMLDSTLGVGTQVMLRVPMPGCPDAGSPLSNSERREHRAEFRLA

SEQ ID NO: 16325 - protein, 250 aa, Ralstonia metallidurans
MKETLLGLDGKRALVTGASSGLGAHFAQRLAAHGAEVVLAARRVDALQSVAKQLEPYGRARCVALDVTSASSRAAMVEEAGPIDILVNNAGLVREGAALKHSEEDWDVVLDTNLKGMFFMAQALASGMRERGGGSIINVASILGLRQAGGVVSYAVSKAGVVQLTRTLALEWARHGIRVNALAPGYIDTEINHDFWQTDAGKALIQRIPQRRLGQPDDLDGPLLLLASDASRYMTGAVLPVDGGHLVNTL

SEQ ID NO: 16326 - protein, 257 aa, Ralstonia metallidurans
MSQIVSLEGRTIVVTGAAQGIGKAVVELGIELGANVVAVDLNGETLNAALAPLPAERVMAVAGSVADSALATRAVADAVSRFGAVHGLVNNAGIIRPAMIDKMTDQQWTDVIDVHLSGSFYWTRAVGQHMVSRAKDGDKTGGSIVNISSDAGRKGSIGQINYAAAKAGMLGMTMTAAREWGRYNIRSNSVCFGVVETPMTEVVRGEKFRDGMLAQIPLGRWSTPEEVVKTVCFLLSDGSSYVTGQHLGVNGGFHISL

SEQ ID NO: 16327 - protein, 472 aa, Ralstonia metallidurans
MNAVTDLKQDYIVADIGLAGWGRKEIAIAETEMPGLMAIRDEFAAAQPLKGARIAGSLHMTIQTAVLIETLKALGADVRWASCNIFSTQDHAAAAIAASGTPVFAFKGESLKEYWDFTHRIFDWADGGTPNMILDDGGDATLLLHLGARAEKDASLIAKPTSEEETFLFAAIKEKLAKDSTWYSRNLAAIRGVTEETTTGVHRLYQMAQKGELKFPAINVNDSVTKSKFDNLYGCRESLVDGIKRATDVMIAGKIAVVAGYGDVGKGSAQALRALSAQVWVTEIDPICALQAAMEGYRVVTMDYAAEHGDIFVTCTGNYHVITHDHMAKMKDQAIVCNIGHFDNEIDIASVEKYEWDEIKPQVDHVKFPDGKKIIILAKGRLVNLGCATGHPSYVMSSSFANQTIAQIELWAERDSGKYPVGVYVLPKHLDEKVARLQLRKLNAQLTELTEQQAAYIGVKKEGPYKADHYRY

SEQ ID NO: 16328 - protein, 365 aa, Ralstonia metallidurans
MHRRCSIACMKRCPTPWPNNSTPRGNTTPLARPIPREPIMAELHMVEAVNLALAHALANDPDVVLLGEDIGVNGGVFRSTVGLQSRFGEARVIDTPLAEGAIVGAAIGMAAMGLKPVAEIQFAGFIYPAIDNILNHAGHMRHRTRGRITCPMVVRAPSGAGIHAPEHHSESPEALFAQMPGIRVVMPSSPARAYGLLLAAIRDPDPVIFLEPTRLYRLFRQEVADDGQALPLDACFTLREGTDLTLVSWGAMLRETLAAADVLADDGVSAAVIDVATLKPLDMETILESVAQSGRCVIVHEAPRTAGLGAEIAANLADAGLYSLSAPVQRVTAPDTVVPLARLEHSYMPSVARIVDAARRALEAA

SEQ ID NO: 16329 - protein, 784 aa, Ralstonia metallidurans
MLHLSAAYFVTPFALLAAMMLVVARCWRNARQASAKMAELKAERTLFQSLLDSSPNAVLVVSHEHRILKVSEPYARLCGVSTEDLIGKPLVHSHTTSRFLDLGGLLELTLLRMDGNERSDLITLGIPEQSVRTFRVNATQCRSEDGVFSGTAIVLTDISEQVAAQHRVDQTSAAMDDITDALSVTFFQLCRESNGHIWLPWVKGMQNTTLNWSAERMMRDGGGILPNLDASEKTLFIGAVDQSIATQQPMDVTVRLTSDNRWVHIASGNPRVGPNGATLWYAYAMDVTEMQRYNTLLATASREAEAATEAKSRFLATMSHEIRTPLATVIASLDLLRESELSTHQREELDLADHSAKLLLEILGDILDFSRIEAGEMKLEQAPIDLRLIIEDVLRIQARQIEKKGVILDFYVEAGLAATLLGDAVRLRQIVLNLVGNATKFTLQGSIVVRALLIADHPETQTIQLEVSDTGIGIPAEKQAALFKAFSQADVSTTRRFGGSGLGLSICSRLVQAMGGAVVLTSTPGVGSTFRVELTLPVVERSTRMVEFAKTHIAIDVSRADDAAVFREHAVALGMQLAPLDCLNPSDIAVIDEDAASDKVPVGVLTIPYGKKHGNLSGPPIWWSEFRAACLDAVLRDTHRFPAQGQDVTATPPISDSLAGLTSLPILVAEDHTPFQIVIRRQIEKLGLACDVVSDGKEALAAIRNKQYGMILTDCHMPYMDGYELTSAIRASEAQGQRLPIVALSADASDEQRHRGRAAGMDDFLLKPLKLPELRACIQRWVLR

SEQ ID NO: 16330 - protein, 261 aa, Ralstonia metallidurans
MNVLLVYAHPEPKSLNGSLKDFAVQRLEAAGHQVRVSDLYAMQWKAPLDAGDSLAPANGTPFHPSLASKHAFENGLQSPDIAREQEKLKWADAVILQFPLWWFSMPAILKGWIERVYAFGFAYGVGEHSDSRWGNRYGEGTLAGKRAMLMVTTGGWESHYDARGINGPIEDILFPIHHGILYYPGFDVLPPFLVFRSGRIDGDRYAAVTEELGQRLDTLFTTEPIAFRPQNGGQYEIPSLILRSDISPGQTGFAAHVALEN

SEQ ID NO: 16331 - protein, 951 aa, Ralstonia metallidurans
MWHSSPTRIARRRVASFTLMLAAVLLPVAASAAAGEASGRHVYFPAAQPVALDGSKPQDSVVAGTPAQAAAPLGEDERRYLASLPRLRVQLLTQWAPFTYEDEDGQPTGILSAYLAYLSETLGLRFDVSSVAEPAESGRLRAAGQIDLNQYVEPAEMANRHLPTRTRAVESYPLVIVGRTDSPAIGELSELAGFRVAVAAKSVMADLVRAAVPSAPIVTAASPEAALEMVRDNKADLYIGNLAALDRAIQSRYVGQLKVVGATRLRQLIGFDVRPGLEPLVPLIDRAIEAMPPERRQAIRNRYLTTTYQFGLSGSEIRRRAAPYVALVVTALALLALGYWRQRRQVAIRLQAERELQRAHRLAEDANAAKSIFLAAMSHEMRTPLYGMLGTLELLSLTALDDRQRQDVGTIQTSSATLLSIIDDLLDYTKFEGGQLTLESVAFDPVELVEAVARSHAPLALRKGLALTCYVQADLPWLIGDPVRVRQALDNFLTNALKFTSEGHVGIRAFRAASTPSDETTLCLVLEVLDTGIGMSPGTQAQLFEPFVQGDATTARRFGGSGLGLSICRRLARRMGASIVVESELGRGSRFSFSVPLEIGEARQSVEPALPNVVVRAQDPVWRADVIAMIRQSGGRAIACQGDATDPGTILLIADETQGPVPNGYAGVVRLKASGPLEAVARPDGLVVSAYHQAGIVRALCRAAGIPLTSTASPVQRSTQMLKLDLQVLAVDDHPVNRRLMQQQLEQLGCRTTMVSSGEDALLACRQGQFDAVLTDVHMPGMDGYALAHALRADGFTIPIIGVTASVATGEAERCVASGMNGHLTKPVLLQALADSLRQVLPDRSEALATAARSAAELPQGDVSQDDRLLLIRTVWEDARAIRQAVEQKNLGTVAERAHRVRGAVAHLHDWEEVADLCRELEAVARDAFDGAKQLADDLDGYLQVYLEAES

SEQ ID NO: 16332 - protein, 677 aa, Ralstonia metallidurans
MGERVGPSRNAPQVVREIIMRKLIKGEKLAALPLSISQIRNLVYVFVTCLLVLIGLSWFVLLKYRMDEAVDRQKILFQARAEQVEANLTAVRRMTLRAQGTLERLIEVGVGKPMAQTTSRDWIDHLQKRGERPYVALPISAGREAIPADASIAPLANVLAFMLRVSSVQYQGLENVWLVDLNADRFYVTPRNLPQARETLRNDATYQAFVEGSIARLRSRKLLEQLKAAPGRVVMLEPGYDWVSRTPIVTVATLIHVDGEPRAVFAMDFPLSAIFPEDDDLEDGFFVQTAEGTILRPDSMSRDPLPPAVSQALVKRAHVATNLPTFVGSGLLPSVMVLDGPVDRSGWRAVEVVETGMLWESLRRNTLWLFALTGLTCTLMLAWVRLVDRRIMRPTQTQSLRLQESEVLGRTIIESTGVGLVILDSTNAAVLMENDVSDRITAHAKPGELARFHRAACNALADGERGNTVGRHGKFNFELAHTDETVSYLTVRVVESTYQGKPAKLCAMDDVTAARQSESTLLQAIHDADAANRAKSAFLATMSHEIRTPLNGMLGSIELLEVSALDAAQRDQLEVMQQSAQSLIQIINDVLDFSKIEAGQMALQARPCQIDSLVEDVCRRFAPDAERRSLQLLCVIDPALHAPILLDPLKTEQVLGNLVSNAIKFTEQERLWSRLPP

SEQ ID NO: 16333 - protein, 248 aa, Ralstonia metallidurans
MSSGRIAVVTGGMGGLGEAIAERLLSDGFRVVVTHSLGNDHVATWLREHSTQQREFVAYPVDVADFESCQQCAARILSEVGPVDVLINNAGITRDSTLRKMTHEAWRAVMSTDLDSVFNMTKPFCEGMVERRWGRIVNISSINGSKGAFGQTNYAAAKAGIHGFSKSLALELASKGVTVNTVSPGYLDTKMVRAVPQDVLDQHVIPQIPVGRLGQPKEVAALISYLCSDDGAYVTGANLAINGGQHMD

SEQ ID NO: 16334 - protein, 259 aa, Ralstonia metallidurans
MENASTAHPFSLTGRVALVTGGAQGLGQAIAAGLAAAGAHVLICARNAARVDEAVAQLRANGLGAEALVLDITDEAAVAAAFDDIVACHGRLDILVNNAGARNRNSMAHLDAADLRQMLETNLVAPYALCRHAAQWMQRGGYGRIVNVTSIAGQVARANDVLYPATKGGLDALTRAMAADLGRQGITVNAIAPGYFATEPNQTMVADKTVAEWLRNRTSLGRWGQPEEVAGAVVFLASPAASYVTGQVLAVDGGYLGHF

SEQ ID NO: 16335 - protein, 112 aa, Ralstonia metallidurans
MKLIIAVIKPFKLDEVREALSDVGVSGITVTEVKGFGRQKGHTELYRGAEYIVDFLPKVKIEVAVPDEVVERAIEAVEKSARTGKIGDGKIFVAPIEQVIRIRTGETGGDAL

SEQ ID NO: 16336 - protein, 429 aa, Ralstonia metallidurans
MSSAGFIVCKNMHFTCMIQGVLLMLSAASRPYIDASVPVLREHGLAITTHFYREMFAARPELKRIFNMGNQANGSQQQSLASAVFAYAANIDRADVLAPVVERIVHKHVAVGLTPAHYPIVGKYLLEAIAAVLGDAATPPLLAAWDEAYWLLAGELIAAEARLYERHGVAAGELLRVRVVNREQEGDQVVALTLAAEDGSPLRDFAPGQYISVEASFADGRRQLRQYSLSGERGLPTWRISVKREDGASDAPAGTVSNWLHENAQVGTTLHVSTPWGDFAPELDSRQPIVLMSAGIGVTPMVSVLRTLAHENPHRPVLFAHAARHGRQHAHRRDLAWARERMPNLRTHVSYETPQSVDASGRDYDHAGTMPVEALLKSGDNAAFNDARFYLCGPLGFMQEQRRALIASGVPVGHIHREVFGPDLLDDIL

SEQ ID NO: 16337 - protein, 614 aa, Ralstonia metallidurans
MRRDRLSGILLPNLPRRRFVQGLAAGGVMAGLSALGGTAWAQSSGLPESASSGTAPVLTGTEFDLVIAESVVNFTGTPRVATTINGMLPGPTLRWRQGDTVTIRVTNRLHEHTSIHWHGIILPFQMDGVPGISFAGIAPGETFTYQFKVEQTGSYWYHSHSGFQEMTGVYGGIVIDPATGVDGVRADRDYTILLSDWTDEDPMRVLSKLKVQSDYYNYIKPTVFDFFRDVSNDGVKSAFEKRKMWNEMRMNPTDLADLSGATLTYLTNGVTPAGNWTGLFKPGEKVRLRFINGSGNTFYDVRIPGLKLKVIQVDGQNLEPVSVDEFRFGPGETYDVLVEPRDDAYTIFSQSMDRTGYARGTLAVRAGLNAQVPAVDKPEWLTMSDMMGGMGGMGGMDHSKMDMGGMNQGSMAGMNHGAMTMDHSQHAMGGMAMDASLKVPSTKARHAKTEYGANTDMRVDMARTNLDDPGIGLRNNGRRVLTLADQHTIGGPLDKRGPAREVELHLTGNMERYSWSIDGVEYGKSTPVRFKYGERLRVILHNDTMMTHPMHLHGMWSELESPDGSFQARRHTIPVQPAQRISFLVTADALGRWAWHCHLMLHMDAGMFREVLVA

SEQ ID NO: 16338 - protein, 193 aa, Ralstonia metallidurans
MGSTGIIRFAPDWAGRHRHGNQHMSDKGTDTKDKEKKAGKKKTASDRIEVRQSGVHGKGVYAIGQIAEGERVIEYKGEHISWKEALKRHPHDPNDPNHTFYFSLDDGDVIDAKFGGNRARWINHACDPNCEAREKKGRVFIHALRDIEPGEELFYDYGLVIDARYTKKLKQEYECRCGSPKCRGTMLAPKDKK

SEQ ID NO: 16339 - protein, 1130 aa, Ralstonia metallidurans
MSNPISPSPAVRQAVFVKTAHSLWQNIWRTIGTMLALVFLALGTAHPAQAEFRRDPTVPSHAVTLKTSIRVNGTSSPAPGSSTLQEPNDPMLLRIGVMANGLPPFDLVGIDGNYEGISADYLAMIASTLHAKVEVRAYATRDAALHDLSRDAIDVVATDPGQTEPAQGAIGFTPNQIIEIATRTTAHKLVGNQTLGYVNGQLDPQAILAAYPGRKLQAYATLLDALTQLSLGADVVLLSNATAASYITAQYGIPNLVAVNVSRLSVGDLSFLVRDPALRARFDAAIRAIPKPTRLAISTHWVPTALMPHFDKALNLTTEESAWIAAHPVARYRATNDRVPFVFSDEHGESVGLSVQVLGKIEERTGLRFEPVSADGNSDPDHATTPTIQPIVPVDGPSERTDGLTITEPYFQGYWAIVAHVRQHGINNILDLAGKRVAVVLPNPIIDRLRATVPLQVVKAASYRDAYRMVATGIADATLGNMMTANYLIRESYPEALRIVAPISGTPLNVGIGVPADEPMLLAILNKALLSLSREDINALRLRWSEPSSIAGSTETLPSWAWFSLSAGLVLLAISLLWSQSLRQQIQRRRRMEAVLHEQLAFQTSILDAIPQPIYLRDIDLRLMTCNAAFERALGCGRKQMRGRTIDQMPLKLGDVPLSMQTYRKVLATGEAATLDRTLMIEGKERIVLNWVEPLRNATGGVVGIIGGWIDMTERQQMVTELASAKDRAEAANRAKSAFLASISHEIRTPMNAILGMLELTLQDKRLPDDDRLQVETAQESAKSLIGLIDDILDASKMEAGKFVLTPQPAPLRQLIGDVTSLFGLAASRKGVQLEAIVDDAVAPCHMVDPLRFKQVLNNLVSNAVRFTDRGSVVIRLGATNLTPDCQSLTFSVSDTGTGIPEDGLKKLFQPFTQIGDTKRSAGGTGLGLSICQRLVTKMHGTIGITSEVGKGTTVTATIELPIAAEIAPVLQSEQQNQPASKPGKALRVLIVDDHAPNRILLQRQLEKLGHRAFTASDGCEALEKLTDATFDLIICDYSMPNMDGPTLTRTIRSSDLPYRTLPILGYTASAQPEIRAHAIECGMDAVMIKPVDMATLETTLAANVNRRAHPGLPGLALALAPCGKSALTA

SEQ ID NO: 16340 - protein, 605 aa, Ralstonia metallidurans
MRANVPADLILPVRAGLSRRRFVQGLAAGGVLGALGGLSSGSWASSGGGQAATGNGTAPVLRGTEFDLVIGESAVNFTGKPGMATTINGMLPGPTLRWRKGDTVTIRVTNRLNEPTSIHWHGIILPYQMDGVPGISFPGIPPGETFTYRFKVDQTGSYWYHSHSGFQEMTGVYGSLIIDGDEDPVRADRDYAVLLSDWTDEDPMRVMSKLKIQSDYYNYNQPTVVDFFRDVSNDGLGAALEKRKMWNQMRMSPTDLADLSGATLTYLMNGVTPAGNWTGLFRPGERVRLRFVNGAGNTFYDVRIPGLKLKVIQVDGQNIEPVTVDEFRIGPGETCDVLVEPTDDAHTIFAQSMDRTGFARGTLAVREGLQPPVPALDKAEWLTMGDMMGSMNHGAMNHGAMPMDHSQHDMSGMSGMAGMSAMSHGDSLKVPSTRARHARTEYGPSTDMRVDMARTNLDDPGIGLRNNGRRVLTLADMHTVGGPMDHRGPGREVELHLTGNMERYTWSFDGVEYGKSTPVFFKHGERLRVILHNDTMMTHPMHMHGMWSELEAPDGTFQARRHTIPVQPAQRISFLVTADALGRWAWHCHLMMHMDMGMFREVVVA

SEQ ID NO: 16341 - protein, 510 aa, Ralstonia metallidurans
MRSAAFAESFLDLLALATDTSQTIHCLVTGACMEDSLSEVEGAAGDVSDVSEVDNFAPVTQEVDASDLCVRGVLPAGLQGTLYRIGPNPRFPQPEAHWFGGDGMVHVFAIDDGRVSYRNRWVRTPKWRDEDRAGRPLFRAFAGKLPDAPEWSGSDGGVANTNIIWHGGALLALEEAHLPTAVTPRAIDTLGYMEYGPLKGPFTAHPKTDPRTGELLFFGYNADGKLTPGVQVGAIDAQGRLTHYARLQAPYPSMIHDFMATPGHLLIPVLPLTGSLARVERGGPGYAWEPEKPAMIGVLPRGGGADDVRWFEGPACYVFHVMNAWEEGEGGQRILADVMVYDEPPLFPHADGSPGDPARQQAYLTRWTFDLASDIRRFTAERLDDTAGEFPRIDDRVSGFRYRHGWFAASHPEYGEGALNGIMHLDMQDGTRDAYWLPRGDITSEPVFAPGGGAHGGEGDGWLLAVVWRAAAQCSELLVFDARHVARGPLATVELPQRVPFGFHGNWVAG

SEQ ID NO: 16342 - protein, 289 aa, Ralstonia metallidurans
  unsure (1)..(289): unsure at all Xaa locations
MPLSHRQTLTRYLIEERRRCXPRATRRTQRADPRCGAGMQGAGPRSVSSREXXRATALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKP

SEQ ID NO: 16343 - protein, 381 aa, Ralstonia metallidurans
PAELMSIRFTARNVERLCDTLRGQVDEVRKLERAILNIVVDKCGMPRADFVARFPGNETNLDWIQTIVADNKSYSTIVERNVPAVHELQQKLIDLQSRVVLPLKELKDVNRKMSEGEKRAREAKREMTEANLRLVISIAKKYTNRGLQFLDLIQEGNIGLMKAVDKFEYRRGYKFSTYATWWIRQAITRSIADQARTIRIPVHMIETINKMNRISRQILQETGNEPDPATLAEKMEMPEDKIRKIMKIAKEPISMETPIGDDDDSHLGDFIEDTNTLAPAEAALDGSMRDVVKDVLDSLTPREAKVLRMRFGIEMSTDHTLEEVGKQFDVTRERIRQIEAKALRKLRHPSRSDKLKSFLEATKGILRVTYSMQCLPLWVVL

SEQ ID NO: 16344 - protein, 313 aa, Ralstonia metallidurans
MGEWQYHGFLFGVDAETLAVNPPTIEACVHPDDRMSLRRAIARARRELQVLNHEVRLRKLEGFRWTRLQAVPRIEIDGSVLWNGYWRDTQAEHERAAALASAKESAEAASRAKDSFLAMMSHEIRTPMNGVLGLAELLSHTSLTPEQSATVGMMGDSASALLQILDDILDYSKIEAGRIDIESRPLDIRELCDCTIGVLATRAHEKGLHLRLHVGADVAAVVLGDSVRLRQVLFNLLSNAIKFTESGMVSVSAEVVQETERQTLRWRVTDTGIGIEPQNQSRLFDPFVQADTSTTRRFGGTGLGLAICRRLVQ

SEQ ID NO: 16345 - protein, 196 aa, Ralstonia metallidurans
MIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 16346 - protein, 157 aa, Ralstonia metallidurans
MDTTRIQTVPATATETVQRSRSVDRVVRGIATSDGAGVKLTRVLTQNLQRRLDPFLMLDAFGTDNKDDYIGGFPDHPHRGFETITYMLAGRMRHRDSAGHEGLLENGGAQWMVAGAGVVHSELPEQEDGRMEGFQLWLNLPAADKMTTPWYRDMPAS

SEQ ID NO: 16347 - protein, 363 aa, Ralstonia metallidurans
SRSLHPRLFVQQRVFSFSSRRLKVRLVAEIVSPSCSAAAVIEPESTTAAKASSSSMVVFIVDQKSNEFRLYTALSAKVRTANFVHRDCMNLHRSYTMSIPSFGVGTFRLTGQVVVDSVRNALDVGYRAIDTAQIYGNEADVGQAIAESGVERGELFVTTKIWTANYAADKLVPSLRESLDKLRTDYVDLTLIHWPAPGNGVALSEYMAALAEAKALGLTRQIGVSNFNIELTRQAIEAVGKGEIATNQIELSPYLQSRKLTAFLKEQGIAVTSYMTLAYGKVLKDPVLGQIAAKHHATVAQVALAWALQLGYAVIPSSTKRENLASNLLARDLKLDADDMALIASLERNGREVSPEGLAPVWD

SEQ ID NO: 16348 - protein, 733 aa, Burkholderia fungorum
MMTSGLRPGDPGAILRLIRAPPDARQPFPDSPLMPHPDRSAVVSANSTDNAVSPWHAGELKLQRAVGVAERMQEVGRRVIRRLMPDQHRAFFPQLPFVALGAVDHEGDVWATLVAGKPGFLHAPTARTLRVDLVRDPHDPASAGLDDGEAVGLLGIELHTRRRNRLNGTVSHSAGAGFNVDVTQSFGNCPQYIQMRDAEFVRDPASPPPVEAVQLEHLSERARTMIDTADTFFVASYVDDPAGRQVDVSHRGGKAGFVRLSEDGVLTIPDFAGNLFFATLGNFVINPRAGLVFADFESGDLLQLTGEAQVDLDSPEIAAFQGAERLWRFKPRRIVYRAGALPLRWKLQANGWSPNSLMTGSWDEVASRVKAQALADAWRPFKVTQVVDESSVIRSFYLEPLDGAGLIPHAAAQHLPIRVTLPGCTKPVIRTYTLSTAPADGSYRISVKRQGLVSAHLHDTLRVGSVIEARAPAGQFTIDAAARRSAVLLAAGVGVTPMLAMLRHIVYEGLRTRRVRPTWFFHSARTLAERAFTKEIDQLAASAGGAVRVVRTLTDTEGAQMGKDFDASGRLDVELLRATLPFNDYDFYLCGPAGFMQSLYDGLRELNVADNRIHAEAFGPAGLHRRADAGADAGLAHLPADKPVPVAFVKSGKEARWNPDSGSLLDLAESRGLSPEFGCRGGSCGTCRTRVLEGAVAYPVAPEFKVASDEALICCAVPAQAGTSGAERLLLDL

SEQ ID NO: 16349 - protein, 291 aa, Burkholderia fungorum
MACSTASTHCCRCCRLPCCCSARERDMQKRLTLLGSTGSIGDSTLDVVARHPERFSVYALSAHRNGDKLVEQCLRFEPEVAVVGDADTAARVAAKLREAGCKTEVTYGPQALVDVSESDGCDTVVAAIVGAAGLAPSLAAARAGKRILLANKEALVMSGAIFMDAVRDNGAVLLPVDSEHNAIFQCLPREAALHGGVSKIILTASGGPFRTREPATLVDVTPEEACKHPNWVMGRKISVDSATMMNKGLEVIEAHWLFDLPGERIDVLIHPQSVIHSLVSYADGSVLAQLG

SEQ ID NO: 16350 - protein, 412 aa, Burkholderia fungorum
MKKIFNDPSNVVKSAPRYCRDGTRRCSDDTEHRACSAGDCFARGDCGAVPGRSMPPRWFVPRVVSPTPLLQPRSNGSPPSGAPLMPSVSYAGLSRPTAPCSTPSSPQSRRSTVASNPVWTHLAPGEWWPSRRLPLYRYFGGSGAMQLPVPMMNIVNGGAHANNSLDIQEFMIVPVSQPSFREALRCGAEVFHALKKILSDRGMSTAVGDEGGFAPNFGSNDECLSTILQAIEKAGYRAGEDVLLALDCAASEFYHDGKYQLAGEGLQLSSTEFADYLANLADKFPIVSIEDGMHESDWAGWKTLTDKLGKKIQLVGDDLFVTNTRILKEGIEKGIANSILIMINQIGTLTGNFRGDRNGQARRLHGCDLASFGRNRRFDDCGYRRRSERRADQDGFAVAFGPHFEVQPVAAH

SEQ ID NO: 16351 - protein, 341 aa, Burkholderia fungorum
MRPTHFSTTIRMPRADYRKRRFWHRSRVATSTVCNWVSAHCSESASRPRGARFARIGGISMNQDFFLQSKVAAITGAAGGLGTGIAKRLAGLGASVALLEPGIERLVSLASELTDSGATVLNVACNVTDAASTRYAAAQVLSSFGRIDVLVNNAGVLARPSALESISLEDWDRSLAVNLTGALLCTASFGAAMLEAGAGSIVNIASIAAYSPNTSVAYSVSKAGLLALTRHTAVEWAPRGIRANSVSPGFIRTPLSEVHYANPDLLQLRTQATPVRRLGTVDDVAAIVGFLASPASAFINGEDIVADGGFLNTALMHVHDPAQQYGGTHQADLSAFARLGR

SEQ ID NO: 16352 - protein, 465 aa, Burkholderia fungorum
  unsure (1)..(465): unsure at all Xaa locations
MNGIDGGAPDQVLERRILRKVGWRILPILLLGFLISFIDRANVGVLYGPLTQXXPGXLGLXXXXXXXXXPXXXXXXXXXPQXTXXYIGYLVFEIPSNLAMAKYGARVWLARILVTWGFVTVALAAAQGVTSFYILRILLGVAEAGFYPGALFFLTLWYPPRALGRAYSLFEISIPASLAIGSLLTSSLLLLDGVWGIAGWKWVFILEGLPAIALGLYIFFVLPDNPDKATWLTAEETCYLNSQLLTRHESAKSELGKVAVIFQSGLAWIFAALYFSFVIGFWAVTYFLPKIVQERFHVGVVQAGAISAIPWIVAVLAIIVVSRTSAKTRDRRWHMLVLLGLAGIGLLMSAAVASPILALIGIAMGAAGMQAATPLFWTMPSTVFRGAMAAVALAMVNSLGNLSGLAGPWILGFFSDVTGSSRVGLYIMSGFFFVSAILAFAVSTAVTRRRDVIGSPSLEQPIGSY

SEQ ID NO: 16353 - protein, 655 aa, Burkholderia fungorum
MRHRYTLSKLHAHADTHSNEIWTKDCARRREHAPPVGVIRTVKVRQAVRGSHAPRIGATCRPGDGATRRRAKLLPYTSSASRGHIVDAHRRPPQQRRHIARNRPMDIVFTVLILLLAVAASGVVIRILPIALPLPLVQIAIGALLAWPKLGLHVTFDPEIFMMLFIPPLLFADGWRIPKREFFMARRSILMLALGLVFVTVLVVGYFVHALVPSISLPVAFALAAVLSPTDAVALSGIVGKGKIPGRLMHILEGEALMNDASGLVALKFAIAAALTGVFSLRDASISFVIISVGGIATGAAVSWLFSFVSARFLNLTEDGDPAPGVVMTLLIPFAAYLIAERFELSGILAAVAAGMTMNYATLANAGPVSSRVRANSTWTMIEFVFNGMVFILLGLQFPHILGRALLDAHETSNAQVGLLIGYIAAVAAALYAMRFVWVWLLRWVASRGATKRGMANAVPGLRTVAVTTVAGVRGAVTLAGVLSLPEVLPDGVPLPGRDLAIFIASGVILLSLLVAVVALPLLLSGWRRGKDPHAAEELLARTLAAQAAIRAVDEVHDTECADLDESASAYAADVTARVMDLYRRRLATLDEEQEPRELARRADALEFRMKLAAMRAERKTLLALRSSQAINDETLNKLMREVDLSETALTARRK

SEQ ID NO: 16354 - protein, 390 aa, Burkholderia fungorum
MRAAGFRARNAPCIDRLTGAFTMKTKAAIAWKAGAPLTIEEVDLEGPRAGEVLIEVKATGICHTDYYTLSGADPEGIFPAILGHEGAGVIVDTGPGVGTLKKGDHVIPLYTPECRQCKFCLSRKTNLCQAIRSTQGKGLMPDSTSRFSIDGKPLFHYMGTSTFSNYIVVPEIAVAKVREDAPFDKICYIGCGVTTGVGAVVYSAKVEAGANVVVFGLGGIGLNVIQGAKMVGADRIIGVDINSGRVELAKKFGMTHFINPTEVENVVDHIVQLTDGGADYSFECIGNTKVMRQALECTHKGWGQSFIIGVAAAGEEISTRPFQLVTGREWKGSAFGGARGRTDVPKIVDWYMEGKINIDDLITHRLPLERINEGFDLMKKGESIRSVVLY

SEQ ID NO: 16355 - protein, 249 aa, Burkholderia fungorum
MEKTLDKQIAIVTGASRGIGRAIALELARQGATVIGTATSESGAAAISEAFNAAGASGRGAVLNVNDAAAAEALIDGTVKEFGALHVLVNNAGITQDQLAMRMKDDDWDAVIDTNLKSVFRLSRAVLRPMMKAKGGRIINITSVVGSAGNPGQVNYAAAKAGVAGMTRALAREIGSRGITVNCVAPGFIDTDMTRTLPEEQQTALKTQIPLGRLGSPEDIAHAVAFLASPQAGYITGTTLHVNGGMYMS

SEQ ID NO: 16356 - protein, 303 aa, Burkholderia fungorum
MSKQERLLMLSDLMLLAVAVVWGTSYGVVKSALVFYPVLGLLALRFGITFVILSPALRHLRAADARTLRGVLIAGALLLGIFLCETFGILMTRAANAAFLISLCVVLTPLIEWLLLRRRPSRIEWLAVALSLLGAWLLAGDGALSFNPGDALILLAALLRALTVCVTKRVMRDSALPPLSVTAVQSGVVAFGSAAAAWWFAPQQWQPLPSIAGHAAFWGYVGYLVIACTLFAFFAQNFAIKRSSPTRVSLLMGSEPAFGAVFACLWLGERISVTAWVGGALIVAASILATVRWTALRVNTARA

SEQ ID NO: 16357 - protein, 496 aa, Burkholderia fungorum
MGHMNETPALPAWLDGSPKLLLIDGQPTPARSGRTFETINPTTGKALAQIAEADEKDIDLAVAAARRALDGPWGRFKPFDRQAVLLKLADLVETHFDELALLDTLDMGGPIRSTGAKRTRAIGLLRFYAGLATSIHGSTIDNSQAGEVISYTVKEPVGVVAAINPWNGPLGLAIWKIAPALAAGCTVVLKPAEQAPLSPLRFGELCLEAGIPQGVVNVVTGFAGAGAALAAHPGVDKVAFTGSTEVGQHIIRASAGNIKRVSLELGGKSPNIVFADANLDAAVPGAAMAVFANSGQICSAGTRLFVQRSIHEEFVERLSSFAKTLRVGNPLDPDTQLGPLVSEAQLKRVTSYLDKGREEGARAVAGGTRLQNDELKNGYFVEPTVFDGVKDDMAIAREEIFGPVISVLPFDTAEEAVQRGNDTEYGLGSGVWTRDIGNAHRVARGLRAGSVWVNCYQVMDPAVPFGGYKMSGYGRESGVEHMEEFLQTKAIWIKTD

SEQ ID NO: 16358 - protein, 464 aa, Burkholderia fungorum
MRLRAPKRWLPMETSMKADEGMVAEIERRIVSKVNWRVMLIFMLGYLISFVDRANLGVLAGPISKDLHLSAASFGLAAGVFYIGYLLFAIPSNMAIVRFGGRFWMGCIMAGWGLVCFGLAAARSETWLLACRILLGVTEAGFYPGAMFLMTLWYPPRALAKAYATYTAFTPLALVFGALATSALLSLHGFGPIADWRLVFVLEGIPAFLLGIYTWLSLPSRPKDAKWLSAEEKAYLASQIPEVARGQRGDATRALVKTLKDPFSWLFALLYFLMLLGYWGLIYFMPRILQSRFHTDPVHAGFISTLPWLFACVLIYAMGKSSAMTGERRWHMAIGLILSGAGLYLAASTDSSVLTLLGLCLGAGGAPAAAAFFWTMPATVFAGATVAIAMAMVNSVGNLSGFAGPWVIGVLTDLSGDSRLALYVLACMCILAAALAFTMASIVQRRGASWGVTADKSLSGATGH

SEQ ID NO: 16359 - protein, 306 aa, Burkholderia fungorum
MLCGTPCRCVRCRARGPFSYNTVPAMFTRLREDIATIRERDPAARSAWEVLTCYPGLHALVLHRFAHACWQARRRWLARFVSQLARFMTGIEIHPGATLGRRVFIDHGMGVVIGETAQVGDDCTIYQGVTLGGTSLTRGAKRHPTLERGVIVGAGAKVLGGFTIGAEAKIGSNAVVTKPVPARGTAVGNPARIIVPAAAAVASEGASVVANSDSGGAARGAKRSAGSSRFCAYGITPNADDPVSLAIHGLIDHAATQAKRIDEIVDALERLGTSLEALQGADAALLDLRRLSAAIAGKVDGVVAER

SEQ ID NO: 16360 - protein, 298 aa, Burkholderia fungorum
MLMLIAAMIWGSAFVAQRLSLDAIGPFLFTGLRFLLGALVVLTLIVCVRRSAPAELSKRESGGARELLGAGVLLGVVLAASISLQQIGLQYTKVANAGFISSLYVVIVPLLGVLFRHRTGIGTWLGAALAAVGMYFLSVNEQFSMLYGDWYQLAGALVISIQMMLVGRFALRHDTLMLALVQFVTCGLACLVVGLAIEPFSLAVIARAAPTIVYGGALSVGVAYTIQVVAQKHAAPSHAAVIFSMEGVFAALAAWLVLGETMSARALSGCALMLAGLVVCQVMPAWRRGNERLPRASS

SEQ ID NO: 16361 - protein, 348 aa, Burkholderia fungorum
MLVTRQNVLRRFWYAIMPMARLDAGPQPFTLLGEPIVLWKGAGGKPHALRDRCCHRTAKLSKGFVDSDGNIACGYHGWTYDCSGQCVRIPQNSGGAIPSRAVVPSYRCEERYGYAWVALEDPLQPIPGFPEDGAPGYRRILQFYERWETSPLRMMENSFDNSHFSFVHKGNFGLFDNPKPSKYEFRPHEWGFEAETHVPVRNPPASYRITGTTEEVTERHLINRWFMPFARRFGCVYPASGIHHIIYNCATPIDDRTLMLSQWLYRNDTEDACSTQELIDWDRPITDEDRDILEATDYDACIDVRRQQECHMESDQPGLLMRRMLLKLLNDHGESEVFREVLPTHMEE

SEQ ID NO: 16362 - protein, 444 aa, Burkholderia fungorum
MNTDSYGNGLAIGKELDDPADAALYGKLTRRIVPFLFLAFVVAYIDRVNVSFAKLQMLADLSLSETVYGAGAGIFFVGYFIFEVPSNLILHRVGARLWIARIMVTWAVVSSLTVFVTDASSFYLLRFLLGIAEAGFFPGVVLYLSNWFPSQRRSQIIALFMAAIPVSGAIGGPLSGWLMAHLAGVHGIAGWRWLFLVEGLGSLVVGVAAFFVLTDRFADVRWLNAEEKSRIAADLARDALTRTHTSARGAFASVQVWLLGLLYFCIAMGNYGLAFWVPTIIKASGVASIGNIGLLSAVPSLVSVIAMIWIARHADRRNERRVHVALCCVIGAAGLLASVLCAANVTVSIAALVVAAIGINSIAPVFWGIPTALLGGAGAAAGLAVINCTGNLAGFVSPFIVGRLADLSGGKLLPGMLAIACALVVGAAIVLFMPSHRTSQRTFK

SEQ ID NO: 16363 - protein, 657 aa, Burkholderia fungorum
MNQLDVPSAGQNVEPANVPAPTRMNPAADVDYWALMQAIEDYAIFLLDATGRIVSCNTGALKQAGYTEREIIGQHFSCFYTEDAVARDWPAYELQQASLTGRFEDEGWRVRKNGTTFWSNVVITAIRNDAGILTGFAKITRDLTARRDYLEALRQSEERFRLLVDSVKDYAIFMLDPQGNVVSWNEGAARIKGYTREEIVGRHFSTFYPPEDAAAGKPARELAIARQIGHVEDEGWRVRKDGTTFWANVNITAVYDESKRLCGFAKVTRDLTERRQREELERSGERMRQFLATLAHELRNPLAPVRNAIGVMQLETGISPTLARSRDLIDRQVTHLTRLVDDLLDVGRIMSNKVELRVGRVDLAEVVARGIEAARPFTDAHEQRVVAHMPLEPISVRGDMTRLVQVLQNLLHNASKFSPVGSVVDIVARIDFHMAVLEVRDAGCGIALRSLDRIFDLFAQEKEAQTIGEGGLGIGLTLCKSLVEMHGGSIVASSEGPGSGSTFTLSLPLAAAPSNAAGDEANAANGQVAPLRILLVDDNRDSADSLAMLLELKGHEVRIAYEGEQALQVAPRFAPHLAVIDIAMPKMDGYATIAALREMPGLAHTMYAAMTGFGHATDRERSRDAGFHAHLVKPVELALFDTLLAEVEARRSGRTSG

SEQ ID NO: 16364 - protein, 424 aa, Burkholderia fungorum
MAGRQRPAPLSATTLCRRLSLATAELAGKHLVLGMTGGIACYKIAELTRLLTKAGATVQVVMTEAATQFITPVTMQALSGRPVYTSQWDGRVPNNMAHIDLSREADAIVIAPASTDFLAKLAHGMADDLLSTLCVARDCPLLVVPAMNRQMWQNAATQRNVAQLRADGVEVLGPDSGPQACGEVGDGRMLEAAATYEAIASFFTPKILSGRRVLLTAGPTFEPLDPVRGITNRSSGKMGFALARAAQQAGAEVHLVAGPVALETPWGVFRQDVQTAQQMHDAVMHSVADADIFIGVAAVADWRVDHASEHKIKKTADRALPSFTFVENPDILASVAKLPHPPFTVGFAAESGDLEIHGEEKRVRKNVPLLIGNLGPQTFGLDDNEVILFEAGGATRLPRADKQTLARALIAEIARRLPDTSLIR

SEQ ID NO: 16365 - protein, 360 aa, Burkholderia fungorum
MPKSKRPPPQAESETISHAMSASVDESGASEVEEEIAEERDLDERQGGADEAGDAREGASEVAPDADDFRALLQAELTADTIQHYLNRISVKPLLTVEEEQKYSRLAKAGEFEARQVMIERNLRLVVSIAKGYLNRGVPLLDLIEEGNLGLMHAIEKFDPTRGFRFSTYATWWIRQSIERAIMNQARTVRLPVHVIRELNQVLRAKRHLEKNSMNSGEAAERRDASIDDIAYLTGKTTDEVTDILALNEHTASLDAPLDLDPASSLLDLLSDDQSQSPDAEVQHRELETLTRAWLARLSDKHRHVIERRFGLNHIEPATLEELADEMGLTRERVRQIQQEALVRLKRFFASNGVRKDAVL

SEQ ID NO: 16366 - protein, 414 aa, Burkholderia fungorum
MDRKGATVDARLTIHSPPGLPMLSAEHRAIVKATVPLLESGGEALTTHFYRILIGEHPEVRPMFNLANQASGAQPRALANSVLMYARHIDQLEQLGGLVSQIINKHVALNILPEHYPIVGQCLLRAIREVLGAEIATDAVIAAWAAAYRQLADLLIGLEEKIYAEREAAPGGWRGTRLFRVARKVRESDEITSFYLRPDDNGELLAFHPGQYIGVRLYIDGEEVRRNYSLSAMSNGCEYRISVKREANGKVSSHLHTHLNENDTIELFAPAGDFTLEPGDKPLVLISGGVGITPTLAMLQAALHTNRVVHFIHSARHGGVHAFRDTIEQLAARHPQLKRFYCYEQRRADDADADGIGYLDETRLDAWLPETRDVDVYFLGPIAFMKAVKKHLKAIGVPESQSRYEFFGPAAALE

SEQ ID NO: 16367 - protein, 435 aa, Burkholderia fungorum
MNALASAMNSDAPSLFSGINVIQTMTVFQITGALLAVVAVFGVINYRFIKLPDTLGITAVGLVVCLGISALGFYYPTMAVVARKIVTQIDFADIVFHGLLGFLLFAGALHVDLSRMRTQRRAVLLLATIGVLISVALVGLGFFYVTQWLGHPVSLLWCLAFGALISPTDPIAVLSVLKGAGAPESLETKITGEALFNDGTAVVAFVTLVGLASGANEFSATAVAIDLLREIAGALILGVSLGFAASLLLRGIDSYPVEILITLALATGGYSLAETLHVSAPLAVVIMGLVIGNHGALTSMSEKTREHLFSFWELLDELLNLVLFGLIGLEIIALSLHQHIVRLGLAAIPVVLVARGISVSIPLFALQNFRRVNPHSALMLTWGGLRGGISIALALSLPDFHGRDMFIGVTYLVVVFSLLIQATTLGPLVRRLNRR

SEQ ID NO: 16368 - protein, 420 aa, Burkholderia fungorum
MTRSAFDYVDGVLHAEGVSAVSLAEQFGTPLYVYSRAALTAAWNAYAGACAGRRASVHVAVKANSNLAVLNVFARLGAGFDIVSGGELARVLAAGGKAENTVFSGVGKNANEMREALAAGVKCFNVESIPELDRLNAVAAEMGKKAPVSLRVNPDVDAKTHPYISTGLKSNKFGVAFEDARATYQAAAGMANLEVVGIDCHIGSQITEAAPYLDAVDKVLELVEQIEQDGLKIRHIDVGGGLGITYDDETPPEIGEFVRTVLDRIEARGHGHREVYFEPGRSLVGNAGVLLTRVEFLKPGAEKNFAIVDAAMNDLARPAMYEAYHAIDPVVKRDVPAHVYDVVGPVCESGDWLGRERLLAVEPGDLLAIRSAGAYGFVMSSNYNTRPRAAEVMVDGTQVHVARAREEVRQLFVGETILPA

SEQ ID NO: 16369 - protein, 657 aa, Burkholderia fungorum
MTEEVSTQHAAYVLVVDDDEGILRLARKSLERAGCRVAICAGVDAARERLARGGPDLLVLDYQLSGPETGLDFFRHLRAEGVRIPAILVTGFTDESRVIEALRAGVSDVVPKSGDYLDYLPEAVERVLSQVRLQRASDEALLLRDREQHYRTLSEALPHLVMTCNAAGDCDFLSKQWYDYTGLAEGSSYGLAWLDAVHPDDREVIRRSWLKAVSGNAGDYRHELRIRRHDGEYRWFDVRVVAMRDAEGNISKWFGSCTDIHSQREAIEERERLLASEQAARQIAEEANRAKDRFLAMLSHELRTPLTPVLAGASVLEMIPELPDQARASVRMIRRNVELEARLIDDLLDLTRVANGKLRLSLETVDVHDVMDSVLELFRSEIQVKQQDVHVHKNARHHYVLADRARLQQMLWNLIRNAAKFTPDGGHIYVRTRDERMHVQIAVEDTGIGIEPDQIGKLFNAFEQGNQNMTRQFGGLGLGLAITKALTDVHGGTVTAQSPGAHCGATFTITLPTATAPEVTSPVVVPDQVHPAGLLTILLIEDHVDTAEVMAQLIRSLGHEVTTVGRVDDALAATQSADFDLVISDVGLPDGTGLDFIKVFREHSDAPAVALTGFGTDEDVRRCLSAGFTSHLTKPVNFGQLETMIEGAVNRKEQKEA

SEQ ID NO: 16370 - protein, 486 aa, Burkholderia fungorum
MRLIQTALTFDDVLLVPAFSDVLPRDTSLKTRLTRNISLNMPLVSAAMDTVTEARLAIAMAQMGGVGIIHKNLTPAEQAREVAKVKRFESGVVRDPITVPPQMKVRDVIALSRQHGISGFPVVEGAQLVGIVTNRDLRFEERLDEPVRNIMTPRERLVTVKEGTPLAEAKALMHSHRLERVLVINDAFELRGLMTVKDITKQTEHPDACKDEHGKLRAGAAVGVGEDNEERVELLVQAGVDVIVVDTAHGHSKGVLERVKWVKQNFPRVEVIGGNIATAAAAKALVEYGADGVKVGIGPGSICTTRIVAGVGVPQVTAISNVSEALKGSGVPVIADGGVRFSGDVSKALAAGANAVMMGSMFAGTEEAPGDVFLFQGRQYKSYRGMGSVGAMKDGAADRYFQDNSANIDKLVPEGIEGRVAYKGSVNAILFQLIGGVRASMGYCGCRTIAEMNDKAEFVQITGAGLRESHVHDVQITKEAPNYHVD

SEQ ID NO: 16371 - protein, 431 aa, Burkholderia fungorum
MVSRRHFIGGSGAALLGAALVSKAGAASLPEAPTMAASAMQVPRAPSIGRPYTPVATLNGWSLPWRMKNGWKEFHLTAEPVVREFAPGMRVNLWGYNGQAPGPTIEAVEGDKVRIFVTNRLPEHTTVHWHGMLLPCGMDGVGGLTQPHIPPGKTFVYEFRLEKPGTFMYHPHADEMVQMAMGMMGTFIVHPKDPGVMQVDRDFVFIMSAYDIDPGSFTPRVNEMTDFNMWTWNARVFPGIDSLPVRAGDRVRIRVGNLTMTNHPIHLHGYHFEVVGTDGGWIPPSARWPEVTADIAVGQMRVIEFTANRPGDWAFHCHKSHHTMNAMGHQVPNMIGVPQKDLAKRINRLVPDYMAMGSTGGSMGAMAMPLPDNTLPMMTGTGPFGALEMGGMFTVVKVREGLGRDDYRDPGWFAHPKGTVAYEYTGELPDS

SEQ ID NO: 16372 - protein, 470 aa, Burkholderia fungorum
MTQSGFTRAAARPPTLTRHAADTARLAAPLAIAQLSQMAMGVTDTILLGSLGPDALAAGGLGANLFFVVVTLLQGVLTSVSVSVSHARGAADEGRVPHIYWTGFVLSVLLSVPAFFLLSFATPILLAFGEPALLAHNVGEYAAVLRWGSLGSLVGVGLMRSFLPAIGAAKRLLWVSLASVGVNGFLNYGLIHGAYGLPRLGFLGSAAATSITVWLSALVLMALLHLRPRYRHFVVATRPNVPLMGELFGIGWPVAITYGVESTLFLATGLMVGLLGESQLAAHQIALNVASVAFMVPLAIGQAANVRVGFWSGAGQPLAARHAGFVALALGVGFMTLSGLVLIAAPHWIVGLYLHLDDPANAATVALASSLLGVAAIFQIVDGLQTVGSGCLRGLKDTRVPMIAAAFGYWVIGFPTGYTLAFHFGLGARGLWWGLAAGLASVALLMTLRFHKLSLRRVPAKPGAQPAKSV

SEQ ID NO: 16373 - protein, 219 aa, Burkholderia fungorum
MSVAGRRGARKAPRLLCASEKAARQTRAFATAADLHPKFFTRIHSMSSRRIAVRRSGVHGKGVFAVEPIAAGERLIEYKGERISWKEALRRHPHNPAEPNHTFYFALDSGKVIDGKVNGNSARWINHSCAPNCEAEEIDGHVYVHALRDIAEGEEVFYDYGLVIDARQTNKLKKEYECRCGARKCRGTMLAPPEKEKGAGKSGKSAKKAGTTVKKAKKK

SEQ ID NO: 16374 - protein, 1108 aa, Burkholderia fungorum
MRRQARMECNLHGRTASHATRRRKASMHQTQPQTPPPAAAATQAGASRPPAGGTQRIVKIRRDYNAWVGDETLEDYALRFTPRAFRRWSEFRVANTAIGAVSFLVLEAIGGALVVNYGFTNAICAILAVSLLIFLTGIPISYYAARNGVDMDLLTRGAGFGYLGSTLTSLIYAVFTFVFFALEAAIMSLALELYLKVPLSVAYVISALVIIPVVTFGITFINRLQGWTQPLWLVLLVVPYVVVLWREPHVLAEWVTFSGVSGNGHEFNLVAFGAGCTVVFSLIVQIGEQVDYLRFLPPRTRANRFRWWAALIAAGPGWIVPGAMKMLGGAFLAFLAIQHEIDPVKAVEPTQMYLVAYHYVFHSPEGALAAMTLFVIVSQLKINVTNAYAGSLAWSNFFARLTHSHPGRVVWLVFNVLIALLLVEMGVFEAISKVLALYANVAIAWIGAVVGDLVINKPLGYSPRHVEFKRAHLYDVNPVGVGAMLIASLIAALSHAGVFGTTAEALSSFIALLVAFVCAPLLAIATRGRFYLARDGRDLEEGAILRCVICENTFEREDMAHCPAYAGSICSLCCSLDSRCNDSCKPHARLPAQFGKSMRTLFPRLTLGPAGLRLAQYAGLLIAVVTLLGGVLAVQWYQSVRTLPNLDTTVHDVLLQGYLKAFFALALVGCIAAWWLVLANENRKVTQEESQRQAELLMQEIEAHRKTDAALQRASAAAESANRAKSRYVTGLSHELRTPLNSILGYAQLLLQGTDELPPARRNAVATIYRSGEHLLALVDGLLDVARIEAGKLQLNVTEISLPDFVAQLAAMLEPQATDKGLQFEFQTSGRMADVVRIDEKRVRQILINLIGNAIRFTSHGSVKVRASYAWEAITFEITDTGPGMPASELERLFLPFERGAAAREHDHGAGLGLTICRLLTELMGGNLEVQSEVGKGTRFIVKLFAPEVRAPQLLASGPLNVKGYDGPRRTVLVVDDLAEQRRIVVQTLAPLGFNVVEAASGPEALQWLGTASADLIVMDVSMPDMDGFEASRLIRDNHLSAAPVLILSANAFADDRDKGAAAGCDDYLAKPLYIPLLLDKLAALLQLHWIVEPTEAAAASAVARVDV

SEQ ID NO: 16375 - protein, 469 aa, Burkholderia fungorum
MRLRRYTTITRGRKCGRASVGRFRHSLFLKLRKGRGMTDLADLTCVGPGTPMGTLMRQYWVPAAKSSELKRDGDPMRLMLLGEKLIAFRDSEGRVGVLDHRCPHRCASLFLGRNEESGIRCVYHGWKFDVAGRCVDMPSVPPHQDFKDKVHAKAFRTAERNGLVWVYMGDAAEPPPLPAIEANLVADCEIWCLQRDCNWLQALEGDIDTSHVGFLHVGSLKPDDLADDHPMRPTVLDRAPEYAVTNTAWGTMYGGYRPNDDGQRSWRVAHFMFPFWTQTPNNRFSSRAIARAWVPMDDEHSMLFDITCGVDEGNPAYSSTRKTGEPLFAPFEYAPATTDWFGRWRCVDDRRNDWGIDRELQRNGSQYTGIPNITMQDQAVTESMGPIIDHSYEHLAPTDQMIARTRRRLLLATQALSEQGTLPPGAQDSDVFFGARAGSFLCDPGLPFETAYATQLETATRWAGDKVVS

SEQ ID NO: 16376 - protein, 440 aa, Burkholderia fungorum
MLSHQDNEILVRVGPGTPTGQFMRLFWLPFLPSSDLSVDGQPQRVRLLGEDLLAFRDSEGRVGLVDHACPHRGAPLVFGRNENSGLRCVYHGWQFGVDGRVIETPAEPIESRLKEKVRIKSYPCRERNGIVWTYMGDASADGLPPLPNLEWNMVPVENVHFSFRVQECNWLQAVEGEIDSAHAPILHGRIDSQGAINEWTAKRDLRPVFECQRQDFGISIASRRVLDEEHHYWRVNQFLFPFYTLVPPQSKYPELSGHAWVPIDDENTLCLMFSYTPATPLYEKTRQLFEQGHQGRETGHASVNAYEPRPVTNPYAKYWTRYNLESAFQFDYDAQTKTWFSGLPGLWVQDAACQSGVAPIYDRSKENLGISDTGVAMTRRLLLENVRKLAAERVSTVQVDEPDLWMVRAVSLTLQAGASWQNDGAVHMRARLGADFGYKP

SEQ ID NO: 16377 - protein, 345 aa, Burkholderia fungorum
MFLRNMWYVAAFSADVKPGKCLARTFLNEPVVLFRTASGSLGALIDRCSHRAMPLSEGHVDGDIIRCPYHGLEFNAAGVCAHIPGQERIPAAANVRSYPVSERDGLIWIWMGEPEKADLRSIMSNPEHRDPGWSWRPYYMHVNSNWQLLVDNILDLTHVAYIHANTIGGNPQTHFNADMSVQFDGEKVTLLRKMPNSVPPKTYVAAGGFKGNVDRWQMVEYRPCGGNVLRVNAGACEVGTGAYEGRRDNGFTLLNVHGVTPETETTTHYIWTICTDAPRESGVPDMLFDQFYETICEDERALEAQQRRINDMPDMRFVGIASDGAVSRARLLLERLHENETAVTS

SEQ ID NO: 16378 - protein, 256 aa, Burkholderia fungorum
MKKKQTSLEGQVAVVSGGAHGIGLGIVERLLQLGAKVVASDIDRDGLAVSRERLAKSFGTSIAVQAADLSKERGAQALHRAVAKRFGPAQILVNCAGGGVIRPFLEHTPETLKATIDRNLWTVIWCSRVFLPDMIGAKYGRIVNIGADSVRNGLPAHAGYNAAKGGMHGLTTGLAREFALNGITVNTVAPCAVNTEVWAKVKKSNPRLAQAFVDVIPMGRVGEIEEVASMVGYLALPEAAFVTGQVISVNGGSAML

SEQ ID NO: 16379 - protein, 341 aa, Burkholderia fungorum
MTIAGRHAGVPGIRNAVHRAVHRPLLPAPLNCRIEQSIGERMSPRDLLLALVVVVAWGINFVVIKVGLHGVPPMLLGALRFTLAAVPAVFFIKRPNLPWRWLLAYGATISFGQFAFLFSAMYVGMPAGLASLVLQAQAFFTLIFAAIFLHERFRLPNVAGLAIAAAGLAVIGMQGGRAMTLAGFVLTLCAACSWALGNIVTKKVGKVDLVGLVVWGSLIPPLPFFALSYAFEGPQRIAAALAGISAMSIFAIVYLAFIATLLGYGLWSRLLSRYPASQVAPFSLLVPIVGLASASLFLDEQLSSAQIAGALLVMAGLAVNVFGGWVVQRFSPARRATDASD

SEQ ID NO: 16380 - protein, 379 aa, Burkholderia fungorum
MDRGPELAGKLQVERRVVFRVRAQIAPAVFRGRGHGTHARRASGNSMTSARGVIAGFCLVAGRMSVEPLNSSLCFRGIRRAFACAEALPTIEPLRGVSMTSDIASVSLPDGERIPKLGQGTWEMGEVPARRAAEIDALRCGIELGMTLIDTAEMYGDGATESLLGVALAGLRDKVFLVSKVYPHNASRRGVIAACEQSLKRLKTDQLDLYLLHWRGSVPLAETVEGFEALRRAGKIRHWGVSNFDTADMEELVATPGGDACATNQILYNVARRGPEFELLPWLAARKMPAMAYSPVDHARLPKRSPLDNIADARGVSVFQVALAWVLLAPGVFAIPKAGRAEHVRDNHRAAQLQLGADELAAIDAYFKPPRSKRPLEML

SEQ ID NO: 16381 - protein, 543 aa, Burkholderia fungorum
MTALQPDTVQLWPDEVYLIGCAGAPRGNPDPAGASAEKVGFKAYNLLRMAELGLPVPPAFVLGTHYCRDARAREIATASTVWEPGLQELERTTGQRFGDPRQPLLLSVRSGAPVSMPGMMDTLLNVGLCDTTLAGMLRQTGNPRLVWDTYRRLVASYGELVAGVPSSIFEAEYAAFAGTRDEHGLDFTELRELTHRCLAAYERAAGQPFPQDPQVQLANAIGSVLASWQSDRACAYRKQCGISDAIGTAVTVQTMVFGNAGGRSGAGVGFTRDPVSGEPTLWVDFLFNAQGEDVVSGRRSARGHEELAQAMPAAWKALQDAATRLEHALGDMQDVEFTVQDARLYMLQTRNGKRTPQAAARIALDLLDEGVISAEVARERTAALKPAALTRTRIVASGDRPLTPLAHAASASNGVAAGEIAFDEARARMRHAAGASVVLVRRDAETDDIAALEVAAGLLTQRGARTSHAAVVARQLGKVCLVGCTGLRLDESARTLQLGDTVLHEGDEVTLDGNDGAIYAGTARTVIEPMAELQARLERLRAP

SEQ ID NO: 16382 - protein, 356 aa, Burkholderia fungorum
MHLLSITVIPARHGPQVRIRGFSKRGRSGLRIAARCHRFTKAHRTGNRTYSSTTTTAHSGMSGRYASTDTDVLAAYATVRQTLHATYGVQADSRKLIIEVIMTQALNGKLALVTGASRGIGAAIAARLARDGASVIVHYASSAERADAVVKAIREAGGEAEAVAANLSTQDGVAVLIDSLNGVFGGRFAGRLDILVNNAGTVEYGPFLESSATSYDTHFNLNVRAPIELAKDAAKRMIATGWGRIINVGSAFGEAAPLPGVTLYIASKFAVRGFTRGLSRELGKFGVTVNAVQPGPIDTELAPQPGTEAHATMTRLASVGRFGKPEEIAAAVAYLASPEAGYTTGESLTVDGGWIA

SEQ ID NO: 16383 - protein, 288 aa, Burkholderia fungorum
MVGMTADLGKYTDLHIFGKEFPERYYQMGMAEQLLMGAAAGMAHEGAQPFVTTYAVFATRRAYDFMHQAIAEDNLDVKIICALPGLTTGYGPSHQAAEDLALMRAMPNMTVIDPCDALDTEQMVPAIAAHNGPVYARLLRGNVPAVLDEYDYQFELGKAKLLRDGAEVLIISSGIMTMRSLEVAKLLQADKVGVGVLHVPTIKPLDTETILREARRTGRMVVVAENHSVIGGLGEAVATTLLTAGVTPTYRQIALPDQFLAAGALPTLHDRYGISTSVMAENIKGWLG

SEQ ID NO: 16384 - protein, 285 aa, Burkholderia fungorum
MIRYRPALAVLPHLSTASAITTEQGTTMGRSINLEGKVALITGASSGLGKRFAQVLSQAGAKVVLASRRTERLKELRAEIEASGGAAHVVSLDVTDYQSIKSAVAHAETEAGTIDILVNNSGVSTTQKLSEVTPADFEYVFDTNTRGAFFVAQEVAKRMIMRGNNAQNPSYRIINIASMAGLRVLPQIGLYSISKAAVVHMTKAMALEWGKHGINVNAICPGYIDTEINHHHWSTEQGQKLVSMLPRHRVGKPDDLDGLLLLLAADESQFINGSVIAADDGFGLS

SEQ ID NO: 16385 - protein, 402 aa, Burkholderia fungorum
MTLTFVRRPPGLQFGGLDVRQLADRAGRTPFFAYDRSAIDIRVRELRNLLPAGMHLHYSIKANPMPAVIHHLAQRVDGFDVASAQEMALALDAGTAPDAIGFAGPGKSHDDLRRAVASGINVHVESETQLRLVTALGWELGVQPSVAIRVNPDFQVGHSGMRMGGGAAPFGVDVDQVPALLRELEAREVALAGFHVFWGSQCLHAATIIKAQRQSADLILRLASGVPRPLRFVNLGGGFGIPYFPGETPLDVKAVCEAMQDWLPPLCERLPGTTPILELGRYLVGEAGIYVCRVIDRKVSRGRTFVVTDGGLHHHLAASGNFGQVLRRNFPVVIGNRPDGVPRERCHVVGCLCTPLDRLADEVELPEAHIGDFVVIMQSGAYGRSASPVRFLSHPEPVEMLV

SEQ ID NO: 16386 - protein, 703 aa, Burkholderia fungorum
MNAADQSNLALLPVVVLCSMAFSHAISKGRIFVEKNRALQALAGSIAHEMRNPLSQLRYVLDRVEEALPSTAQPGRSPALPRENAGELYRHLAHGQLSIERGLRIIAMTLDEVSAKPIRPDCLAYLSAATTTRKALEEYGFGDEKERDKVRLVVREDFTFKVDETVYLFTLFNLIKNALHHIATHPAATLTLTIEQQSVVVRDTGPGIAPDMLPHLFEPFRTAGNSAGTGLGLAYCQRAMQAFGGSITCRSELAKFTEFTLQFPVVPKSEIVDYERRILEHAMPFFDGKRILIVDDDAGQRARASHALSKVGAHVSEAENGAIALTVLRESVPYDLVLMDINMPVLDGYRTTERIRADHGDPSWNVLIAAYTAEPGTAVRLLARRAGMDEIISKSCSVLELITSLQTLFESGNRHHLNQKSDAFSGKSILVADDDTYSRLVAKGYLERCGASVVEAEHGQAVLAHLQGDGVIDAIIMDMNMPGMGGVETTALIRARADSYATVPIIALTSQSDIKAVQTCLAAGMNEVMIKPLQGGSLYACLARQFARQRGGAVPAQAGSLPAPAHTLAGKPAAMSESALLDEKHLEELASLDLLDESFLKGIEQIRLLVTRLGASVAAVDLESTQGALHLLLGVSGNIGARALHQFVRQIYARLVEDEWPAEADWLTRVGALSERSTEALQAYFASARARREHRDLLSDEWP

SEQ ID NO: 16387 - protein, 309 aa, Burkholderia fungorum
MATLRTDFANLFAPLFFPMLASFIATVFVVSWSTGFVVARAITPYADPNLFLLARFGGAALIFALAALAARAAWPGGRDIGKHLLAGALLQGVYLGAGYWAVAQGLSAGVMALLGALQPLATAAVAAPLFGERLSRRGWAGMALGLAGVVLVLEPKLASSAAPAPHGSAPGWLVVLISIAAVGAITAGTLYQKTSLAKADIRSASAVQNFGAALVAGVFVLALGEHRWIASPTLWASLAWGIVMLSGISVTLLVWMVRRGDAARATALMFLAPPLAALEGYAGFGETLLPVQIAGFAVALVGVLLTRSR

SEQ ID NO: 16388 - protein, 647 aa, Burkholderia fungorum
MTKRVVKRRALDVAANDLGMQDESGKENENESGRADLKALIKLGTERGFVIRGEISDCLPERLAQPDAIENVVRAFSEMGIAVFEQAPDAESMIMNDHPAAVATDEQIEEEAVTAISSVDAEFGRTTDPVRMYMREMGTTELLTRQGEIALAQRIEEGRNGMIRAISSCPATIAEILAIADGVACGETAIDEFVDGLVDPAATATDDMIAVPEDSLGATPMFDDDQGDEDDDGAEAEPADQHIETLKHDALAKFAKVADWFSQLRDAYETQGYGSARYRAAQAAIEAELMTIRFTARTIERLCGALRLSADEVRTIEREIARIAVERCGVPRDTFIAHFRGNETDPAWARQLAAAGQPFSSVLERNLPAIGLEQEKLLALQKRVVLPLDEFREVCRALSASEAKTLRAKGEMIEANLRLVISIAKRYTNRGLLFLDLIQEGNIGLMRAVDKFEYRRGYKFSTYATWWIRQAVSRSIADQARTIRVPVHMIESLNKLKRISRKILQETGNEPDAALLAQLMEMQEQKVRAMLRIVKEPVSLDASVGENDDTSIGDLIEDSAAILPDDAALHAGMRDAISEALMTLTPREAKILRLRFGIESSRDHTLEELGEQFELTRERIRQIEVKALRKLRHPARSARLKSFLDEG

SEQ ID NO: 16389 - protein, 258 aa, Burkholderia fungorum
MKRLAGKVALVTGAGRGIGAAIAYAFAREGAAVVLAELDIETAQQTAEHIRSQTGARVLAVHTDVTQAASVQHAVSEAERAFGALDVLVNNAGINVFCDPLTMTDDDWRRCFAVDLDGVWNGCRAVLPRMVERGAGSIVNIASTHSFKIIPGCFPYPVAKHGVIGLTRALGIEYAPRNVRVNAIAPGYIETQLTHDWWNEQADPAAAQQATLDLQPMKRIGRPEEVAMTAVFLASDEAPFINATCITVDGGRSALYHD

SEQ ID NO: 16390 - protein, 569 aa, Burkholderia fungorum
MESNSKPAHTDELGSRPARPADHAAENGILLRLARAQSGSRERLLQEIADAALSLCNAGSSGISLVEGTDPHRQFRWLAVAGLCVGLQGKTTAWNECPCRLALESAAPQLFVRPQDHFPSLRFPGVEIAERLVVPIPTDNGFVGAIWVMSHTSARRFDLEDVRLLSNLAVSAGAALTTVNARDTGEESERRHSEFIAMLGHELRNPMAPIDSAVGAAKQLCADNARAVEVLTIAQRQMRHLRTLVDDLLDAARLRHGKLAIKHSDTSLNEIAFDAVTAVKHHIQSRRHSLTLTGLETPVPVRADHVRLSQVLGNLLSNAAKYTPVGGAIELAVRVAEDGQEPERKEVVVIEVKDNGIGIDNSIQPRVFDLFAQSARGNARAEGRLGIGLAVAKRMVELHDGTISLRSEGTGKGTLVTLKLPILRSGDELQARVETPPSPGLGPVRLLLVDDNVDALQSLGILMELEGHQVTMCDSGREAVRLIRENLPEVAIIDVGMPDMDGFDVAHAVRSDSGLADVMLVALTGYAAESDKSRALAAGFDYHLTKPLSLDKLQYILANRAGGKLGGIV

SEQ ID NO: 16391 - protein, 324 aa, Burkholderia fungorum
MSAPEIRYAQAVAQALHDSLRDDESVMVMGEDIAAAGGSFKATRGLLDAFGPQRVRDTPISEASIVSAAVGAALTGMRPVVEIMFMDFITLAMDALVNQASKARFMFGGQGSVPMVLRTPHGGGMNAGPQHSQCLEAWLAHVPGLKVVCPSTPQDAYSLLRAAIADPDPVIVVEHKGLYARKGVVEPVVGRIGEASIVRAGRDLTLVSYGATVAACLDAARTLGAEGVEAEVIDLRSIQPWDKAAVLASLARTHRAVIVHEAVSAFGVGAEIAATLSDEGFDDLDAPVRRVGAPFMPVPFASSLEKGYAVDAEKIVAVARETLN

SEQ ID NO: 16392 - protein, 450 aa, Burkholderia fungorum
MSTSVNAGARLDRLPISRFHWKILFLIGAGVAIDAFDIYLGGTVMAATVKTGFATLHQGALFISLTFTGMLIGAGAAGYVGDRFGRRYSYQTNLLVFGLAAVGCWLAPNMPMLIVGRFIMGVGLGAEVVVATGTLCEFVPPAYRGRWAALMSLMIHIGVLAATGLSYLIIPRFGWRVMFLIAALGALVIWIMRKRMPESPRWLESVGREAEAQAVLERIEAEVARHHGSLPPVQLQPSVTAAADGRSSLAALFARGQLRKTLVGTVTGVTINIALYGFLSWIPTFLVKQGLEVSTSLGFATIIAFGGPLGVLAGLLFTDRVGRKKGLIGFAAVSAVLGVAYSHLQGQVLIGTVGFLVEGTIYGLATIGLYGFIPELFPTAIRLRGTGWCGVCSRGASIGMPYLTVMLFERFGVSGVTSMVAGVLLLLIVTVGLFSEETSQRSLESIALQD

SEQ ID NO: 16393 - protein, 291 aa, Burkholderia fungorum
MNTSNGNSRDTQTDSLQGKVVVLTGAGGGIASAIVDRFARSGSRIVLLELRTSSLADAEQRLAAAGIESVSIECDVADESSVKNAAGRTVEHFGRCDVLINNAATLAPATSIEKLLVADWDRTLAINLRGVFLTTKYLGALMLNQGSGSIVNIASIAATAPNASPQYGASKAAVLAFTRHTAVEWGPRGIRANAVSPGFIRTPLSESNYAEPEMLARRSNMVPSRRLGLPGDIAEAVAFLAGDGASFINGQELAVDGGFMQTTLMHAQPKAEQYGGWQPAHIDFSAAVPHG

SEQ ID NO: 16394 - protein, 346 aa, Burkholderia fungorum
MKALVYHGPGKKSLDERPMPQLASATDAIVKVTRTTICGTDLHILKGDVPTCQPGRILGHEGVGIVQQVGAAVSSLKEGDHVLISCISACGKCDYCRRGMYSHCTTGGWILGNRIDGTQAEYVRIPHAETSLYPIPAGADEEALVMLSDILPTGFECGVLNGKVQPGSAVAIVGAGPIGLASLLTAQFYSPAQIIMIDRDERRLEVASRFGATACIDSRVAEPVVEVMKLTGHVGVDCAIEAVGVPDTFELCQALVAPGGVIANIGVHGVKADLHLESLWDRNISITTRLVDTVSTPMLLKTVQSGRIDPARLITHHFQLDDVLNAYDTFGRAADSHALKVIIEMS

SEQ ID NO: 16395 - protein, 247 aa, Burkholderia fungorum
SRPGHLESAPRFFLSHLRLFVSIARNYLGYGLPHADLIQEGNIGLMKAVKRFDPEQNVRLVSYAMHWIKAEIHEYILRNWRMVKVATTKAQRKLFFNLRSHKQGLGAFTPDEIEGLAKELNVKREEVSEMETRLSGGDIALEGQVEDGEESYAPIAYLADSHSEPTAVLASRQRDKLQSDGIASALDALDARSRRIIEARWLKVEDDGSGGSTLHELADEFGVSAERIRQIEASAMKKMRGALTEYA

SEQ ID NO: 16396 - protein, 800 aa, Burkholderia fungorum
MAKTKDAATGGKKATGTNSRESTRKVSEARLVSSARKTSAASVAPVAGKKSSTASAARAEPVRAAKAVALPAAKGSGVRSAREAAAAQDDAVVREVPVSTVQPAVVHQPRVETTAGTANSMTKKLNEVPVDDDATQSEENPAAVPAKVEKAKARDRRAKEKALLKDAFASSQPGTVEELEERRSKLRALIKLGKERGFLTYAEINDHLPDNFTETEAIEGIISTFNDMGVAVYEQAPDAETLLLNDNAPAASSDDEVEEEAEVALSTVDSEFGRTTDPVRMYMREMGTVELLTREGEIEIAKRIEDGLKHMVMAISACPTTIADILAMAERVANEEIRIDELVDGLIDANAEDADGFSAQEAEAIESEDEEVEEDSEEDEEEDDGTAQATANAAQMEALKRASLEKFAMISEWFDKMRRAFEKEGYKSKSYLKAQETIQNELMTIRFTARTVERLCDTLRAQVDEVRQVERQILHTVVDKCGMPRAEFIARFPGSETDLEWADKIVGEGHAYSAILTRNIPAIREQQQRLLDLQARVVLPLKDLKETNRQMAAGELKARQAKREMTEANLRLVISIAKKYTNRGLQFLDLIQEGNIGLMKAVDKFEYRRGYKFSTYATWWIRQAITRSIADQARTIRIPVHMIETINKMNRISRQILQETGLEPDPATLAEKMEMPEDKIRKIMKIAKEPISMETPIGDDDDSHLGDFIEDNNTVAPADAALHASMRDVVKDVLDSLTPREAKVLRMRFGIEMSTDHTLEEVGKQFDVTRERIRQIEAKALRKLRHPSRSDKLKSFLEGN

SEQ ID NO: 16397 - protein, 650 aa, Burkholderia fungorum
MYEVRARKFSYNGTTMYDLLKTIDDPAALRRLDRRQLQPLADELRAFVLDSVSQTGGHLSSNLGTVELTIALHYVFDTPHDRIVWDVGHQTYPHKILTGRRDQMHTLRQLGGISGFPKRDESEYDTFGTAHSSTSISAALGMAVASKLKGDNRMGIAVIGDGAMTAGMAFEAMNNAGVEDDVPLLVILNDNDMSISPPVGALNRHLARLMSGRFYAAARAGVERVLRVAPPMLDLARKLEEHAKGMIVPATLFEEFGFNYIGPIDGHDLDSLIPTLQNIKELRGPQFLHVVTKKGQGYKLAEADPVLYHGPGKFNPAEGIKPAATPSKKTYTQVFGEWLCDAAELDARVIGITPAMREGSGMVEFEKRFPDRYFDVGIAEQHAVTFAGGLAAEGMKPVVAIYSTFLQRAYDQLIHDVALQNLPVVFAIDRAGLVGADGATHAGAYDLAFLRCIPNMTVMAASDENECRQMLYTALQQPNPTAVRYPRGAGTGVATIKQMTALPLGKGEIRRETSQPAGKRIAILAFGTMVAPSLAAAEQLDATVANMRFVKPLDADLVRQLAETHDAIVTVEEGCVMGGAGSACVEALLASGVTRPVLQLGLPDRFIDHGDPAKLLAACGLDAVGITKSIRERFLLSGAVGGQSSVKRVA

SEQ ID NO: 16398 - protein, 1167 aa, Burkholderia fungorum
MQKILDRTQESLALAFATLAQNAKRQQRVYLATIGSLMLVVAIFALVLAVVAGLAQLDYRRTFASQNATDISLLLHQEESFSRRVELTFDYYYTAPHVRSAPEAVQQSIRRTGVVRGKVDRIDAGFDMLVGEATTTAWGPQLGEKLGRLYEASQSTLATQQAFELQQRATLVGLTEDYAVILPSLAQPVAGKAAAAKLSAVPQQQLAFVRTLRETLERQLEAQTGRRLPGKGERVWLGPYLDPLENVPVISAVSVYYDGGTPTTLISMNIRLDVLARRIAPPGDEGTILLMAADRRIIASSKPLGMQTGKMLQQTVAATPSHVFHYGREGVIFHEPLGPGFGFLVGYLPWGALAVALGWQLAVIAALTALILLAVALTARYFGFRLLRNAFAETSRSLESETINHVLVSATPVGLCVVRQGDYSVLTANALAAELLSIEPGGNRLPPHIVGEFLAQTPGKPSAAAIARIAAFVVAARPQSPASAPSEEGAPPARFLQFTYAPARYAGENVLFCAILDVTAQTLLEQQLRHAQQTSDAMMRARTNFFAAMSHEIRTPLNALLGNLELFARTPGLEAHSQRLATLSVASDALRRVVNDILDFSKIDAGEMLLANEPFRPIDEFENIAFSHAPLCGDRAIRFYALLSPTLDCTLIGDRMRIAQVVNNLLSNAFKFTSSGKITLYAEVKDDPQGRPTLLCRISDSGAGMSEELLARLFKPFVQGALGTSRGTGGTGLGLVICARLCELMGGRISAESVPGVGSVFHVSIPLVAVPGDQRTPVAIPASRGTALVLCTERQAGEFLDGWLQRAGWSSHTVMSLAGAEAWLKANRPAVLIVSGEYDLEAIVGLRALQAVGVVWITSGGPTRPEARAQGVLEVSEFSRTACLTAIELAVEGASAAPAEASAAASALTPSVEIDPALLGLAVLVAEDNPLIQNLIAEQLVELGCVPTIAADGKQALALFERAPFEVVLTDVHMPVMDGHELLTALRERHAELPVLAFSAAAEEQQAQSWHERGFNGYVSKPASLSELQAALLAVVPAPARAARAKAASTAESASADSVAPVANVASMLSADDKARYTAMLREHLQKDLPRLLAIVEEEDVRALAGWAHSASGAFVVVQEPEFFDQCRQLQRLCADNSEWTTEMDERAISLHEALSDHYGLDEQPAR

SEQ ID NO: 16399 - protein, 461 aa, Burkholderia fungorum
MTFLKSPPPTPDAVADEYAAMISGSSLPKYRIPEASSDRRAVFDLVRDELFMDGNSRQNVATFCTTYADDEVRRLMDLSIDKNMIDKDEYPQTAEIEMRCVHMLADLWHATKSWKTTGCSTTGSSEACMLGGLALKWQWKKRREAQGKPTGKPNFVCGPVQVCWAKFARYFDVEMRQVPLSGDATGLRPEDLAQYCDENTIGVVATLGITFTCVYEPVKALAGALDALQANVGLDIPIHVDAASGGFVAPFIQPDLEWDFSVPRVKSINASGHKYGLAPLGVGWIVWRSTQDLPDELIFRVDYLGGDMPTFALNFSRPAGQIIAQYYMLLRLGREGYRHIQQECADTAQALADGLAKIDALDMIYDGRGALPAVCYKLKHPDTAGFTLFDLSDRVRMRGWQIASYELPAGREDTIVQRVLIRRGVTRDMAAMLLEDIKHAIAHLTKNPVPNSTAGPTFHHD

SEQ ID NO: 16400 - protein, 744 aa, Burkholderia fungorum
MKITVTQPFDTAHTGKALLVVFARVAVADRPASLAPTGVDSDLWHLESELRTTQVELGSTIEELEESNSELRVSNEEILSMNEELRSANEELETSKEELQALNEQLNVVNSQLGQKVHELEMLSEDVTNLLASTEIATLLLDGHAVIKRFTPRAARIFGLALADIDRPITNVLGNPLGDALLEDVQRVLSAQTGQAEKEIETVTGEWYVRRITPYIAVKGASPAGVVVTWNDITHVKASDERSRRLAAVVQDSNDAMTVFDLNGRLMAWNRAATAMYGYTEAEALGMTVSDMLPPGARQDHLDFIRYAAHNEALHSYETQRVTKGGRVVDIWITLSILSDDQGHAVAIATTERELTDRSLSNAQLRERAERLAQADRRKNEFLAMLGHELRNPLAALCSSGDLLASETIDPRQKSWAVGVIQRQGRSMTQLVNEMLDLTRITSGSIELRRQAVTLKAVIQSAVEVCQPIIDERHHTLSVSLPDEPVLMYVDPTRLSQVVENIVINAARYTEPGGHISLTATRTGRRLSLRVKDNGRGIPASMLSTLFDMFVQGPVPYGQLHNGLGVGLSVVRRLVELHGGSVRAISDGRTGSEFIVDLPLGMIPPGVEQAGTPQEPVNAGPRKILIIDDNADASEALAMLLAAEGHVVETRLDGPGGLEAASTFRPDVVLLDIGLPGMDGYEVAKQLRDSVATYDTMLIAVTGYGQPGDQLRSAEAGLDYHLVKPVDINALTRLLAVQVKPRGR

SEQ ID NO: 16401 - protein, 427 aa, Burkholderia fungorum
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 16402 - protein, 484 aa, Burkholderia fungorum
MIFHESRHDTAKPRKDLSIKKLTVDRLGILYIIGPTNLTLMETVMLSHEDNETLVRVGPGTPTGQFMRLYWLPFLPSSDLTVDGQPQRVRLLGEDLIAFRDSEGRVGLVDHVCPHRGAPLVFGRNENCGLRCVYHGWQFGVDGQVIDTPAEPAESRLKDKVRIRSYPCRERNGIVWAYMGEADANALPPLPNLEWNMVPLENVHFSFRVQECNWLQAVEGEIDSAHAPILHGRIDSQGAINEWTAKRDLRPVFECQRREFGISIASRRVLDDSHHYWRVNQFLFPFYTLVPPQSKYPELSGHAWVPVDDENTLCLMFSYTPAAPLYEKTRKLFEDGHAGRETGHASAHAFAPRPVTQPYAKYWTRFNLESAFQFDYDAQTKTWFSGLPGLWVQDAACQSGVAPIYDRRKENLGISDTGVAMTRRLLLENVRKLASERVSPVRVDDPDLWMVRAVSLTLPAGAPWQSDGAEHMRARLGADFGYTP

SEQ ID NO: 16403 - protein, 112 aa, Burkholderia fungorum
MKRITAVIKPFKLDEVREALAEVGLTGLTVTEVKGFGRQKGHTELYRGAEYVVDFLPKVKIEVVVADIQCDQVIDAIIGAARTGKIGDGKIFVADVERVIRIRTGEENEAAV

SEQ ID NO: 16404 - protein, 326 aa, Burkholderia fungorum
MRNCPPASGEPCVDAERSRENRLFRRDLAEALHRGEVSTRTESRTRARPGCRERGSVAARTRAARRRNHVNTLQSTLTGQHAVVTGGGSGIGAAVAQALLHAGARVTLMGRNAERLDAQREKCQTLGEVACISVDVTQEDSVESAFREAGAVDILINNAGQAQAAPFTHTDLALWQRMLDVNLTGVFLGTRAVLPGMLERGHGRIVNVASTAGQIGYAYVAAYCAAKHGVIGLTRSLALEVATKGVTVNAVCPGYTETELLHASLEQITSKTSRTEQQARETLLRSNPQHRFVSPDQVANAVLWLCQPGSDAVTGQSISISGGEVM

SEQ ID NO: 16405 - protein, 262 aa, Burkholderia fungorum
MDTEQHQLASSQDAPLPPVVLITGALAGIGRATALAFARLGSRVVVSGRRPDAGEALAEELRALGAEARFVAADVRSEEDVSKLVEQAVESFGRLDVAVNNAGTEGTPGPLTGQTLESYDSVFDTNVRGTLLPMKYELRVMQRQGFGSIVNISSTMGERGAGNMSIYVGSKHAVEGITKSAAIEAAAYGVRVNAVAPGPTETAMLDRLTNTPAGKAAFYATVPLRRAGTPEEIAEAIVFVASEKASFITGQIVRVNGGRTAS

SEQ ID NO: 16406 - protein, 306 aa, Burkholderia fungorum
MRCVFRTPRMSIALGRFVMSDTQRPTPPFPKQQQNHTPGHTAEMQPQPDHGERSYRGSGRLAGKAAIVTGGDSGIGRAVAIAFAREGADVLISYLDEDDDARETARWIEEAGRKAVLLPGDITNPAHCKAIVERAIEAFGRLDVLVNNAAYQMSYPSLDAISDQEWDKTFDTNIGAMFRITRAAVKHMKPGAAIVNTTSINADHPNPGLIAYAATKGAIQNFTGGLAQLLAEKGIRANCVAPGPIWTPLIPSTMPPEKVEQFGAQVPMKRPGQPAELAAAYVMLASDEASYISGATIAVTGGSPII

SEQ ID NO: 16407 - protein, 112 aa, Burkholderia fungorum
MKLITAIIKPFKLDEAREALSAIGVSGITVTEVKGFGRQKGHTELYRGAEYVVDFLPKVKIEAAVSDDIVDQAIEALERAARTGKIGDGKIFVTPIEQVIRIRTGETGADAL

SEQ ID NO: 16408 - protein, 359 aa, Burkholderia fungorum
MNQPAQTATPVRPDAAYTRGAALPALLKSRILILDGAMGTMIQRYKLDEARYRGERFKDYGRDIKGNNELLSITQPQIISEIHEQYLAAGADIVETNTFGATTVAQADYGMEALAVEMNLESAKLARAACDKYSTPDKPRFVAGAIGPTPKTASISPDVNDPGARNVTFDELRAAYYEQARALLDGGVDLFLVETIFDTLNAKAALFALDELFEDTGERLPIMISGTVTDASGRILSGQTVEAFWNSLRHAKPLTFGLNCALGAALMRPYIAELAKLCDTYVSCYPNAGLPNPMSDTGFDELPADTSGLLKEFAQAGLVNIAGGCCGTTPEHIAAIAQALAGVKPRVWANYRETDTETV

SEQ ID NO: 16409 - protein, 338 aa, Burkholderia fungorum
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 16410 - protein, 241 aa, Burkholderia fungorum
MSRRVLVTGASRGIGRAIAYKLAADGFAVSVHCRTGRSEADAVATGIAAQGGTARVLQFDVRERAVCREVLEADVAANGPYYGIVCSAGVTRDAAFPALSGEDWDVVIETGLDSFYNVVHPLTMPMVRARQGGRIVTIASVSGVMGNRGQVNYSAAKAGLIGATKALAVELATRNITVNCVAPGLIETGMLDELPLEQVLKTVPMNRVGQPAEVASVVSFLMSDAASYVTRQVIGVNGGMI

SEQ ID NO: 16411 - protein, 487 aa, Burkholderia fungorum
MASPDHAGSVANSSGAVYSDTAATSARAATPLDAGSISARLDRLPATRSIWKLVVLLSLGFFFELYDLLYSGYVAPGLVKSGLLTATTHGLFGSTGVASFIAALFSGLFIGTIACGFLADRFGRRAVFTYSLLWYTAANIVMAFQETATGLNFWRFLAGIGIGVELVTIGTYISELVPKQIRGRAFACEQAVGFTAVPVVAFLSYLLVPRTLLGLDGWRWVVLIGAHGALFVWWIRRALPESPRWLAQQGRLAEADRVMTELEAKVRREYGRELPPPAPPVPVAPRGSFRDMWVPPYRSRTLMMTIFNIFQTVGFYGFANWVPTLLIKQGITITTSLMYSSVIALAAPLGPVIGLFIGDRFERKTVIVVMAGVNIVCGLWFSQAAGAVLLVSLGVGLTLAGNIISYSFHAYQAELFPTSIRARAVGFVYSWSRFSAIFTAFLIAAVLKHFGTGGVFVFIAGAMLIVMLAIGLMGPRTNGIELEKISK

SEQ ID NO: 16412 - protein, 265 aa, Burkholderia fungorum
MMTMTSSNKRFTEKVVIVTGAAQGIGRGVALRAAAEGAIVVLADRAELVHEVEAEIAALGSPSLAVIADLETYAGACKLMRAALDAFGKIDVLINNVGGTIWAKPYEEYEEAQIEAEVRRSLFPTLWSCRAVLPAMIAQRRGAIVNVSSIATRSIYRVPYAASKGGVNALTASLAFEHADDGIRVNAVATGGTEAPPRKVPRNTAPQSEQEARWYRGIVDQTIASSLMRRYGTIDEQVGAILFLASDEASYITGTVLPAGGGDLG

SEQ ID NO: 16413 - protein, 442 aa, Burkholderia fungorum
MSQSLAPALEPGASAAAHDDLLYRKVSLRIIPFLFLCYVVSFLDRINIGFAQLQMKHDLGFSDAMYGLGAAVFYVGYVLCEVPSNMLLARFGARRTFTRIMLLWGIASVGMMLVSKPAHFYALRFMLGVFEAGFFPGIVLYLTYWYPARRRAAVLSIFFAGVAVAGVLGGLVSGWIMRDMGGVLGLFGWQWMFVIEGAPAIVLGLLAAFYLVDGPQHATWLTAAEKAQLIAQRDEDRRPSSAAHSSRSFVQALRNPRVYLFAFIYFSLTCASLTLNFWMPLMIRDFGVHDVLAISLYTVIPNAIGAVGLILIARHSDRRGERRRHFAVCTIGGGVALSLLTLHLSSFPAMLAILSLAAVLIFAALPIFWTVPSGYLSGTAAAAGIALISSIGITSGIVSPWVIGLIKTHTGSMDNALYLLTALLFVSGVALLLGVPKDVKHV

SEQ ID NO: 16414 - protein, 650 aa, Burkholderia fungorum
MSAPPNACGYARRPCLWRHAARMEKAVHVSMEQDSREMQLRALMKLGKERGFLTHTEIVDHLPDCVAQADAIEGIVKAFNDVGIAVRDFAPTGDALLLGDAAQQSAPDDVAEDETATALTIAISEPGPAADPMRAYLREMGATPLLTREGEIAVARRIEACLREMLEVIALRPATVDAILSRADRVAAGELDIDDLVDGFLEQQPDEMLPAMQGATAEGAAGSKADSGVPTSASESAGAIEADEARIARLTAGCNAIFSQVREQLASWRAAVAGRTGQREEAQSTLVLIASTLGQIRFSARTIGELSADVRRAVEEIRGIERNVLRLAVNQGGMARDMFVETFVGSETDPEWLARAAAAAPACSAALMRCAPSIHSQQEKLAQIEAREGLSLQELKWISRKMNVADRELQDARRAMIEANLRLVVSVAKKYVQSGMPLLDLVQEGNIGLMKAVDRFEYRRGFKFSTYATWWIRQSVSRAIADYGRTIRVPVHMADAMHRVKRVAGEMRQETGRPARSSELAARLGMSEEKVRSVQRVTRQPVSLDVPIGEEADTTLGEMVEDSSTLAPLDALLQADLRVAIDAALGVLTPREAKVIKLRFGVDAVSEHTLEELGDQFDVTRERVRQIQNKALQKLRHSDGISTLKNYLDH

SEQ ID NO: 16415 - protein, 474 aa, Burkholderia fungorum
MMNAAVIDSKNSQDFIVADMSLADWGRKELNIAETEMPGLVQTREEYKVQQPLKGARIAGSLHMTIQTGVLIETLTALGADVRWASCNIFSTQDHAAAAIAKAGTPVFAFKGESLDEYWEFSHRIFEWPNGEFANMILDDGGDATLLLILGSKAEKDRSVISKPTNEEEVALYKSIERHLDADPTWYSTRLAHIKGVTEETTTGVHRLYQMEKEGRLPFPAINVNDSVTKSKFDNLYGCRESLVDGIKRATDVMIAGKIAVVAGYGDVGKGCAQSLRGLGATVWVTEIDPICALQAAMEGYRVVTMEYAADKADIFVTATGNYHVIGHDHMKAMRHNAIVCNIGHFDSEIDVASTRQYQWDNIKPQVDHIIFPDGKRVILLAEGRLVNLGCATGHPSFVMSNSFTNQTLAQIELFTQGNKYENKVYVLPKHLDEKVARLHLARIGANLTVLSDEQAGYIGVDKNGPFKPNHYRY

SEQ ID NO: 16416 - protein, 519 aa, Burkholderia fungorum
MPRRRDAVRHRTDFDRRDAHRGSGSFSAYLTSSFHSLRHSSRDRHEPGTLTSNQELHAMTFLKSPPPTPEDVADEYAATISGSSLPKYRIPEASSDRRAVFDLVRDELFMDGNSRQNVATFCTTYADDEVRHLMDLSIDKNMIDKDEYPQTAEIEMRCVHMLADLWHASKAWKTTGCSTTGSSEACMLGGLALKWQWKKRREAQGKPTDKPNFVCGPVQVCWAKFARYFDVEMRQVPLRGEATGLTPEDLAEYCDENTIGVVATLGITFTCVYEPVKALAGALDALQANVGLDIPIHVDAASGGFVAPFIQPDLEWDFSVPRVKSINASGHKYGLAPLGVGWVVWRSTQDLPDELIFRVDYLGGDMPTFALNFSRPAGQIIAQYYMLLRLGREGYRRIQQECADTAQALADGLAKIDQLEMIYDGRGALPAVCYKLKHPETAGFTLFDLSDQVRMRGWQIASYELPAGREDTIVQRVLIRRGVTRDMAAMLLEDIRHAIGHLTKNPVLHSSAGPTFHHN

SEQ ID NO: 16417 - protein, 574 aa, Burkholderia fungorum
MERAALDRAPGGVERERSGRLASTARHELHARATGCAGRAQAGEGTGSRKAHRDSRWIAKGDEAGAAMQSYGRDRKVNVSTGSLLSDFCTGRTRQCRSGRHRPFATRCQPPEKLHAPCPVFKPAAIRPNPSARTHPPEPIRPNPSARTHPPEHYGCRIMNSPAGDLPQGQLCCSKPNSYDSFKRRGGRLLHNAMRADHSARVRRGPLRFGRRGVVAPLAIYRPSVPPTCPSASPVRPYRRCGVRRPASGSSAGAQHLERHGRVERMSLQTPSRFPRGFPLRLPQSRNGQLVLALAVVYLVWGSTYLAVHVALGSFPPLLLSGLRNLFAGVGLFVFAARRNPVWPGAAEIRNAGLVGTMLVGLSSGMLAYGMRTVGTGTAAVMVATVPLFATVIAAVAGRKIGRGEWFAVGLGLAGIAILSHGDSAPGSAGGSLAILCGALFWAGGAHLAGRLKLPSDLFLSTSLQIGLGGAMSTLVAWVSGERMLELHWLPLLAFIYLMLIGTMAAYVAYGFLIRHTSPIIASSCMYVNPVVAVALGALLLGEPVTRSTVVATIVILASVGLSFWFDYRKKGLA

SEQ ID NO: 16418 - protein, 1226 aa, Burkholderia fungorum
MITPVAPRQNASPETSEKYSESIRFAKPKTEKMTASQAVDQNRFRSIIRRNIALPLGVGLVTMAVFVGLIAYLVSTMNWAEHSERVIGQANEMLRLAVDRESSMRGFLITGDESFLTPYEEGGPRFKTQIEALQELVSDNPPQVEKLKQIEAIQQRWSVYAEQMIDARRRNQDFESAVASGRGKIEFDETRREFGDFLDVELRLRQERAEATRRVTTTLVSVFLLFSLSVSGLLAWMGRRELMSLSSTYDNALRQQAEQTEMLQEQVWLRSGQRLLAEKVVGQATPPLVGRAMLDFLAQYLDAAVAALYVRDKRHGTLRRIATYGFSRESEQATARNFEEGETLIGQAAAARRTLVLRDVPENYVQVVSATGKSAPKNLLIMPIENDGEVNGVVELGFVRELTPRDQEFMELIASSMGDFVEAALYRERLQDALAETQQLNEELQVQQEELRVSNEGLEERGRALMESQTRLEAQQAELEQTNVQLEEYAQRLERQKSDLLRAQDDLAANAARLEQSSRYKSEFLANMSHELRTPLNSSLILAKLLQQNRAGNLTEEQVRYAETIHASNSDLLVLINDILDLSKVEAGQVTVELETVSIDATLQALEEMFKPMAAARQLRLAFERLPGTPDTFISDGQRVTQILRNLLSNAVKFTEHGEVALSVAPAEGGMLRIDVRDSGIGIAPDKLDMIFEAFQQADGSTSRQYGGSGLGLSISREFSRLLGGRITVASEVGKGSVFTLWLPLDAEAALSASEGAAAPTPPSAPVPAQASARGAAGSMAEPLLTRPSSSGGAATVITPANGLTSGPTSGLTTGNASETPIGPIADDRDNRTRAGRLIVAVEDDVAFAEILRDLTHELDFDFVHASDAASGLALVRDMRPAAVLLDVGLPDRSGLTVLEWLKNDPLTRHIPIHIVSATDHADKALHLGAIGYTLKPTARSTMEAAIRRLEARLQQRLKRVLVIEDDTPMRESIRALLQSENTEIVAVATLAEALDYLAKVTFDCVVTDLALPDGTGYDLLERLAANTAHVSLPVIVYTGRMLSDEEEHRLRRYSKSIIIKGAKSPERLLDEVTLFLHSVESSLAPEQQRMLRTVRQRDNAFEGRTILLAEDDVRNIFALSHVLEPLGAKLQIARNGREALDALENGPEVHLILMDIMMPEMDGLTAMGEIRRNPRFAHLPIIALTAKAMANDRTRCLEAGADDYVSKPIDVDKLVALCRVWLRQR

SEQ ID NO: 16419 - protein, 308 aa, Burkholderia fungorum
MPNVPAHNWGLEQIVADLRASREQLHRTRHPLGIRELPSREAVVNIVAGLRAALFPTHYGAPDLTDETVDYYVGHTLESTLRLLAEQIRRALRFLPEFGETPDADLQARAFEVAREFGTQLPGIRALLVSDIQAAFTGDPAAQHITEILLCYPGVWAMTHHRLAHALHRLGVPLLARFINEIAHSATGIDIHPGATIGPSFFIDHGTGVVIGETAIIGEHVRVYQAVTLGAKSFAADLDGALIKGNARHPIVEDDVVIYAGATILGRVTIGRGSVIGGNVWLTHSVPPGSSVSQGKIREGERTDEGRQ

SEQ ID NO: 16420 - protein, 435 aa, Burkholderia fungorum
MSGSSRLATMLPAICWVATFFPLVHGDPPMHAVPPLEQDTGDATVDVSPAQAASQKSAHAPAQAANDAPVRDLRRVGIHPDYWYPLAWSHEVKRGKTHGVTFAGDPIVLARTEGGKVFALEDRCAHRQVPLHQGVVDGESIRCGYHGWTYDCSGKCIDVPYLGRERLPNGVRSYPCREVEGLIFVFPGNAALAEQRPLPDLSSVSDKKYKTRRFGRPVNCHYSFMHENLMDMNHQFLHRKQMGQMRARSLGRRTGEGWVEVDYTFARMAGQQPIGEAIVFGQSRKTGGDNDKDVMTIRTEYPYQTLQIRTSEQTLVMNLWIVYVPLDREQRTNRTFGLLSIRKPGVPGVLNLAWPLLVWFTERIFKEDREIVEAEQRAHDSQGADWNHEVFPVINELRALLRERGAPDQVVGAGTGDTEVIRFWDSRNGSPLAKS

SEQ ID NO: 16421 - protein, 269 aa, Burkholderia fungorum
MIQIDLTGQVAVVTGGSSGIGLATAELFLRAGASVAICGRDTERLAQAEAALKAQFPQAQLLARRCNVLDADDVKAFAEAVQSRFGRTGMLINNAGQGRVSTFADTTDEAWREELDLKYFSVIRPTRAFLPMLRDASASNSNAAIVCVNSLLALQPEPHMVATSSARAGVQNLLKSLAVELAPQRIRVNSILIGIVESGQWRRRYAKEAQPGQSWEDWTAELARKKNIPLGRFGRPEEAAQALFYLATTLSSYTTGSHIDVSGGVARHV

SEQ ID NO: 16422 - protein, 363 aa, Burkholderia fungorum
MTSPNTTQGAADPIQSYLNQGLRNYWYPVAPSWQVGDAPVGITRLGDQIVLWRDKEGKVRALEDRCPHRGARLSLGWNLGGSVACWYHGIEVDGGGTVTKVPAVSNCPLEGQKCVKSYPVEEHAGAIFLWFGDDAHKEPAPLVLPEELVGEEYASFLCMSHWKCNYQYAIDNVMDPMHGAYLHATSHSMAEGDKQADMRVRKTETGLMFEKIGQRDVNFDWVELGETGCLWMRLAIPYKKKFGPGGNFGIIGFAVPVDEDNCQVYFWRTRKVQGWQRDAWRFMYRNRLEGLHWAVLEQDRYVLESMAPNARDHEFLYQHDVGMTRVRRMLRQRAQQHFADLDAHRAQAVSATPAAAEAGHSHA

SEQ ID NO: 16423 - protein, 136 aa, Burkholderia fungorum
MLYIYRIAHLLHRLHVPFLPWALKVFNRVVFSVSLPPSVIVGRNVVFGYQGLGIVVHRHAVLGSDIVIAPNVVIGGRGQPGAPIIEDNVLIGAGACILGPVTIGRNVKIGANAVVTFDVPPNVTVAGVPARIVKLR

SEQ ID NO: 16424 - protein, 455 aa, Burkholderia fungorum
MKNVMSSLKSGDWRALVACFLYFDTGFTVWVLYGPLAPFISKSIAMTPAQQGLLVAVPVLSAAILRVTLGNLYQSAHGKRIALMGVLLSAVPTIVLPLMPSVPSYTVLLVLGVFLGVGGASFAVALPMAGSNYPPKVQGLVLGLAAAGNIGAVLDGFLFPQLATHYGWQMAAGGALPLLAIAAITLYFWANDSGVKSGSVLRAFGSFTVTLVGLIVLVLLVEAGMFGSGKTGVLLLPVIGALLAIAVLPKRYRAVLAERDTWAIMLVYSITFGGFVGMSSYVSLLLTNLYQLSKIDAGLFMALLAATGAMVRPLGGLIADKVSGVRALTFLLAIISLCDFVFAAAMPAMAGGIALLLVLYVAFGLGNGATFQLVPHRWAGRTGLMSGIVGAAGGIGGFYLPVVMGIAKESTGSYQMGFATFGVLAACAFLAIVALRRPWMAWSMHSGVMHAHATE

SEQ ID NO: 16425 - protein, 515 aa, Burkholderia fungorum
MVRGRPGTTKAQCTKTGETPGCSHRRRGLQIWNCATAPNPTDKETAVMGMRPDPTFHASPKLAMDAPAEEYAYTVLLSPDFSQPDALAVIDVKPGSPTYSQVVHTVPVPYKGDEFHHFGWNACSSSLSPLTGHAFLERRYLIVPGMRSSRIYIVDTHPHPTQARIHKIIEPEEIFSKTGYSRPHTVHCGPEGIYISTLGGAGKDGTDGPPGIFIMDCETFEVLGRWEIDRGLQEKHYDFWWNLPRDYMVSSEWALPPQFENGIVAEDLLANKYGHRIHFWDLSGRRNVQTIDLGANHQMALEVRPAHDPSREYGFIGVVVDTTNLEGSIWTWWREGGEFHIEKTVTIPPEPAATELLPPLLQGFGAVPPLVTDIDLSIDDKFLYVACWGTGEMRQYDVTEPRKPKLTGSVHIGGIARRTPHPNGKTFAGGPQMVEISRDGKRVYWTNSLYSTWDNQFYPGGVPAAQVMARAEPGGGLTLTDDYWVDFPDGYRAHQIRLEGGDCSTDSFCYPSVGV

SEQ ID NO: 16426 - protein, 528 aa, Burkholderia fungorum
MNNVELFHYLLLLVCGAGLLTWLAERLTIPPAVMLLVGGSAVALSGPHMTVGMDPNLILTAVLPPLLMSSSFYTAWRDFRREIATISSLALGAVVFTTVAVAVAVHAFEPALSWPACFALGAIVSPPDAVAAKAMLERYPLPSRLVTVLEGESLVNDASGLLLYQMAIAAVLVGQFTVSRAATVLLMLMVIGIATGAACGQAMIWLIRRLPDPMLRIVLTFLMAWGSYSVAEELGGSGVLSVVTCGLVLGIHQHRVFDAHTRIKATATWEVIVFVLDALVFILIGLALEGIVSRMGNVSSMLKTGVGVALPATVAAILARLLWVAAAIYLPSLLSSRLGKSPHPWSRGEAAILGWAGMRGVVSLAAALALPDNFPGRDVIVFSTFLVIFATLVIQGGSLAFLIRLTGLRPVRSTTMSELEARTHTFGASLKEIEKISQSATDDDKPLVQRLIDEYKVRVSNNERAFEAGKEHVELRARQLRLELDLVAISRQALLGLHHEGKIQDSVLHRLEAELDLEELRLHRLLEP

SEQ ID NO: 16427 - protein, 504 aa, Burkholderia fungorum
MQPKRVCPMPAASRHKTRGRSSRQAMHCWSTCAQPRSASSSDWCRAVCTLPGRPARASRVIRVSCANSRRGPARTPWCCCCAAAATVRRSPPRPPRKRASPRCSMFWKVSRGIWTARNDAAPATAGAFTACRGFRTDFLAGPRRTIRGVTSVAVFDVDDIVLALQTVRQQWREVQKRSLEPGGRELPGREALSQVVDTLKGVLFPMRLGPPDLRQESENFYVGHALDAALHALLSQARLELHYRSRHAPPAADVIEREASVAVRAFAARLPAIRTLLDSDVLAAFHGDPAAGSVDEVLLCYPGVLAMIHHRLAHELYRLGLPLLARIVAELAHAQTGIDIHPGARIGAGFFIDHGTGVVIGETSIIGERVRVYQAVTLGAKRFPRDAEGHLEKGHARHPIVEDDVVIYAGATILGRVTLGRGAVIGGNVWLTQDVAPGSHVTQAVSRSEGIGVVSAAPHKPVPPNTLAEEPAVAGVHGDPDRQKLRGAGAAPSRVTGLVAGTVG

SEQ ID NO: 16428 - protein, 292 aa, Burkholderia fungorum
MNVLLVYAHPEPKSLNGSLKDFTVKRLQDAGHTVQVSDLYAMKWKAVLDADDSLAKEPGERFYPSRDSKHAFENGLQSKDIELEQEKLMWADAVILQFPLWWFTMPAILKGWVERVYAYGFAYGVGEHSDARWGERYGEGRLAGKRAMLVVTTGGWESHYSPRGINGPMDDVLFPIQHGILYYPGFDVLPPFVIYRTSRIDETNYPAVQDALGQRLDNLWTTAPIPFRAQNGGAYTIPELTLRADIAPDQVGFGAHVEPQRDGDAAGSSYSISAGRRASVAHYTSPSRTDRS

SEQ ID NO: 16429 - protein, 256 aa, Burkholderia fungorum
MGDSMDLELRGRTALVTGASTGIGTGIARALASEGVRLAITARRDALLEEVAASIVAEGGVRPIVIVGDLTAPGHIERILAQATDALGQIDILVNNAGASRPAPLDSGEDVWEEAFALNFTAARRMTHAVLPAMRSRKWGRVINISGSMEPRGLNPSGPAKAALHLWAKSLSREIAADGITINTIPPGRIHSEQIEKRLHPTEESKQAFIARNVPIGYFGDPLDIGYLAAFLASPRARYITGDVIPVDGGMHFYAH

SEQ ID NO: 16430 - protein, 662 aa, Burkholderia fungorum
MRADPIQRAIDEDLVRVLYAQDPIAFFSHWFSIAVLVAIYWPNIPSPPLFIACFGFYAAANCGGLALWICNRRYPELVSPRGWIYLHALRGVLLYSAPGIAVWFAFQSPQTDLPLLHTVMLVTLAAGVFMSNGFDLLNFSTAIPFLLFPSIVMHFGTHTFDRTILAIVLAFFFCAINVYALSYRKLFQQVVQARVDQQYLAESLAAQKRVAEEASLAKTRFFAAASHDLRQPLHAIGLLAASLNDAAATPAQHAKTAEHIVYNVEALNQLFNQVLDLARLESGVTQVIRLHFRLSELFERVGSQYRPQAAAKGLALRIAPTTMVVHDDPVLLERVLSNLLSNAVRYTEEGAIWLGVRRAGRPAGGHIEVRDSGIGIPVEEQERIFEEFYQVANPQRDARQGHGLGLPTVKRLVEMLGGKLQLRSAPGRGSVFRFPVQAGDAGGIVASLNEAVAGGPSAQGRRVLCIDDDPSILEGLVSLLGRWGCSVLGARDEADALAALEGGFVPDAVLCDYQLANHRTGAQALTAVRNALARAGHDNVVTLLITGDMASAELAALALQGIPVLHKPVTPARLRRTLEMLWQQAELDKGRAAAAPELRADPTGKEVGGRPASGAMPAAASVPQSEAGMAGMAGMAGMGSQSQSQPRSTRYESTPSQSEPQK

SEQ ID NO: 16431 - protein, 208 aa, Burkholderia fungorum
MITIWGRTNSVNVQKVLWCCDELVLPYERIDAGLQFGRNDEPAYLAMNPTGKIPTLVDDDFVLWESNSILRYLVLNYGESSLLYPSEPKARASIDRWLDWSLSTLQPAERPVFWALVRTPAAARDTAKLASDFDAVALLWRMLDSHLQGRFFLEGEKFTLADIVIGAYAKRWFGVEGVERPPLPNLERWYSRIATRTGFKKYVDFPLT

SEQ ID NO: 16432 - protein, 471 aa, Burkholderia fungorum
MYMEKEIAGTAGVQASVSARLDRLPPTRYFSGLVARIAIGGWFEFYEMFMAAYISLGLISSGLYRATTAGLFDVDGFASFLGSFFAGMFVGTVALGGFTDRFGRRAVFTCAMLIYSVATFAAAFQHSPQAMDLWRFVAGLGIGVQLITVDTYISELTPHHTRGRYSAFSILVILTSVPTVAVLSFLLVPHTILGLEGWRWVMIIGSAGAVLIWFMRRGLPESPRWLESKGRLDEARAIVDAIEARVVAETGRALQAPAQRAPQPLTGEHGGSWSEMWKGRYLSRTIMLSFFNFFQTFGVYGFGAWVPVLLYTKGITITHSLLYTMVIAFATPLGALGAMACAERIQRKWQLVGCAIVVAVAGVLFGMVREPLLILLFGSAVTIANNWLIGIFHTYQAELYPTRIRARAVGFVFSWSRLSSIFVGFWVAALLKHSGVPAVFVLISSAMFVIVVMVGLLGPKTNGIRLEELSQ

SEQ ID NO: 16433 - protein, 1490 aa, Burkholderia fungorum
MSSVNFPPDVAMRRALERVRLCLLAWCLIAAAQTATAAQLFDNRSNSQVVAAFPAKLTVGVLAGGWLPLDALQDGRLTGMSVDYLRALVGPNVVIEAKAFPDVSQLLAAACAGNVDLLTSVARTPERERCLSFTAPYFRSSSSAVVRRDGDSYASPALIAGARIAVEKGFALERVARERFPHAQISAFATTHAALSAVVRGDADVYLGFTPAVQYALATEEFRGLHVAFEESSRTANLRFAVPRSHAALRDQLDEALASMNPADEAAIRVRWLSGNFDAKPVPTAPRLVLTPQEQAWLRSLPPLQIGFDNGWSPFSYVDSSGRPAGIAADYLAYLSRTLGVVFNRARTADWPTAIESFQRGELAILATASIHDPRLKGARHTVAYESYPLVIVGREDEPAARSLSDFASRRVVVSSHVAGSIPLAFERIPADHVVIAPSLDDALDMVAAGEADVLVGNVAAIDILLKQRYDSVLKILGTVGESDALDFAVRTDLSPLAGLIDRALLAMPPAEKQRIRQKWVTGNSPESGLWSVTAVRLLPLLIGIGVALLITLRAYLLLQREVRLRKKTELELELQLNFQETMMKMVPYPLVAIDLDGRYIAVNEAYEQACGMSREAVIGRNTVDVQTWGEANSRILTDMTREMLNGRETAQLELQFERGAGNVRHGLFWASVCRDGDGQPACVLGTVVDITDIRRAEMRARETERRLFDVTRSLPAVVFQLRRTSDGAYSFPYIGGDTRHLLGGKDGSLNRSDHVDFQRVCEEDRAFVLAELERSALCETPVNMEFRFEGDEEIKWARAELVPRREADDSVVWSGYWVDASVEHARSDELARARDLAEAAARAKDDFFAMMSHEIRTPMNGVLGLVEVLERTPLNTDQGEMLGMIHESAGALLQILDDLLDYSKIEAGRLTIEAESIDIRELVDNAVGLLAGRAHEKGLKVRVDIAPDVAATLRGDSVRLRQILFNLLGNAIKFTPQGEVDVRVSVFAQADGVQTLEMTVEDTGIGIAPEVQNRLFEPFVQAESSTTRRFGGTGLGLTICRKLIDLMGGSLALHSEPGSGTRMTVRLDMAVETQRYSVNGLRGKRGLVATGDARVAQALMHFGEALGLTLRRVPPDAPELRDRVALANLDLLFVNEDVTLPADVRPRTRVICLTEKPKPTGYRILDDNVRLSINPISWRGLGAACAAAMTGLPSVPRSAGTPRAPEGGPPPPDRERAIASGRLILVAEDHPVNQELIRHQLALLGFACDVTNDGAEALAALQRTSYGCLITDCHMPNVSGYELTRRIREGEEGGAHRLPILGITANTAPEDLNLCRDAGMDDSLVKPTRLATLRDYLSRWFGSDSAAHAAPSESVGAPAIAATDVQGGADPFVPVDLGHMTQLWGSESTVKALLDSFVSSVREDVQSLSPLLERVGSERTELERVREWLHRVAGAASVLQYPPLLMALEDYRREINVKPPERVRNDGMVLIDKCNAMLDGIEQQAALLV

SEQ ID NO: 16434 - protein, 350 aa, Burkholderia fungorum
MKSAKNLRPVRSTRRRWGHRLARWAGLLSYDLFPTRLRPMSTSALPARRAPDSFAILLMIGLCAIWGLQQVAIKSTNVALPPVFQAGLRSAIAAVLVWGWARSRGTPLFRDDGTLGAGLLAGVLFASEFVCIFLGLTLTSASRMAVFLYTAPCFTALGLHWFVDGERMRRIQWLGIFVAFAGMALAFADGFLHGRAAQSPVLTGVAGDALGVLAGIAWAATTVVVRATRLAHSSASKTLFYQLTVSAAVLLALALALGQARVETVTPLAMVSLAYQAVVVAFVSYLVWFWLLTRYIASRLSVFSFLTPLFGVTFGVLLLGESFSLRFLMAAVLVLTGIALVNAPAKRVTV

SEQ ID NO: 16435 - protein, 468 aa, Burkholderia fungorum
MGMRPDPTFHASPKLAMDAPAENYAYTLLLSPDFSQPDALAVIDVKPGSPTYSKVVHTVPVPNKGDEFHHFGWNACSSALSPLTGHAFLERRYLIIPGMRSSRIYIVDTKPHPTQARLHKIIEPEEIFRKTGYSRPHTVHCGPEGIYVSTLGGGGKEGTDGPPGIFIMDCETFEVLGRWEIDRGPQEKHYDFWWNLPRDYMVSSEWALPPQFENGIVAEDLLSNRYGHHIHFWDLRARRNVQSIDLGANHQMALEVRPAHDPSREYGFIGVVVDTTNLEGSIWTWWREGGQFHIEKTATIPPEPAAAELLPPLLQGFGAVPPLVTDIDLSIDDKFLYVACWGTGEMRQYDVTDPRKPKLAGSVHIGGIARRTPHPNGETFAGGPQMVEISRDGKRVYWTNSLYSSWDNQFYPNGVPAAQVMARAEPGGGLTLADDYWVAFPDGYRAHQIRLEGGDCSTDSFCYPSVGI

SEQ ID NO: 16436 - protein, 568 aa, Burkholderia fungorum
MESNYPPAQTDELAMRAARPADHAAENGVLLRIARAQLGSRERLLQEIADAALLLCDAGSSGISLVEGDDQHKQFRWLAVAGLCVGLQGKTTPWRDCPCGVALESAAPQLFVRPQDHFASLRFPGVNITEGLVVPIPTDNGFVGAIWVMSHTPARQFDREDVRLLANLAVSAGAALTTVDARDTGEGSERRHSEFIAMLGHELRNPMAPIDSAVGAAKQLCSDNEKAVEVLTIAQRQMRHLRTLVDDLLDAARLKHGKLAIKHSNTSLNEIAFDAVTAVRHHIESRRHSLKVTGLDEQVPVRADHVRLSQVLGNLLSNAAKYTPTGGTIELTVKVAADEEPAQPDLVVIEVKDNGIGIDSSVQPHVFELFAQSARGNARAEGGLGIGLAVAKRMVELHDGTISLQSDGSGRGTSVTLRLPILRSRDDSPATVDTAQPRELRPVRLLLVDDNADALQSLGMLLELEGHQVTMSASGREAVQLIRQTLPEVAIIDVGMPDMDGFDVATAVRSDSRLDDVTLVALTGYAAESDKSRALAAGFDYHLTKPLSLEKLQYILANRAGGKLGGIV

SEQ ID NO: 16437 - protein, 378 aa, Burkholderia fungorum
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 16438 - protein, 300 aa, Burkholderia fungorum
MWRRARRSSGHRNSENSRSFSQLPKGAYLSSGYQNRILVSSKQFPASVLLQGRMHDMTRLNGKTAVITGGATGIGRAAARRFIEEGAFVFIYGRRQEALDAAVAELGPNARAVKGSVSDEADLDRLYAAVKAERGTLDIVFANAGAGSPLALGKITAQHIDETFDTNVKGTIFTVQKALPLMGQGGSIILTGSSAGTTGAPGMSAYSASKAAVRNLARTWAEDLKGTGIRVNVLSPGATATELAKAALGEEGQKVYAAMTPLQRMADPSEIGAVAAFLASSDSSFMTASEVAVDGGLAQL

SEQ ID NO: 16439 - protein, 250 aa, Burkholderia fungorum
MNRIDLEGRVVAITGGARGIGYAVAQRALNSGASVALWDVDAERLARSQRELSELGKVTAVAVELTQEAAVAQAVAQTVADHGAIDVLINCAGITGGNGTTWELEPDIWRRVIDVNLIGPYLTCRAVVPQMLRQGYGRIVNIASVAGKEGNPNASHYSASKAGLIGLTKSLGKELATKNILVNAVTPAAAKTEIFDSMSQQHIDYMLSKIPMNRFLLPEEAASLILWLSSEDCAFSTGSVFDLSGGRATY

SEQ ID NO: 16440 - protein, 472 aa, Burkholderia fungorum
MSTAYQPRASAAARLERLPFSGYHRTIFIIIAIAFFFDSVDLGTMTFVLGSIRTEFGLSSATAGLVASASFFGMVIGAAIAGLLADRFGRRPVFQWSMVLWGLASYLCSTAQSVEALIFYRVLLGFGMGMEFPIAQTLLSEFVPAASRGRLIALMDGFWPLGFIAAGVVSYFVLPTFGWRTEFALLAIPAVFVLIVRRMVPESPRWLEHRGRFGEADKILAEVEVKVMKAAGLSQLRPPAMLAEPPAAQGTGAFREIWSIAYRRRTIMVWTLWFFALLGFYGLTSWLGALMQQAGFAVTKSVLYTVLISLGGIPGFICAAWLVERWGRKPTCIASLAGSAVMAYVYGQTALHAQTPTLLICAGLAMQFFLFAMWAVLYTYTPELYGTGARATGSGFASAIGRVGSLIGPYVVGVVLPVFGQGGVFSLGAMCFVIAAAAVWILGIETRGLALETLVSEAVETDARGVLSPMRD

SEQ ID NO: 16441 - protein, 336 aa, Burkholderia fungorum
MSALHFRGVTAVAVFDVDEIVAALQTVRQQWREVQKRSLEPGGRELPGREALAEIVDTLKGVLFPMRLGPPDLRQESENFYVGHALDAALHALLSQARLELHYRSRHQPPPAATIEAQAGIAVRAFAARLPAIRSLLDSDVLAAFHGDPAAGSVDEVLLCYPGVLAMIHHRLAHELYGLGLPLLARIVAELAHAQTGIDIHPGAKIGAGFFIDHGTGVVIGETAVIGERVRLYQAVTLGAKRFPRDAQGHLEKGHARHPIVEDDVVIYAGATILGRVTLGQGSVIGGNVWLTQDVAPGSHVTQAVSRSEGTGTAVSAERTPRGHTDTVPVAAGAAT

SEQ ID NO: 16442 - protein, 625 aa, Burkholderia fungorum
MTAGAGRERADVTPREFDLAQHFAPACNDHLADPRQLQRITDPVHHRHAERVFDLRDLFRNGRLRDMERSRDARDLTKLSKAYEDAQMRQLEAAAKKTLNRIIVLHGKGFPGNTDRHNCSVITFAEIVICGNARDTANLPTLPPEGSGPQHGQTPTTRQRADGAHWRQTMSVPSYGPESGPAAAGSAADPHNAALYAKLTRRIVPFLFLAFVVAYIDRVNVSFAKLQMLSDLSLSETVYGAGAGIFFVGYFFFEVPSNLILNRVGARRWIARIMVTWAIVSGLTMFVSGPTSFYIMRFLLGVAEAGFFPGILLYLSNWFPSTRRSQIIALFMTAIPVSGAIGGPLSGWLMAHFAGTYGLAGWRWLFLVEGIGSLAVGIAAFFVLHDRIDNVRWLNADEKSRLAADLARDAITRTETSARGAFASKRVWLLGLLYFCIAMGNYGLAFWVPTIIKASGVASVGNIGWLSAVPSLISAVAMVLIARHADRHDERRVHVAVCCAIGALGLLASVLFASNVAVSIAALIVAAIGINSIAPVFWGIPTALLGGAGAAAGIAVINCTGNLAGFVSPFIVGRLSDLSGGKLLPGMFAIAVALLIGAAIVLRMPLRRASASAASAPDSSIPQRT

SEQ ID NO: 16443 - protein, 1344 aa, Burkholderia fungorum
MNDANNISPTLGAATVPRIVAIGASAGALHALSLFFRAASTMPHDIAFAIVVHLAPGAESHLPELLAKDTSLAVSAIEDGATLCAGHVYVIPPKVSVVIEQGVFRLRPAVERPTIPMPIDEFFTSLAADQHDRAIGIVLTGANADGSAGLRAIKAAGGMVMAQSPATAEHDSMPAHAVATGLVDYVLPIEKMPAVLFDYIARSGEAMLPVSGKSGAMVDLEPVLRALAAAGSDFRGYKRGTLERRIARRMTVNQVDSLDAYCAVLRTSVEEAQALSLDMMIGVTEFFRDPEAWRALAERVLGPLLDEPGGDQPLRVWVPGCATGEEAYSMAMLLTEEIGKRKLTRSFMILASDVNRVALTRARQGIYSPGVALPVGEERLERFFRPHGNDYQIDQALRETILFTPQNLIADPPFSRVDLISCRNLLIYLEPEAQQRVFEVFHFALNPKRYLFLGRSESTDPDSGPFQEVSRAWRIYQRSPVTAAVVSGYRFSAPGGRRDEFPSASRGSNRSKGYAELVNSTLLEEHHAASVLINAAHQVLYTSGSTDEYLRQPTGEPTGNILDMAREGLRLKLRIVLRRASQDEAAGPVSEVVSDGGAPAVKITVTRPFDTAHTGKALLVIFARVPVAERPGSLAPTGVDSDLWHLESELRTTQVELGSTIEELEESNSELRVSNEEILSMNEELRSANEELETSKEELQALNEQLNLVNSQLGQKVHQLEVLSEDVANLLASTEIATLLLDRHAVIKRFTPSAARIFGLALADIDRPITNVLGNPLGDTLLEDVQRVMSAQTGQAEKEIQTLTGEWYVRRITPYIAVQGTPPAGVVVTWNDITHVKASDERSRRLAAVVQDSNDAMTVFDLNGRLIAWNRAATAIYGYTEAEALCMTVSDMLPSGARQDHLDFIRYAEHNEALHSYETQRVTKSGRVLDIWITLSILSDNQGHAVAVATTERELTDRSLSNTQLRERAERLAQADRRKNEFLAMLGHELRNPLAALCSAGDLLASESVDARQKVWAVGVIQRQGQAMTQLVNEMLDLTRIASGSIKLNRQAVTLETVVQSALEVCRPIVEERHHTLSVALPEEPVLMFVDPTRLSQVIENIVINAAKYTEPGGKIDLSATRTGRRLSLRVRDNGAGIAPSMLNTLFDMFVQGPLPHGQLHNGLGVGLSVVRRLVELHGGTVEAVSDGKTGSEFIVDLPLGLIPASPDQAGSPQNPGKAPPRRVLIIDDNADASEALAMILASEGHVVATRLDGQQGLEASTTFRPDVVLLDIGLPGMDGYEVAQKLRGSAATRDTLLVAVTGYGQPGDQLRSAAAGFDHHLVKPVDIEALKGLFAAKMKPRDA

SEQ ID NO: 16444 - protein, 577 aa, Burkholderia fungorum
MHTVETVLLVLMLGALTGVASRYIRTIPLPLIQILLGAALSWPRQGLHIVFDPDLFLLLFIPPLLFADGWRIPKREFFALYRPILKLAFGLVLFTVVGLGYLIHWLIPEMPLTVAFALAAVVSPTDAVAVSAITRNLGMPSQTMRVLEGESLLNDASGLVALKFAIAATLTGLFSWTHVARDFIWIAFGGIGAGALIGWGFSVARDAVTRRLGDVAATQMALLLVLLPFAAYIVGDRLGVSGILAAVAAGVMTNFADLDRSEFVAERMQTEGTWTMVESAFNGAIFLLLGLQLPSIIGTPLREAGHQWWILAGYALAISSALLLLRWIWLTLGVQGSLWRAHAEGKLVEKPSYLLTLASTLAGIRGAVTLAGALSLPLLLNDGAPFPARDLLIFLATGTILFTLVIGTIGLPLVLKRMPPGGEPASAREERRARVAACKAAIASMVLGKEQAESVDPQWLAQYQESAGRLTQEYRKRIDLLEDPAPPATPEALAEAPDVVRQRRHRYVVELELRLKSLHVERNALYAERHEQRINDESLRSLVAELDLAEASLRKRLDVARRAAGLTGAHDSVKQDT

SEQ ID NO: 16445 - protein, 197 aa, Burkholderia fungorum
RSGCRQLDRFLIEQDNPMVWRGPMATSALEQLLRQTNWHDLDYLIVDMPPGTGDIQLTLSQRVPVTGAVIVTTPQDIALLDAKKGLKMFEKVGIPILGIVENMGTHICSNCGHEEHIFGAGGGERMGKEYGVDVLGSLPLDIAIREQADSGKPTVVADPEGRIAEIYRSIARKVAIHIAERARDMTSKFPNIVVQNT

SEQ ID NO: 16446 - protein, 334 aa, Burkholderia fungorum
MEFLRNTWYAAGWSQDLAAGAMLGRTMLNEQLVLFRADDGTVSALSDICPHRFAPLHLGKIVDGCRIQCAYHALEFDGTGACVKNPHGKQKIPAAAKLQAYPVVEKHSLIWVWMGEQAAADPSVIPDFSMLDPDSGFQVSRRDWLHMDASYDLVVDNLMDLSHTAFLHDGILGSKYTIKADTSLEQTGETVKVTRLMPNVPVPGFFDLMFNRDGGIVDYWTEIRWNLPGCLMNNTGVTLPGAPRSEGTGVYGMHFLTPETDVSCWYHFAAVRQNPRTWGEPIDTEIKEKISDLRRYAFEEQDQWIIKAQQQTILRAKGNLQPVSLETDIGIERY

SEQ ID NO: 16447 - protein, 335 aa, Sus scrofa
TDQAAFDTNIVTLTRFVMEQGRKARGTGEMTQLLNSLCTAVKAISTAVRKAGIAHLYGIAGSTNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRNVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHA

SEQ ID NO: 16448 - protein, 369 aa, Enterococcus faecium
MANGTDKKTYEAAVAAFIKENKPKRQVVYDDLSNQLATPFTLNADEMDKLIQKIEDAGISVVDENGDPSIHSLKSAEKKAEQAKTEDLSAPTGVKINDPVRMYLKEIGRVSLLTAEEEVALALKIEEGDQEAKQRLAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDLPTEKVREILKIAQEPVSLETPIGEEDDSHLGDFIEDQEATSPAEHAAYELLKEQLEDVLDTLTDREENVLRLRFGLDDGRTRTLEEVGKVFGVTRERIRQIEAKALRKLRHPSRSKQLKDFLE

SEQ ID NO: 16449 - protein, 401 aa, Enterococcus faecium
GALAGRSFSASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALASILKARGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKNK

SEQ ID NO: 16450 - protein, 323 aa, Enterococcus faecium
MEFAELVIVFAVTITLSNIASRILPMIPAPLIQIFLGVVLGLTEWGQSIDFEPELFLVMIIAPLLFREGEKADISSILKNFGTILFLAFGGVILTLVGVGATLSFLLPSVPLAACFAFGAALGPTDAVAVSSLSGRVNIPKKAMHILEGEGLLNDASGVTAFQFALGALITGSFSAVNAGMSLVVSSIGGALIGFLLVWFKQKIIHLIEKASAQDVTGYLLIELLLPFLAYVLAEAFDVSGIIAAVAAGILQASGFRKISVFDAELSSLSHSTWTTIAFTLNALVFIFLGIELTQVFSPVWGDGLYPNGLLLAIIVLISVMLL

SEQ ID NO: 16451 - protein, 207 aa, Enterococcus faecium
MEEISLRFPETFAYALGDVRQMKELQQAVSKCQNHFGEVTILLNTAGILDAYKPLMETDESLWDLIYETNVKSMYQLTKIILPDMIRQKSGTIINMASIAGLIAGGGGIAYTSAKHAIVGFTKQLALDYAGQGIRVKGIAPGAIQTPMNAADFEGKGEMAEWVANETPVKRWAQPEEVAELTLFLASPQASYIQGTIIPIDGGWLLK

SEQ ID NO: 16452 - protein, 225 aa, Enterococcus faecium
MDSKTNSLLKYTSDPYIIIGAGGHAKVIIETLRLENKLIYGFFDDKQNKMQDLKYLGKINELNSWADSKKKIYKFIVAIGDCVVRKKIIKKLNMPSEQYGIAVHPSAIVAKEISIGYGTVIFANAVINPDAVIGEHAIINTGSIVEHDCRINNYVHLSPGVCLAGGVHVGVGTQIGIGSQCIQMKKIGSWCMIGAGSTIVKDIPSHSLAYGNPAKIKKEGINFEF

SEQ ID NO: 16453 - protein, 217 aa, Enterococcus faecium
MKYNAVIFDMDGLLFDTELVYYEATQVVADKMGFPYDKDLYLKFLGVSDEEVWANYHMIFSEFGKTSVQRFIDDSYQETLERFSQGAVQMKPGVLELLSFLEEHQIPKVVASSNQRAVIELLLKKNNLFERFETIVSAENVQRAKPDPEIFLLANQKLGTAKKETLILEDSQNGILAASAAEIPVVMVPDLLPPSQELIKKTAGVVSSLHEIPALLK

SEQ ID NO: 16454 - protein, 333 aa, Enterococcus faecium
MNIQEDNVMKVFDYEDIQLIPNKCIVNSRSECDTTVTLGKHTFKMPVVPANMQTIIDETIAEFLAENGYFYIMHRFDEAARIPFIKKMKKRGLITSISVGVKKEEYSFIEKLAEESLNPDYITIDIAHGHANSVIDMIQHIKKYLPETFVIAGNVGTPEAVRELENAGADATKVGIGPGKVCITKIKTGFGTGGWQLAALRWCAKAARKPIIADGGIRTHGDIAKSVRFGATMVMIGSLFAGHEESPGETKVENGIVYKEYFGSASEFQKGEKRNVEGKKIWIQHKGSLKDTLVEMQQDLQSSISYAGGRDLEAIRKVDYVIVKNSIFNGDTI

SEQ ID NO: 16455 - protein, 137 aa, Enterococcus faecium
MSNFLPHHLDTLAKTAKIMPMVNQVFLAPGELQTTVVEYAKKHDMILEAYSPLGTGKIFDVPEMKQIAEAHDKTIAQVALRWSLQHEFLPLPKSVTPSRIKENTELFDFELTEEEMKQIDQLDGVVGKAKDPDTTQF

SEQ ID NO: 16456 - protein, 498 aa, Enterococcus faecium
MVLKMSNWETKFTKKGFTFDDVLLIPAESHVLPNEVDMSVQLAKNIKLNIPIISASMDTVTDSKMAIAMARQGGLGVIHKNMTISQQADEVRKVKRSESGVIIDPFFLTPQHLVADAEELMSKYRISGVPIVETLENRKLVGIITNRDMRFVTDYHMPIADVMTKDNLVTAPVGTSLKDAEKILQKHKIEKLPIVDNEGRLSGLITIKDIEKVIEFPNAAKDEHGRLLVAAAVGVTSDTFERANALLEAGADAIIIDTAHGHSAGVIRKIQEIRSTFADATLIAGNVATAEATKALYDAGVDVVKVGIGPGSICTTRVVAGVGVPQLTAIYDAASVARQYGKAIIADGGIKYSGDIVKALAAGGHAVMLGSMLAGTDESPGEFEIFQGRRFKTYRGMGSLGAMEKGSKDRYFQGSVNEANKLVPEGIEGRVAYKGSVADIIFQMIGGLRSGMGYVGAANLQQLRDEAQFIQMSGSGLKESHPHDVQITKEAPNYSVES

SEQ ID NO: 16457 - protein, 268 aa, Enterococcus faecium
MMEFSMDMFRLDGKVALVTGAVYGIGFEIARSLATAGAKIVFNNLNQESVDEGIAHYKEAGIDAKGYVCDVTDEEAVQAMVQQIKEDVGSVDILVNNAGIIKRTPMIEMDAADFRQVIDVDLNAPFIVSKAVIPDMIEKGGGKIINICSMMSELGRETVSAYAAAKGGLKMLTKNIASEYGQYNIQCNGIGPGYIATPQTAPLRETQENGERHPFDQFIVGRTPAARWGEPIDLAGPSVFLASSASDFVNGHVLYVDGGILAYIGKQP

SEQ ID NO: 16458 - protein, 370 aa, Enterococcus faecium
MLYASKAFQTIEMLHLVREYGFGLDVVSGGEIYTALQADFPRDTIYFHGNNKTPEELIYALENDLLHIVADNLMEVELLAELSQRYLKKICIMLRLNVGVEAHTHEYIVTAHIDSKFGMSYESKECQQALQLIKESSYLELEGFHAHIGSQIFDVTAWLAEIDKLTNYLTDFDQPLSLNLGGGFGIRYTQNDQPIPVEEALKKLIEYTEEALEKRKLTIRQLLIEPGRSIVGEAGTTLYTIGFIKKTPHKKYYFVDGGMTDNIRPALYQAEYDCDLAAKLSEEKTEKVTIAGKMCESGDVVIKEAYLPKAESGDLLAVYSTGAYGYSMSSNYNRATRPAVVFVNNGQSRLIVRRQAFSDLLRGEVSYDPS

SEQ ID NO: 16459 - protein, 231 aa, Enterococcus faecium
MEAQEIIRYIQTASKKTPVKVYLNVTEPIEFKESKVFGEGSSFVVFGDYETIAPVLEAESEKIIEIEIETAARYSAVPLLDIKKINARIEPGAIIRDQVSIGNNAVIMMGAIINIGAVIGENTMIDMGAVLGGRATVGKNCHIGAGAVLAGVIEPASAKPVIVEDGVLVGANAVIVEGVHIGKDAVVAAGAVVLEDVAAETVVGGIPARVLKISDDQTKENTALIAALREL

SEQ ID NO: 16460 - protein, 214 aa, Enterococcus faecium
MRISLSEQGDEMFRTQMRALLRASVHGNLRIMFPMVATLKEFRAAKAIFEEEKQKLISEGKEVSDTIQVGIMIEIPAAAVLADKFAKEVDFFSVGTNDLIQYTMAADRMNERVSYLYQPYNPSILRLIKNVIDAAHAEGKWAGMCGEMAGDQTAVPLLVGMGLDEFSMSATSILKTRSLMKRLDTAKMAELADRALKECDMMEEVVELVHEYVK

SEQ ID NO: 16461 - protein, 245 aa, Enterococcus faecium
MDVKGKNVFITGSTRGIGKAMALAFAKAGANIILNGRGEIPKEKIEEIEAFGVKCVGVSGDISDYEKAGQMIKEAEEKLGSIHVLVNNAGITNDKLVMRMDAEDFKKCLDINLIGTFNMTQHVLKKMMKQREGAIINLSSVSGLIGNIGQANYAASKAGVVGLTKSVAREAATRGITCNAIAPGFITTDMTEVLADKVKEQAEKQIPMQRFGQVEDIAQTAVFLAQNPYITGQVINVDGGLVMHG

SEQ ID NO: 16462 - protein, 225 aa, Enterococcus faecium
MRTLIIISHPTIEESLNQQFFKEASAGLPATWHHLESSYPDGKIDIETELQLLAQHDRIIFQFPFYWYSSPAHLKIWQDNVLERAAHVLKGKELGIVLTTGVAEKEYQAGGKEEYTISEFLRPYQRIANKFHMTYLPPFVLAQFMYLSQEKRWEKLIAYQQYLSLEGKPSLTQRIDWFIQRVQENQKMQEEESEKQAYIVEALTEAKEQIEDLTFTLQEMKGTSL

SEQ ID NO: 16463 - protein, 587 aa, Enterococcus faecium
MSTVLHVLDAINSPADVKKLSVEEMKQLAEEMRQKILQKDSDVGGHVGPNLGVVELTIAFHYVFDSPKDKIVWDVSHQSYGHKLLTGRKNGFEKGHYREVSGYSNQHESKHDYFTVGHTSTSISLATGLAKARDLKKESGNVVAFIGDGSLSGGLAFEGLNNGGVLQSNLIVLVNDNEMSIDENHGSLYKNLAELRQTNGKSSNNLFKAMGFDYRYVDNGNDLETVIRLFEEVKDIDHPIVLHVHTEKGRGYQPAIDNKMKYHWHVPFDLSTGEAKQVTSGETFNMIIMDYLDKKMQTSTAPIAAVNAAIPGAFGLKTFQEKHPDHYFDVGIAEQHSITFASALASQGVRPVVFQSSTFLQRAYDQLSHDLAINENPVIILVGGGTISASDRTHQGTFDIPYLSSIPNIKYLAPATKEDMISMLDWAFEQTAQPVAIRIPTHGVEHGTAIANDYSIPAYQTVNNGGKVAILALGGFLELGKETVKAFRKKGIEATLINPGTITENDVETLDKLKETHELVITLEDGSLSGGFGENISRYYGDSSMNVLNFGAEKEFTDSVPVGQLYERYHLTPKQIVEDSLRVLNIQ

SEQ ID NO: 16464 - protein, 466 aa, Enterococcus faecium
MLYGKDNQEEKNYLEPIFGSASEDVDLPKYKLNKESIEPRIAYQLVQDEMLDEGNARLNLATFCQTYMEPEAVKLMTQTLEKNAIDKSEYPRTTEIENRCVNMIADLWHAPNNEKFMGTSTIGSSEACMLGGMAMKFAWRKRAEKLGLDIQAKKPNLVISSGYQVCWEKFCVYWDVELREVPMDEKHMSINLDTVMDYVDEYTIGIVGIMGITYTGRYDDIKGLNDLVEAHNKQTDYKVYIHVDAASGGFYAPFTEPDLVWDFQLKNVISINSSGHKYGLVYPGVGWVLWRDQQYLPEELVFKVSYLGGEMPTMAINFSHSAAQLIGQYYNFVRYGFDGYRDIHQRTHDVAVYLAKEIEKTGIFEIINDGSELPVVCYKLKEDPNREWTLYDLSDRLLMKGWQVPAYPLPKDLDQLIIQRLVVRADFGMNMAGDYVQDMNQAIEELNKAHIVYHKKQDVKTYGFTH

SEQ ID NO: 16465 - protein, 138 aa, Enterococcus faecium
MKKILLGVTGSISAYKSADLTSQFVKLGAQVDVIMSKSSTHFITPLTLQSLSKRAVHTDVMQESNPQVINHIELAKQADLFLIAPATANIIGKLANGIADDLLSTVAMALPVGTPKLIAPAMNTNMYQTRSLSVIWKH

SEQ ID NO: 16466 - protein, 157 aa, Enterococcus faecium
MRLALAEAKKAEMLHEVPIGAVVVLDGKVIGRGYNLRETTQDATTHAEMLAIKEACEKVGSWRLEDAALFVTLEPCPMCSGAMILSRVAEVYFGAYDPKGGTAGTLMNLLEDERFNHQAYVEGGILEDECGMILTDFFRKLRQRKKKLKKDWSTNEK

SEQ ID NO: 16467 - protein, 219 aa, Enterococcus faecium
MKKSGTTRKASFDKETYLKGASFLYKKMISYIKFLRKEWKVMSWFTRAIDAAKRNDPAARSTAEIVLTYPGFHALFWHRFSHFLYQHRLFLLAKINAQFWRFLTGVEIHPGATIGTGVFIDHGMGIVIGETAEIEDDVILFHGVTLGGTGKETGKRHPTVKQGAMLSANAQILGPVTIGKNAKIGAGAVVLKDVPDDATAVGVPAKVVRIKGEKVRRSE

SEQ ID NO: 16468 - protein, 799 aa, Xylella fastidiosa Dixon
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRRLGSKLVRMVYSDAPGERVKIEDTPTELRHCFAISDADVQELARQALIIEQHYGRPMDIEWAKDGVSGKLFIVQARPETVKSRSHTTQIERFALQQRGEILTEGRAIGQKIGSGIARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 16469 - protein, 394 aa, Xylella fastidiosa Dixon
MTKPIRNVAVLGATGSIGAAALDVLARHPRQFHVSLLAAGQRVDALLALCHTYRPDHAVIGDATLYTTLRDGLNAAGLATKAYAGEAALAELVASTTCDTVVAAIVGAAGLHSTLAAARAGKRLLLANKESLVLAGMLLMREASISGAEIIPIDSEHNAIFQCLRSRTTDGVHRVTLTASGGPFRGHNRTMLAKITPTQAMAHPTWSMGPKISVDSATLMNKGLEVIEAHHLFGLPSEQIDVLVHPQSLVHSLVEFIDGSTLAQLSLPDMRTTLAVGLAWPERIGSGVPGLDLMKHNRLDFEHPDTETFSCLRLARDAMQTGGTAPAVLNAANEIAVSAFLQGRIGFLTIPALIEHALTTLPRYEADTLETLLTVDTETRRITHAALTHFPLPL

SEQ ID NO: 16470 - protein, 480 aa, Xylella fastidiosa Dixon
MNTHPQTSPNTHYKIADISLADWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLADGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVRTVEDTLGQADIYVTTTGNKDVIRIEHMTAMKDQVIVCNIGHFDNEIQVDALNTLTGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 16471 - protein, 453 aa, Xylella fastidiosa Dixon
MAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAASVLLGWRFRVVSERMFAGIP

SEQ ID NO: 16472 - protein, 288 aa, Xylella fastidiosa Dixon
MTRNTSVVLVGNNLPVPNALGSLEAYISAVHQISVLSVDEEQLLARRYRDQQDLDAARELVHSHLRFVVRVARGYSGYGLSLGDLIQEGNIGLMKAVKRFDPDMGVRLVSFAMHWIRAEMHEFILKNWRIVKVATTKAQRKLFFNLRKSRTRLGWMNAEEVSAVARDLNVSEREVLEMESRLSGRDIGFDAPEEDNAPPSPVGYLIANDGDPSQAYERGNSEETQLRLLQEGLSVLDTRSRDIIQRRWLETDKKITLQELAEEYGVSAERIRQIEANALKKMKVLFAA

SEQ ID NO: 16473 - protein, 303 aa, Xylella fastidiosa Dixon
MSQDGGVTTDERACAAPLQLSNTFPRVSRHAVQTGLSPHPRVRNVIAVGSGKGGVGKSTIAVNLAVALQRTGARVGLLDADIYGPSVPAMLGLSGRPESPDNKLIEPLRAFGIEAMSIGLLIDVDTPMIWRGPMATSALTQLFNDTLWGDLDYLLIDLPPGTGDIQLTLSQKIPVAGAVIVTTPQDIATLDARKALKMFEKVNVPVLGIVENMAMHCCRQCGHVEHLFGEGGAQRMAEHYHVPLLGSLPLDIAIREHGDLGQPITVAAPEGSVGQAYAAVAACLAAELAKRPRAAIPMTTTLG

SEQ ID NO: 16474 - protein, 114 aa, Xylella fastidiosa Dixon
MRMKLITAIIRPFKLDEVREALSQVGVSGITVTEVKGFGQQKGHTELYRGTEYVIDFLPKIKIEMVVTDERLDAVIEVIRIAAVTGKIGDGKIFVTKIEQVVRIRTGEIDIDAL

SEQ ID NO: 16475 - protein, 445 aa, Xylella fastidiosa Dixon
MVLWYCSLLWLLTGPMTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 16476 - protein, 485 aa, Xylella fastidiosa Dixon
MLRILAEALTYDDVSLVPSHSTVLPKDVNLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 16477 - protein, 246 aa, Xylella fastidiosa Dixon
MITDDSPRFRALVTGGSGHLGTAICRQLIADGAHVIVHANHHRSRADTLVECLCAEGGSAEVIVFDVTAAQASKTALENLLQAGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLVPTGRPGRPEEVAALIGFLCSEKAGYINGQVIGINGGMV

SEQ ID NO: 16478 - protein, 1209 aa, Xylella fastidiosa Dixon
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRAPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDGGESSYCNVAPAAYSGGLWQLNRIGELMHLNTSTGELVHTGWQRHELRGVNITTTLEDSRGRLWLANMQNGLSRLDLKNGQWREWAAHGDDAVPLYGPISWIVEMPDSSLWLEALGVLQQRDLESGRVLNQIVPGSHGLDGSRVEQIGLGPDGRLWLAAGSGVYAWESQRRMFVPIPDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDFPVDRPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVSWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVVDTGPGLSEEQCQRLFRRFEQVNGASTAARYGGSGLGLAICRELATVMEGEIHVDSELGKGTCFRVLLPLPWVLAVQPAVAVMDMEPSPCSNPLHLLLIEDDPTVAEVIVELLRVRGHRVTHALHGLEALVEVTLTRFDACLCDLDLPGLDGAGLIVQLRAQGQSFPIVVVTARTDADAQRQAFQVGCDAFLRKPVTGEMLEQVLTQVLSAPRQEVDVHTPKKRNGMGRPRISDSIKRDLG

SEQ ID NO: 16479 - protein, 623 aa, Xylella fastidiosa Dixon
MRSPIMSNERTAQQSDIKQLISKGLEQGYLTYAEVNDHLPEDLVDPDQIEDIIGMINGMGIEVHEVAPDAETLLLNEGNTGNREVDDTAAEEAAAALSALDTEAGRTTDPVRMYMREMGTVELLTREGEIAIAKRIEEGLSEVQAALGAFPLSTELLLSEYELHKEGKRRLTEVVVGFNDLIEDDNSVTSSVDVTDESIVEVDEEDDDSVGNDEDAPMIGPDPAEVASRIESLSTEYAKFKKLYAKHGPEHKAVIKVREDMAAIFVTFKLSLPLTDLLVQQLQNMVNSVKDHERKVLHLATNVAKMPRKDFIRSWENNQTNLEWVEDAIKRKQKWSSALRDIKDQITAEQQSSIDLEKVNSLTLADIKEINRMMVYGEAKASKAKKEMVEANLRLVISIAKKYTNRGLQFLDLIQEGNIGLMKAVCKFEHRRGFKFSTYATWWIRQAITRSIADQARTIRIPVHMIETINKLNRISRQMLQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 16480 - protein, 590 aa, Xylella fastidiosa Dixon
MPHSAHRSTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDHLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLLLQKITNGDMLIIDGNSGEIIVNPSPQDLRHYHSRLRERAKEQRELEQLRSKHSRTRDNVDIVVQANAESPDDVSQAYTLGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSATTLLRARDRKSIEEWMAAHANTTPT

SEQ ID NO: 16481 - protein, 397 aa, Xylella fastidiosa Dixon
MSASFSPHTITLIKSTVPLLAEHGTTIIEAMYHRLFEDPQIEALFNQANQKNGTQIHALAGAILAYARNIDNPGVLASAIERISQKHVGYAIHPEHYPHVATALLGAIKQVLGDVATSEVLEAWGEAYWFIANLLKDREAVIREGIMTKNGGWIHWRRFVISKRIPESETITSFMLHPEDGGPVVPHQAGQYLTFRFDAAGMPGMKRNYSISCGPNSDYYRITVKREHGTGASAFLHDQAKVGTIIECTPPVGDFFLPSVIERPIVLLSGGVGLTPMVSMMEQIAEAHPDAQVWYVHGTQNRETHAMDAHIRALVSRHKHMKATTFYTQRSEADDAEAGFITIDWLRANTPFQKADFYLCGPRPFLRTFVRDLIGAGVPAAQVHYEFFGPMDEEMAA

SEQ ID NO: 16482 - protein, 165 aa, Xylella fastidiosa Dixon
MTAPPPVLPEHTHWMRHALTLAHRAATEFDEIPVGAVLISPEGTLLGEGCNYNITSHDPSAHAEIMALRAAGHQLRNHRMPGCTLYVTLEPCLMCAMAIIHARIAHLIYAAADPKTGACGSTFDILNDPRHNHHVHVYGGLLAEEASRRLTNYFRTKRGQPPLPQ

SEQ ID NO: 16483 - protein, 258 aa, Xylella fastidiosa Dixon
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVCYYEQVIERTPMRRIGEPEEVAAAVAFLCLPASSYVTGECIAVDGGFMRYGF

SEQ ID NO: 16484 - protein, 247 aa, Xylella fastidiosa Dixon
MNKPLQGEVALVTGASRGIGAAVADLLADHGATVIGTATSASGAQLIGDRLALLGGHGRALDVTDTAAVGALVEEIAEQFGSVSILVNNAGITRDNLLMRMKDEDWESIVDTNLSSIFRTSRAVVRNMMKARKGRIINIASVVGVTGNAGQANYAAAKAGVIGFTKSLAKEVGPRGITVNVVAPGFIDTDMTRVLSEGVRNDILNHVPLGHLGDPVDIANAVAFLAAPAARYITGETLHVNGGMYMP

SEQ ID NO: 16485 - protein, 409 aa, Xylella fastidiosa Dixon
MTGSHQPRSLNGQRLLLCVSGGIAAYKSLELVRCLCGAGAQVQVAMTASAQQFVTPLSFQALSGQSTRTTLWDGNAEQAMGHIELARWAERVLIAPASADVIARLAHGLADDLVTTLCLATTAPLIICPAMNHNMWLHPATQANVAMLLGRGVQVIGPENGPLAEGVSGLGRMSEPEAIVVALVQGVSPAPVHGGLFHGQRIVISAGPTFEDLDPVRYLGNRSSGKMGFALASAAVSHGAEVVLVAGPVYQPTPPGVTRVDVRSAAQMRDAVLSAFPADVYIGAAAVADYAPKSVLPQKIKKSGQTLILELVRTQDILSEVAAQTANLKFVVGFAAETHDVACYARGKLAAKHLDLIIANQVGIVGNGFESDDNAVTAYWQGGERVFASCSKVELAERLLALIAERMQT

SEQ ID NO: 16486 - protein, 610 aa, Xylella fastidiosa Dixon
MGVSMNTVTFPSQGGIDRRRFLKGLALGGVVAGTGLWRLPVHAANPELPLLQRHTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIRRDGLRTTLADRRMWGRMRMTPTDLSDVNAHTYTYLLNGTTPAGDWTGLFRPGEKVLLRLINGSAMTYFDVRIPGLKLTVVAVDGQYVHQVTVDELRIALAETYDVLIQPHGQDAFAIFAQDMGRTGYACGTLAVRPGLHAPLPALDPRPRLTMQDMGHRMTHGQHESRASEMADMPGMTHPGRLGDHASHANQPPAQTPHGSHSLPADRTAPRHPASEQNNPLVDMHVDAPQPRLNDPGIGLRDNGRHVLTYADLHSLFDDPDGREPGREIELHLTGHMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 16487 - protein, 659 aa, Xylella fastidiosa Dixon
MLHWIACSGPLWGGQWWFRWNAKTMIDSTCYPRLSRIQTPEDLRAFQESELRAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 16488 - protein, 510 aa, Xylella fastidiosa Dixon
MLCTLEAGFCIVQIVLDDGQPVDGIFRLTNASFGRHLRLDSVVGESVCGIMPDDGPEYIKRYGGVALSGQRVHFEARALRRWYSVEVMRVGAPEGRLLGVLFVDITEHKRMERRLAESEVRFNILADGLPMPVWVFDAQGGMRFVNTAYGEFFGVDLSSGTVPEWSMVLHPEDVLIFEFKLSAALKTQSALRALVRARRYDGQWRWIEMSATPRYSPDGHFIGLTGNSPDVTERLEIELAREQLLKSERAARNEAENMARLKDEFLSTLSHELRTPLTTILGWSELLLQRIEEQHPCYKGLSVIASSAKVQKRLISDMLDLSSMLLGKMQLEMEVLDLVEQIREVIGLYEQVVESKGQRLLLRAPEMPCLVLGDATRLRQIFENLLSNAIKFTPTDGCIDVEIDADGDSFRVSVTDSGDGIAAEFLPHLFSRFRQADGTTTRCHGGLGLGLAIVQSLVEMHGGYVGATSPGLGKGAMFTVSLLRYVCAIDVADTVICDRRVGSAGDQGEY

SEQ ID NO: 16489 - protein, 754 aa, Xylella fastidiosa Dixon
MGVYLIHIVSTLSSGGAINYNASALSSPLLWPGLECGMLKKAKWICSRLSQRPDSEHVQNLIRFLIASLFIIYLSVCWHGETDLNISRIIWLVLLSDLGVSLALMLAIVMHPQISHVRRCIGIIADYTSLTVLMLLMGEAGSPLYVLCLWVTIGNGLRYGSAYLLVTTTLGALSFLTVILVSAYWKSNPFLAWGLLIGLIAIPLYFQSLLKVLIRALRDARQANEAKSRFLANMSHEFRTPLNGLSGMTEVLATTRLDAEQRECLKAIQASVHSVLSLIEEVLDISRIEAGKIRILHDTFSLQEVIGSVGLILQPQIRNKALEYRVDVGLDVPEWLFGDAGYVRQVLLNIVGNAVKFTERGGITLCVSVLNRSRQHSVVLRFEVADTGIGVPLGMRNRLFDVFEQADVGLDRRYQGSGLGTTIAKGLIELMGGSIGFEENVPCGSLFWFELPFELAKEQVVAQEVSEASQCTEPSNVIAFSNPFLRHRARVKSMRVLVADDHETNRMVLSRILDKAGHKLLCVDGAEAVLDCLISMEFDVVIIDLHMPGMSGLDMLKQLRVMQSSSLPYTPVLVLSADATSDSIRCCEEAGARAFLSKPVLATKLLDVLAEIAEGDGGALPYAALSQSSVQQHQVFDPAGLDDLAELNMDDDFEERFIVQSFRDAEHCQQTMLSAAETNQWHEVREEAHALRGVLGHLGLMRASSLAAELMRIPDWQLQLEWCDRVQMLDEALLCGRDALEARRQERRRSGVLR

SEQ ID NO: 16490 - protein, 874 aa, Xylella fastidiosa Dixon
MKTVTLMSASPTVERWIVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVLDA

SEQ ID NO: 16491 - protein, 566 aa, Xylella fastidiosa Dixon
MLAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGNFSLATASLTFVWVLVVGLSLGIATTYVLSRVQRWVWRHFGGEPAAAILVNLLTPFAAYLLAESMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPFLMPDGTPLPARQLVIFLAASVILVSLLLASVALPYLLRGLELPEKSSYDKEEDFARKVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 16492 - protein, 155 aa, Xylella fastidiosa Dixon
MSRRIVARKSRIHGNGVFAVVSIHQGERIIEYKGRIRTHAAVDANSHGHIESGHTFLFTLNDDYVIDANDAGNIARWINHSCSPNCEAVVEEDTGGNRRKDKIFIQAIRDIASGEELTYNYGIVLAERHTARLKKIWACLCGSDHCTHTMLQPKR

SEQ ID NO: 16493 - protein, 514 aa, Xylella fastidiosa Ann-1
MYREMLCNLEAGFCIVEIVLDDGQPVDGIFRLTNASFGRHLRLDSVVGESVCGIIPDDGPEYIKRYGGVALSGQRVHFEARALRRWYSVEVMRVGAPEGRLLGVLFVDITEHKRMERRLAESEVRFNILADGLPMPVWVFDAQGGMRFVNTAYGEFFGVDLSIGTLPEWSMVLHPEDVLIFELKLSAALKTQSALRALVRARRYDGQWRWIEMSATPRYSPDGHFIGLTGSSPDVTERLEIELAREQLLKSERAARNEAENMARLKDEFLSTLSHELRTPLTTILGWSELLLQRIEEQHPCYKGLSVIASSAKVQKRLISDMLDLSSMLLGKMQLEMEVLDLVEQIREVIGLYEQVVESKGQRLLLRAPEMPCLVLGDATRLRQIFENLLSNAIKFTPTDGCIDVEIDADGDSFRVSVTDSGDGIAAEFLPHLFSRFRQADGTTTRCHGGLGLGLAIVQSLVEMHGGYVGATSPGLGKGAMFTVSLLRYVCAINVADTVICDRRFGSVGDQGEY

SEQ ID NO: 16494 - protein, 288 aa, Xylella fastidiosa Ann-1
MTRNTSMVLVGNNFPVPNALGSLEAYISAVHQISVLSVDEEQLLARRYRDQQDLDAARELVHSHLRFVVRVARGYSGYGLSLGDLIQEGNIGLMKAVKRFDPDMGVRLVSFAMHWIRAEMHEFILKNWRIVKVATTKAQRKLFFNLRKSRTRLGWMNAEEVSAVARDLNVSEREVLEMESRLSGRDIGFDAPEEDNAPPSPVGYLIANDGDPSQAYERGNSEETQLRLLQEGLSVLDTRSRDIIQRRWLETDKKITLQELAEEYGVSAERIRQIEANALKKMKALFAA

SEQ ID NO: 16495 - protein, 469 aa, Xylella fastidiosa Ann-1
MFLPRPDFRIALSICFMAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWAPIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAAVLLGWRFRVVSERMFAGIP

SEQ ID NO: 16496 - protein, 300 aa, Xylella fastidiosa Ann-1
MAASPPMSALVLRPCNLSNTFPRVSRHAVQTGLSPHPRVRNVIAVGSGKGGVGKSTIAVNLAVALQRTGARVGLLDADIYGPSVPAMLGLSGRPESPDNKLIEPLRAFGIEAMSIGLLIDVDTPMIWRGPMATSALTQLFNDTLWGDLDYLLIDLPPGTGDIQLTLSQKIPVAGAVIVTTPQDIATLDARKALKMFEKVNVPVLGIVENMAMHCCRQCGHVEHLFGEGGAQRMAEHYHVPLLGSLPLDIVIREHGDLGQPITVAAPKGSVGQAYAAVAACLAAELAKRPRAAIPMTTTLG

SEQ ID NO: 16497 - protein, 445 aa, Xylella fastidiosa Ann-1
MVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 16498 - protein, 409 aa, Xylella fastidiosa Ann-1
MTGSHQPRSLNGQRLLLCVSGGIAAYKSLELVRLLCGAGAQVQVVMTASAQQFVTPLSFQALSGQSTRTTLWDGNAEQAMGHIELARWAERVLIAPASADVIARLAHGLADDLVTTLCLATTAPLIICPAMNHNMWLHPATQANVAMLLGRGVQVIGPEDGPLAEGVSGLGRMSEPEAIVVALVQGVSPAPVHGGLFHGQRIVISAGPTFEDLDPVRYLGNRSSGKMGFALASAAVSHGAEVVLVAGPVYQPTPPGVTRVDVRSAAQMRDAVLSAFPADVYIGAAAVADYAPKSVLPQKIKKSGQTLILELVRTQDILSEVAAQTANLKFVVGFAAETHDVACYARGKLAAKHLDLIIANQVGIIGNGFESDDNAVTAYWQGGERVFASCSKVELAERLLALIAERMQT

SEQ ID NO: 16499 - protein, 1190 aa, Xylella fastidiosa Ann-1
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRVPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDSGESAYCNVAPAAYSGGLWQLNRIGELMHLNTSTGELVHTGWQRHELRGVNITTTLEDSRGRLWLANMQNGLSRLDLKNGQWREWAAHGDDAVPLYGPISWIVEMPDSSLWLEALGVLQQRDLESGHVLNQIVPGSHGVDGSRVEQIGLGPDGRLWLAAGSGVYAWESQRRMFVPIPDLTGTRAYSFVPVGGNEVWVHRLRGLEQWRHSSHGWKRIALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVADTGPGLSEEQCQRLFRRFEQVNGASTVARYGGSGLGLAICRELATVMEGEIHVDSELGKGTCFRVLLPLPWVLAVQPEVAVMDMEPSPCSNPLHLLLIEDDPTVAEVIVELLRVRGHRVTHALHGLEALVEVTLTRFDVCLCDLDLPGLDGAGLIVQLRAQGQSFPIVVVTARTDADAQRQAFHVGCDAFLRKPVTGEMLEQVLTQVLSAPRQDADVDTPT

SEQ ID NO: 16500 - protein, 114 aa, Xylella fastidiosa Ann-1
MRMKLITAIIRPFKLDEVREALSKVGVSGITVTEVKGFGQQKGHTELYRGTEYVIDFLPKIKIEMVVTDERLDAVIEVIRIAAVTGKIGDGKIFVTKIEQVVRIRTGEIDIDAL

SEQ ID NO: 16501 - protein, 397 aa, Xylella fastidiosa Ann-1
MSASFSPHTITLIKSTVPLLAEHGTTIIEAMYHQLFEDPQIEALFNQANQKNGTQIHALAGAILAYARNIDNPGVLASAIERISQKHVGYAIHPEHYPHVATALLGAIKQVLGDVATSEVLQAWGEAYWFIANLLKDREAVIREGIMTKNGGWIHWRRFVISKRIPESETITSFMLHPDDGGPVVPHQAGQYLTFRFDAAGMPGMKRNYSISCGPNSDHYRITVKREHGTGASAFLHDQAKVGTIIECTPPVGDFFLPSVIERPIVLLSGGVGLTPMVSMMEQIAEAYPDAQVWYVHGTQNRETHAMDAHIRALVSRHKHMKATTFYTQRSEADDAEAGFITIDWLRANTPFQKADFYLCGPRPFLRTFVRDLIGAGVPAAQVHYEFFGPMDEEMAA

SEQ ID NO: 16502 - protein, 799 aa, Xylella fastidiosa Ann-1
MALNGASYLNENILWLHELRLTDLARVGGKNSSLGEMIGNLTALGVSVPGGYATTAAAFKAFIAYNNLSKRIYDKLATLDVEDVKALTAAGKQIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGSKLVRMVYSDAPGERVKIEDTPTELRHCFAISDADVQELARQALIIEQHYDRPMDIEWAKDGISGKLFIVQARPETVKSRSHTTQIERFALQQRGEILTEGRAIGQKIGSGTARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 16503 - protein, 485 aa, Xylella fastidiosa Ann-1
MLRILAEALTYDDVSLVPSHSTVLPKDVKLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFERELDDPVRHIMTKKEALVTVKEGADSQEVLQLLHKHRIEKILVVNDAFELRGLITVKDIQKKSDYPNAAKDAVTRLLVGAAVGVGGETEKRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEQMRTKPQFVKITGAGQVESHVHDVQITKEPPNYRMR

SEQ ID NO: 16504 - protein, 480 aa, Xylella fastidiosa Ann-1
MNTHRQTSPNTHYKIADISLADWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLADGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNTLTGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 16505 - protein, 394 aa, Xylella fastidiosa Ann-1
MTKPIRNVAVLGATGSIGAAALDVLARHPRQFHVSLLAAGQRVDALLALCRTYRPDHAVIGDATLYTTLRDGLNAAGLATKAYAGEAALAELVASTTCDTVVAAIVGAAGLHSTLAAARAGKRLLLANKESLVLAGMLLMREASISGAEIIPIDSEHNAIFQCLRSRTTDGVHRVTLTASGGPFRGHNRTMLAKITPTQAMAHPTWSMGPKISVDSATLMNKGLEVIEAHHLFGLPSEQINVLVHPQSLVHSLVEFIDGSTLAQLSLPDMRTTLAVGLAWPERIGSGVQGLDLMKHNRLDFEHPDTETFSCLRLARDAMQTGGTAPAVLNAANEIAVSAFLQGRIGFLTIPALIEHALTTLPRYEADTLETLLTVDTETRRITHAALTHFPLPL

SEQ ID NO: 16506 - protein, 258 aa, Xylella fastidiosa Ann-1
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 16507 - protein, 623 aa, Xylella fastidiosa Ann-1
MRSPIMSNERTAQQSDIKQLISKGLEQGYLTYAEVNDHLPEDLVDPDQIEDIIGMINGMGIEVHEVAPDAETLLLNEGNTGNREVDDTAAEEAAAALSALDTEAGRTTDPVRMYMREMGTVELLTREGEIAIAKRIEEGLSEVQAALGAFPLSTELLLSEYELHKEGKRRLTEVVVGFNDLIEEDNSVTSAVDVTDESIVEVDEEDDDSVGNDEDAPMIGPDPAEVASRIESLSTEYAKFKKLYAKHGPEHKAVIKVREDVAAIFVTFKLSLPLTDLLVQQLQNTVNSVKDHERKVLHLATNVAKMPRKDFIRSWENNQTNLEWVEDAIKRKQKWSSALRDIKDQITAEQQASIDLEKANSLTLADIKEINRMMVYGEAKASKAKKEMVEANLRLVISIAKKYTNRGLQFLDLIQEGNIGLMKAVCKFEHRRGFKFSTYATWWIRQAITRSIADQARTIRIPVHMIETINKLNRISRQMLQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 16508 - protein, 659 aa, Xylella fastidiosa Ann-1
MLHRIACSGRLWGGQWWFRWNAKTMIDSTCYPRLSRIQTPEDLRAFQESELPAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 16509 - protein, 874 aa, Xylella fastidiosa Ann-1
MKTVTLMSASPTAERWIVLKFGGTSVSRRHRWDTIAMVVRKRLEEHGTRVLIVVSALSGVTNELTAIAQGVVDSAKRVTALEQRHRDFLVELGLDVQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHAFEVVPHLVPSRVLFTPSFASRVEYEQAFLLGVNVTLDNVEALRLWPEVFRERTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRHLPAATASGDLMLIADAGAYGFSMASTYNLRGLPAEVVLDA

SEQ ID NO: 16510 - protein, 746 aa, Xylella fastidiosa Ann-1
MSTLSSGGAINYNASELSSPLLWPGRECGMLKKAKWICSRLSQRPDSEHVQNLIRFLIASLFIIYLSVCWHGETDLNTSRVIWLVLLSDLGVSLALMLAIVMHPQISHVRRCIGIIADYTSLTVLMLLMGEAGSPLYVLYLWVTIGNGLRYGCAYLLVTTTLGALSFLTVILVSAYWKSNPFLAWGLLIGLIAIPWYFQSLLKALIQALNDARHANEAKSRFLANMSHEFRTPLNGLSGITEVLATTRLDAEQRECLKVIQASVHSVLSLIEEVLDISRIEAGKIRILHDTFSLQEVIGSVGLILQPQIRNKALEYRVDVGGDVPEWLFGDAGYVRQVLLNIVGNAVKFTERGRITLCVSVLNRSRQHSVVLRFEVADTGIGVPLGMRTRLFDVFEQADVGLDRRYQGSGLGTTIAKGLIELMGGSIGFEENVPCGSLFWFELPFELAKEQVVAQEVSEVSQCTEPSNVIAFSNPFLRHRARVKSMRVLVADDHETNRMVLSRILDKAGHKLLCVDGAEAVLDCLISMEFDVVIIDLHMPGMSGLDMLKQLRVMQSSSMPYTPVLVLSADATSDSIRCCEEAGARAFLSKPVLATKLLDVLAEIAEGDGGALPYAALSQSSVQQHQVFDPAGLDDLAELNMDDDFEERFIVQSFRDAEHCQQTMLSAAETNQWQEVREEAHALRGVLGHLGLMRASSLAAELMRIPDWQLQLEWCALVQMLDEALLCGRDALEARRQERRRSGVLR

SEQ ID NO: 16511 - protein, 247 aa, Xylella fastidiosa Ann-1
MNKPLQGEVALVTGASRGIGAAVADILADHGATVIGTATSASGAQLIGDRLALLGGHGRALDVTDTAAVGALVEEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGLRNDILNHVPLGHLGDPVDIAHAVAFLAAPAARYITGETLHVNGGMYMP

SEQ ID NO: 16512 - protein, 246 aa, Xylella fastidiosa Ann-1
MITDDSPRFRALVTGGSGNLGTAICRQLIADGAHVIVHANHHRSRADTLVECLCAEGGSAEVIVFDVTAAQASKTALENLLQAGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLIPTGRPGRPEEVAALIGFLCSEKAGYINGQVIGINGGMI

SEQ ID NO: 16513 - protein, 566 aa, Xylella fastidiosa Ann-1
MLAAAMRGMAVTFFSQFMVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAEGMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 16514 - protein, 590 aa, Xylella fastidiosa Ann-1
MPHSAHRPTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDAHYVPMLLALGLTEFSLHPATLLEVRRVIRNSDLGTLKTSVTTLLRARDRKSIEEWMAAHANTTPT

SEQ ID NO: 16515 - protein, 203 aa, Xylella fastidiosa Ann-1
MQPPHAATPKASNTTLAKQHWPPLEHSYNATATPPETNMTAPPPVLPEHTHWMRHALTLAHRAATEFDEIPVGAVLISPEGTLLGEGCNYNITSHDPSAHAEIMALRAAGHQLRNHRMPGCTLYVTLEPCLMCAMAIIHARIAHLIYAATDPKTGACGSTFDILNDPRHNHHVHVYGGLLAEEASRRLTNYFRTKRGQPPLPQ

SEQ ID NO: 16516 - protein, 241 aa, Xylella fastidiosa Ann-1
MGVSMNTVTFPSQGGIDRRRFLKGLALGGVVAGTGLWRLPVHAANPELPPLQRRTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIHRDGLRTTLADRRMGD

SEQ ID NO: 16517 - protein, 49 aa, Xylella fastidiosa Ann-1
ATPQAVKALVEAGADGIKVGIGPGSICTTRVVAGVGVPQITAISDCAEE

SEQ ID NO: 16518 - protein, 247 aa, Magnetococcus sp. MC-1
MKDRVAMVSGGAGGIGTEIVRSLHAQGYKVASTCTVMECARVQQWKKERELEHVEVVMVEVDVRNYESCLKGVEEVESRLGPIDVLVNNAGITKDGVMKKMSPEQWQSVIDVNLTGTWNMTKAVLDGMLERQYGRIINISSVNGQKGQFGQVNYAAAKAGMHGITMSLAQEVARKGITVNTVSPGYIGTDMVMAIDEEIRNKIIATIPVGRLGKPEEIARLVTFLAAEESGFMTGADFSINGGMYTH

SEQ ID NO: 16519 - protein, 1120 aa, Magnetococcus sp. MC-1
MESFAQLAIPQDRPAILQAMAQAWQNPGQPVEVEFHVEIGEIWTKVIRCVMQSTPRPSGSPQRLFGSVQNITLLRKIGDALVHSEERLNLILEGAQEGMWEWDIASGALYFSCHWERMLGFEPGEIPHTYQAWITQIHPDDKTATLEALEQHLQGHTQHFEIEHRQHTKKGTWLWLLTRGKVVQWGDQQTPLRMMGTQMNVTDRIRGEQALRFAHTQLKQQERLFHDYFAHGVVGMAITTPDRLFLHANKQLCVLLECQPKALLNTPIDQWLDPRHRDYYIDQYERLVRHLTENFELELPLCTALGRRVSVNLSTRALWDTSGRITHCIHTAVDLSEHNHIIAQVKESEKRFRAIFEHAGLAVAQGDIHGTIIKVNSAYANLLGYSPDELVGRSLQSLTHPSDFPENLSLLHDLAKKKRSVYTLEKRILHKDGSWIWVESTVTALTNAMDEPEFLINMTRDITDRRRAEAALVESEQRYRQLFQRNKAVELLIDPVNGQIVDANMAAADYYGYSCDTLRQMNIAQINILTRDEIEQEMLRAEQENRNHFQFRHRLSSGEVRDVEIHSGPVEIQGRALLYSIVHDITERRRIEAALSHNRHQLEASHGRLITILDSLQSIVYVADPQTGEILYHNRYLFDIAGNLKGEREELLYPNKKRLSQGTPASRSRGRNHAQSWEYCSPINHRWYSAHSQPITWVDGRTVRLEVATDINSLKQSEQALLQAKELAESANRAKSDFLATMSHDIRTPMNAVLGMVELLGESSLDPEQSHYLKIIRRAGSTLLSLINDILDLSKIEAGQLKLELDDFTLAETVEHVMDILRHKASEKGLQLQTHLHIPPQQRVRGDAQRLRQILLNLLGNAVKFTQQGSVSLTLQQQPDGQYSFQVADTGPGIAPHRQKIIFEPFVQEESGTHRHFGGSGLGLSICHKLVTAMRGTLWLKSQLGHGSIFYFTLPLATAMEPAPDEVSPQSVLHAPVSLTQLVNKRLLVVDDAEDNRNLIQAFLKSCQMQIQMAEDGEQAVRLCQEQRFDLILMDIQMPIMNGLEATRLIRQHEQMQHKSRTPIIALSAHAMLDVNNDALAAGCDLHLSKPIAKKRLLEALCHQLCPVVPTHNDDAPPLP

SEQ ID NO: 16520 - protein, 899 aa, Magnetococcus sp. MC-1
MAFVQRLSIHQKLTLMAVGATLVALLFSASAYMARDYWGRRGALETQYRIQAQLMAQSLQAALVFNDAPSATDLLSALKADGQVHSAWLYDLRGEVFSRYVRANLSRVVPPTPGSLPMSGYRFGKRLLDLAVPVTLQGERVGLFYLRVDLKHYWSMLWQDLYLTLLFLLLAVSAAYVIAQRMHRFITTPIQALAAVAQQVSREQDYAARAPQIHTRDELQLLVEGFNGMLDEIGRQDDALRQHRDSLEAQVALRTTELTVLNGELATARDQALESVRLKSEFLATMSHEISTPMNGVVGMLELLDEKTLSPQQQEYVEIAKHSAEALLAIINDILDFSKVEAGHLVLESIPFQPLMEMEEVVALLAPRAQDKGVALVTEAQWQVLPGQVVGDPLRFRQVLTNLIGNAIKFTQQGEVVVALGWQAGQGTAGVLHFSVKDTGVGIDADTQKKLFQVFTQADGSTTRRFGGSGLGLAISRQLIELQGGQIGVESDLGQGAHFFFSVPMLAAAAPILEPYMESGLADPNRPVWLLERHEAAATALQALLHALGLSSQRLDGLSAILTLGKEPPPLVLINLNDSARPDVLSWLLAHPQVCSRYEIALMGWATSLQEARHHLGESVHYLPKPVRLGEITRLLQQRIRAVPDAPAQPLPLRGQLLVVEDNPVNQKVALAMLSGMGVSVQIVSSGAEALQWLQKQAFDLVLMDLHMPTMNGIETCRQLRQWEQQQGRQSVAVVALTASQDLVEQQHCLDAGMADFLSKPLSVEQLYQALARWLPPQSAPATPVVPLSQLLSEQAMQGLQAQATQGASRALLELWLRDTDQVLQRLPTLLESPAALMPLLRGLQGGAQQVGALEMERLGDALLRWSAQPPHGMADGALLIQRLRNGHTRLQQAINTTL

SEQ ID NO: 16521 - protein, 837 aa, Magnetococcus sp. MC-1
MKRCFLVNSNDTAQSQPADLDTPATEASLYAQCYQNLLNVGQQGLCLLGRDRLIVHTNKTMADWLRVSPEALYQTPFSQWVDLNDREKLEAFFIDVDQDGPSAITLNLVPDLGRNGRSVRVMGAGLSDVGGVAGMGLALVDLSDQRAMLQQLNHELTTYRNIANFTHDWESWFDAQGRVQWINPAVQRVTGYSIAACMEMATYPVDLFHAQDRSTLERLMQEGRAGAVAHDVSLRIKHREGDLRWVSLSLQPMLTNAGEKLGFRTSIRDISERREAEQALEAAKRSAETASKAKSRFLSTMSHEIRTPMTAILGVAELMSGTHLDRVQREHVSIIRRSGDALLELIDDILVISQNEGAQEGEKQVVFDVDHLLESVMDMASYRATEKGIKLLSHVAALVPVRVMGDPVRLRQVLINLVGNAIKFSEKGEVVIQVRPGPRNGPERSDYRFSVSDNGIGIPMEKREAIFDAFSQVDETESRRFGGTGLGLTICRRLVNLMGGQLELLFSEPGVGSTFAFDIPLQPAMEQANPANLEYDHTTLKERRVVVFSRGKNLRTMVQEMLTPEGVHCTAVSNHDELVQLMEVVHDVERDGQGPLCDMLLLDAEKPFANMDVVSYASELKKRKIFRNLHFVILGLDPGQKERFALCQAGINYVSPPLKRRVILKTLAELFVEPGYRHLDDACRNLMHATHKRELKEGGALRILLAEDDPDSSYVIQNFLKDTLCHLEVVTDGQQALQRFQEGMTDPLGAAMEFDLVIMDTQMPVMDGYTAVHRIRSWERIQQRAPVKILAISAHSGQEGRLTSLRNGCDDHLNKPLTQRDLLAHIDALCHRLPKTG

SEQ ID NO: 16522 - protein, 1390 aa, Magnetococcus sp. MC-1
MSMSGKIITLVCVIAILAAGSVGYATMERLQKELTLHAQQQVRHTTQQVSHKLEQGIALLMADVRTLAADPALLDLAELARGVPHEHGDVHAHKQRMAQIFTNLLQQRADYQQIRLIGLDEDGRELIRIKRQPDNTLTQVAPADLQTQGQRSYFKRTIILPKNQVYLSEINLSRENQVIVSPHMPVIRASMPLFDHLGETFGLLVINLDLSRLLADLQHQTPGQSMHLFNHHGYLLASSPPQAELQNFGFEFNQPPLMLTLYPVLAQQLNHSAESAFTLVAQDAPSGTHELLGVQTLYHNPNRPDQRLVITVSMPYQKIFTTLYSSRDESLLIGGGMLLMALLLAVLLTRSLTHPLRAMIRAVEDTAHDQGRHALPVGVGGEMGILAKAFAQMLQRTAEQNAAQADHRANQLLEATDVGVFGIDDQGLVSFINPAAERMLGYSREALLGKNIHSMVHHAYADGTPYPEHACRMSAALREQREYHVTDEVLWKQDGSPFYVTYSSIPLWQGDQRSGAVITFWDTTEQRQDEQKLIAAQQEAELIAAEERALEALFKLTLQESATTHYLEEVLEALIHSVPWLKLKPVGGLFLTDESAPQPQLKLVVNHNLDPELKQRCAKVPFGTCLCGLAAQSGTLQFASCMDHRHVITFEGITAHGHYNVPIMDGAQVLGVMVLYLAHGHEQKERETAFLARAGHIISMGLMRRRAAKELSCAKQRAERANHAKSDFLATMSHEIRNPMNAIIALSHLALEQSHDQRQRDYLSKIHTAGQSLLRIINDILDFSKIEAGKLEIEQTDFQLDDVLSNLATLTAVKAQEKQIELIFDKAPALPHALRGDPLRLSQILLNVVGNAIKFTEQGEVEMSITRHTQRGELLELCFTVRDTGIGMNEAQIAELFRPYQQAESSTSRRFGGSGLGLSISHQLVTLMNGTIQVSSTPGVGSQFVITLPFAVLPDRPESLVIPKLLTGQVVVASANQRMCDVVAENLGRFGLTCASVGAMSTLHQWLENNPLPRFMVLDADMLPVSMAQDLELLLNPMLHRFVEGGVLMLHGYQTQQAVMDLAAKDARVGAVQKPVTSSSLYDGAVQLLGVGSLSDAQHAPVQSNASPTTWPQLTGRHMLVAEDNAINQQIIQELLSKVGVNVTLVNNGFEAVEKANPLHHDAILMDLHMPLMDGFEATTQIRQRFGNTLPIFAMTASSTPEDQKQVQQSGMNGHLTKPIDPVLLYTNLSQWLGEQPPKPPSVSSPQPAQPQPADSLQSVPGQPGQRSPAGPPNIPGINYTLGLQQLGGDAELYHQILLAFEQDQRETSAKLIQLLEAGDLAALEPLVHTLKGLLGSVGAERLRARVIALETSLKMAQPKENIAALIQTMQAELAPMLAAIAQLHIKAGR

SEQ ID NO: 16523 - protein, 685 aa, Magnetococcus sp. MC-1
MQELDPQLMLAGINDGALGSIFLDDQEQIVFWNRWMERASGLKRAEVLGRPLREVFPELVGGRLLRAVATALETGLPALLSHKLNLWPLPLYPSYAVRPHGPRLCQQIMINALRPHGEKRFVLIQIQDISHTVQREQLLQEQTRVLMQREEELTASRLKADQANQAKSEFLANMSHEIRTPMNAIIGMADLLLETELNKDQRRYVQIFARAGASLLELINDVLDLSKVEADRLELEHRPFDLWALVEGAVEIFTLRTQEKGVKLDFELSARAPRYVISDQKRLRQILVNLLGNAVKFTQSGQIQLWVDVRDCEDAGGWLYFRVQDSGIGMSKAQQKSIFEPFVQADASVTRQHGGTGLGLAICKKLVELLSGDIWLESELGQGSRFHFTARFTHTALVAESERAFTSAKLHGRHVLLLGSQPQNRVLLESVLRRAGCQITTVTHQAQLAGHLLEPPAGLRPFHAVLVDCYNSMARVHQQIASVRANGSVMPMVLLVGEARQEDIQIAADLGVLLLERPVSHGRLLEALGATMEQGEAALLSSSLSPTAAIEMLKQVPLKILLTEDSVDNAVLFKAYLKQYPLEITHAANGAEALTLFEQHHYDLVFMDLQMPVMDGYSATRAMRFFEKQQRRPPTPILALTAYALSGDADKSRDVGCDAHLVKPIKKLELLSSIAQYGLKISLES

SEQ ID NO: 16524 - protein, 1061 aa, Magnetococcus sp. MC-1
MGCFAARSAGDAMHRRSSLKVKLSLFLFMVIAMTAVIVSFSVQQLAIQQFKANRDQRIHETQQQLLNRFRSFDLFMNELEAELDLRMAEVLPKIAQRIAQGPEPNAWSLSQLTALAREFSVGDIYLIDHDLKVFNTTFKPDMGLNLGQLGESLKTKLEGLQGSGRLDVDRISMSNQTGIIKKYAYHGPVGKPYLVEVSINMWEGAETFGSMAQKRFFLEEFFQSLVDSNDILKELDLFIADDLAQWSVLHEGTPMDPQAAAQLKGQNSLEQLNNNLLTIYTIQARRENISGFRFYSKTVFDTAMPADFYRGVHLSTLGLALVVALLAYLLVDRLIFRQLYARVQSMDQGLKQMREGALNTRIPVIGDDELTRITLAINELAMQVHDREQQLTATKEDLEKRVAARTLDLQTSMRALSEREANYRYLVEHARSIILRWKPDGVITFCNDYALSFFGYSEQALLGSSVYETIVPNRESSGRNLHQRVDEVANTPNSFTFHENENICKDGRRVWVAWANRAILDEQGQLKELLSVGADITHLKMIQQELTLARDAANAANRAKSAFLAVMSHEIRTPMNSILGMTDLLMEHALDAEQRHALQAIARAGDALMIIINDILDLSKIEADRLELELVETDLDNLMANLGDMLTLRAQEKGVKLSLLREEQLSPYRWCDQVRLRQILVNLIGNAIKFTHQGSIEVKLSKGPGNRIRFSVSDSGIGIDLQQQEAIFESFNQGDSSVTRRYGGTGLGLSISQRLVKLMGGVLKVYSRPGKGSTFFFTIPMAPVPHLGRHLTHIQNWEQFHLLLVEPVGTTSTIGQLLTPLGMQVSHLHELTHISQVVAQLDPIDLLLINLDSVEDETLNQSLQQVHDHPASARLPLLLLLPEPDHTRFEMVKGIGGHCLAKPVRRQGLIDAMELVIGAKHATQEAKIAGEIKGLKILIAEDSDDNILLLQSYLKGSDHQLTIVRNGLEALQQVEQHHFDLVLMDVQMPVMDGLEATRKIRLMEQQQGARQPLPIVTLTAHAMLEDKRRSVEAGCTDHLTKPIKKQVLLKAIAKLMQSVAA

SEQ ID NO: 16525 - protein, 1070 aa, Magnetococcus sp. MC-1
MPMGGGMGIQRRVLGLIAFFLLVAFSAVEVRSYYQLKAYAEESLRTQAEIVQGLLMSIRRVYHHAFLDSHIPLSSDTVPLLPAHAINRISKEFPTWFKGGVSFNNVSDKPRNEQQRAKGIEQQAMAHFRQNPEEKRWFTQYQEENGEAYYHYATPIWIEPYCMQCHGAKEKAPAAIQKMYSTGFDYKIGDLRGVVSIKLPAAHINRLVKQQFLENSLIHLLIFGSAFFAISFFLRRDVGQPLEAISHAVRKFGQTRELPKFEEQPGEFQILLHTLTDMASTVVLRESEVQERQLQIELLLDSAGEGIYAIDTQGICIQCNPAAVALLGYASSTELVGRDIHTLCHRADEQGTHMPHSDCPGCKVIASGEPVHLAQEYLQRQDGSVFPVEMRIHPMHQGGRVVGAVVLFDDISRRLDAEQKLRLSERHFRTLVQALPGTFYKCAPDPLCTMYSLGDNIAELTGYAADSFIENHERSFSSVVHAEDWPRVREALDQALAQGVVYHLEYRVNHTDGKPRWVMDRGQAVYDEAGRAEVLYGVLLDMTERKQYEQRLESARQQADAGNRAKSEFLAVMSHEIRTPLNAIMGMGDLLGETALSPVQRHYLSISQHAGETLVELIEDILDLSRIEVGELELEPAPFEVEALVEEVCEVVTSSAHDKGLILLMRIDPLLPPVLIGDKKRLRQILFNLLFNAVKFTKHGEVMLDIRHDAARSAAGAVLLQVRDTGVGMAEEMIERVFEPFTQGDSTITRQYGGSGLGLTICKRLVSKMGGDIQLESALGRGTTATVQLVLPVGRHGMVAAVRQQVPLHGANLLLVDDNANNREIYTELLQQEGARVVGCATGETAMQQVSEANFDLAVLDFHMPSEDGLTLAGRIQEMVPNMPLLMLSSDQQPAAAARANSMGVTFLLKPVKRQLLRQTIAQLMQSGKGVKDAPVLGQGVESGPQKGLKILLAEDVPENALLIEAYLEETGHQISVVGDGQQAFERFQEEPFDLVLMDLQMPVMNGLQATRHIRAWEQAQGVKRTPILALTAHAMKEDESKSLEAGCDGHLTKPIRKQVFLQKLQGFLG

SEQ ID NO: 16526 - protein, 707 aa, Magnetococcus sp. MC-1
MEELLSSMLDYPELRYAMVVDVNGKVLSHSDKSKAGKFLADPLSLKLIDAPNTLQVLLQSKQVIDVAMPILTNQQLVGWARVSLSQNKSGQELLHVTYKGFLYTLFAIVVGIVFAYFMARGLTKDLYHLLHVANTTRLGQLNHRVQIKRHDEIGLLSNGFNQMLGVLEQEEQQLRLIQQSLTQSNQALRQSEEKFRRLVESLSSEYFLYSHNTEGVFEYVSPSIRTVLGYDPQEFMTHYATYFTENPINMQAVNHTEASIRGEQQASYVIEIFNKQGQAVRLDVLEYPIFDKDGRVIAVEGLAHDVTERHRAEFELLTAKEQAEAANRTKSEFLAMMSHEIRTPMNSILGMAELLSESPLTPEQQGYLKIQRRAGHGLLELINDILDLSKLEAGRIELYIQPFNLPELLQSVVDLLENLARERGLALRLERMEEIPTLCQGDRARLRQIMVNLVGNAIKFTHDGSVKISVEKSSDDATNLLFHVIDSGIGIAEKDQSSVFQRFTQIDSSNSRFYGGSGLGLAITHHLVELMGGKIWLKSALGEGSCFTFTLPLPPVQIDEPALAATHDEEAPMVATESCCATKPLRILLAEDSPDNELLIRIFLRDSPHSLCCVKNGLEAYQQVQKENFDLILMDIQMPVMGGDEAIIKIRAWEQSQQCDPTIIIALTAHAMSEHQKHYLTLGFDAFLSKPINKKTLLNALAQYGQS

SEQ ID NO: 16527 - protein, 997 aa, Magnetococcus sp. MC-1
MLWRTTHKAALAVGLLASAFIIAITWQSQHLLENDAIHNRNLALEDTAEHFSWTLQSRIFEIRDQLRALASNSLVANALADDKGREIYLPTFFSGIQTIGGVPARLSLTNFLGREVVSSQPQLPLLLETELIGAAIQTTQPLTHVHPVDGGSLYMIMMEPVIYANTGMAEGALILQIRISDLLDHKQIHSFWEHSRQITGLGMTFHALGHNKPITLTVGKSRRTSISRILRLDEQHQGNIRFTADVVLFTTDDYFQTAMANKRQDFLMLGLAWIGIAILSAWLLVTWLNRRLNEVARELRGLNLSGASFGRLKVQGEDEVRQVAEAFNAVLERLESAYGELAKKSARQMQLEREKYRGVVDQAGESLLIFDLDGRVVEANSAAEKLLGYRRVTLLNYTQDQLLAPNSTLTIPNHDGDNAENPSHVTFETRLHTADGQDLEVEVWAGFLEIDYVQHTLWLARDITDRKRLEAEMVAARDMAEKAYQAKSIFLATMSHEIRTPMNAILGTAELLAETELDADQSRYVRMFTSAGENLLQVINDILDISKFEAGHIELEQRVFSVREMMGDLHKLLAYKCKEKGLYLLVNASETTPDSLIGDPTRLRQVLINLLGNAIKFTDTGTVALLAHSEQIADKQVQLAFHVVDTGIGISDADQEKVFRPFEQAGTYITRTHGGTGLGLSICQSLIHKMGGKITVHSRADHGSTFTAQVNLDLAEESTAQNFSRLLTGQSALVIHDHVIHHHFFEEGLVSIGASIKSFGNLEQLEMSVRRSREDGGVDFLLIHHEKDRLAPSTEANLVTIRGLPGMAQLPILLCGNLQTVETIQRLEALRVVFISDHYDKHLFFEGVRRALEIVKDQPMLENASADSTCLSILLAEDSHDNIELFQAFLKHTPYRVTVVNDGAQAVGKVTVKKDSFNLVFMDIQMPIMDGLTATRAIRDWEKENHCFPITIVALTAHAMEEHQQETIQAGCNSYLTKPIKKRDLLGYLDRFSRSGE

SEQ ID NO: 16528 - protein, 237 aa, Magnetococcus sp. MC-1
  unsure (1)..(237): unsure at all Xaa locations
MQTHRFLSGRRFSMGAKILIIEDDPTLNRLMVNHLSRLGHHVTGTHSRAEAEHYFNQHEPLLIIMDLRLPDVNGIDYLPQIPVPAPVIMLTAYSSVTSAVKAMKAGAFEYLVKPVNVEELELVVSRGLEHANMLHDRQFFSQQQPQQQRMIGTSVAMLHLQQQIQQMLEHEQPVWVFGEPGTGKSLVARTIHEKSLRRGGHFGILHCDSLPESLLEAELFGHEKGFSPXMLVANWVF

SEQ ID NO: 16529 - protein, 968 aa, Magnetococcus sp. MC-1
MRLNHKILLLTIAILALLLSGSTALNVASFRSTYTDALLRGSFGIGHGINDILNEMLSLGLPLNSLDGMDTKLSNIVKQTPHITYAAITDLQGMVLFHSDAQLIGRHFKDEAAIKSTNTREPIWQIYNRFDGKRYYDVALPIFDQTKQHIGVIRLGFNSKEVDDRVWHEITLIVINMFITFGLIALLLNFVLVRLIIKPVEILSQQARAISEGHFETGPPTQRSDEVGQLSTALDRMSATLHQQFQDLTQYQAELELKVTRRTHELAAANHLLLERNDDLEQAITTQRRLNDQLHQNKEALRESKTLLVSILQSLSVGVFGLDLTGKIQFINPAAANMLGGVIESMLGQSGLSLWYHDGTGKNPNPIGVTLTNHQPQQGEGRFVHMRGHTLQVGYTVMPILEQGQVTGVVVTFNDITANRRTERLTRTIIQGTSKVTGEAFQRELVRNISESLEMRFVFVGRFHEDPMPRIETTSVWANGRQGAPFNYLLADTPCAEVIGKETSVYAEHVQTHFPNDPLLAELKVESYMGTPLFRSDGKPLGILVVMDVQPLTDIELARSILGIFSGRAAMELEREETELALRVAKERAEAASQAKSEFLAMMSHEIRTPMNAILGITELLQEQPSKKEQLEFLTVQAKAGQALLTLINDILELSRLEAGREQLQTAPFDLYELLRSVSTLLEPSAKHKGLSVHLEIAEGLSPNWIGDERRLRQVLINLVGNGIKFTNRGSIWISAQPMANGLEIRVKDSGAGINPRHHDKIFERFHQVDSTATRKHGGTGLGLAITKKLMDLMGGEIRMESQPDQGSCFTLALPLSEAPCALPAAEEAALPPLDVTAPLRALKILLVEDSADNALLIRSFLKSTPYHLEIVEDGQQALDRLQDSNFDLVLMDMQMPVMDGYTATSQIRLREALDELPPSIIIALTAHALKGDREKCLKAGCDDFLTKPIRKKQLLAFLAHYAVSPTL

SEQ ID NO: 16530 - protein, 847 aa, Magnetococcus sp. MC-1
MLKMAEQAPKESQESSPSLTLPPDPGPLRLVRSVGVQMLLMLVVLSGLVLSALLLSESAFEHMQRRVDYMVTTDLESLVATAELANESAAHAAAAPALAAAKNDFSRMAVMDQLMDWQRLLARSISGVKKMQRVAADEERGRYLKAVISHRDDLLDNLYALDGVVARRIALDQQLAEKMLILQRNDESLARLLPTVKTQQTPQFQVNLLAFGATFHSMSAILHSAMQSDSRGRLKRLQKRVMDAHQLAHDYYDSLHLESEQLAPFFDAIHELLEGPANLFQLRLEALDVLKKQRGLLQRNKQLASQFNETVARLFDLVRSDVRRQTAQVKEVAKQSSQHLRGIAAVALVAIVIGVMMVRWRLVVPLDQLHSAIVEHLRGNTRSTVRQSGKNEIARISQGLAYFIALIDQRERALRWAKEAAEQAAQAKSEFLANMSHEIRTPMNAITGLTGLCLKTDLNSKQRDYLTKVEGAARSLLRIVDDILDFSKVEAGCLVLEETDFELESVFDHLSTMISQKAHEKGLEVVYGVPRSVPTYLRGDPLRLSQILINLASNAVKFTEEGDIVVQVAVDRYLEEQVVLHFSVRDSGMGMSQPQLERLFHSFTQADSSTTRRFGGTGLGLTISKRLVEMMQGKIWVESSLGQGSAFHFTACFRYDPERALAPCMLTWALQDKRALLVDNNPTSRGFLREMIASFSLKVQLACGLDEGMQKCHQARDEGHPFDVVVLNFSAEQDSATGLAVLQDLQRLGGDEALRRTLVIVPVTQEALIRAADRLDVGVLQFKPIYPAALQSGLTAILCPQQDDDGAAQKLTRRCIWIYTACICYWSRIMRLINWLPAKSSKGLGPR

SEQ ID NO: 16531 - protein, 887 aa, Magnetococcus sp. MC-1
MALVVGLFTTFSALLTGEAIRIHMDQALQQRTLLALQSTTRFLESQRLNLALLGSTPAVRVYLQNPAMISISQPGLDTLFQQELDNKPWFSSIMLMHGDLVVYRHRHPTLIPHQGIELFGLAEQPITTLENDPYRGEILLRVPLIIPHREDEPYAIAARINPSQLQLQLFQTGGEDHVGSILFAPLDHNNHPMFKDVDQIDPHWQQLLEQGIPQWAWHHQRPLQTKSFYLHGRRHAIYPFAVFGHEPVSIKRTIITQQIFILVAVGAALLAVGLVGISRMSGQITAPITQLANEAYQRVHQALPNLDIDHQRLNDRRDRQNEVVTLGTLLDLLLDELLRHTQDLTSRVQAQTQDLTQANARLLEEIEQRRTAEEELREHQELLHDILETSVDGFLVVDRKGNVTHSNQRFAQMWQIPESIIMQQDESLLLQHVLPQLSHPHSFMAKVNGLYEDDQFSLDELMFRDGRVFERHSRPLYHNGDMVGRLWQFRDITREREQQRQLQTAKDRAESANAAKSAFLATMSHEIRTPLNGIIGMLEHLRQEPLEAALKERFDLICRSSEVLLDLLNNILDFSKIEADQLRFESIPYRPKQLIQDGIELHKLLAHEKGIDLSCHCHPNLPSSSMGDPTRIRQILINLVSNAIKFTETGYVQIEAYLEEGAPAQLHINVSDSGSGIPEAQLAQLFTPFTQADGSISRRHGGTGLGLAISKRLVEAMYGQISVTSQVGEGSSFLMTIPHQPPSQALLLEQGMDDLLAVVSSLEILLVEDDPINQVVARGLLQREGHRVTLAKDGLEALDLFQLDRFDLILMDIRMPRLNGLDTTRRIRARERGHGVTSPIPVIGLTADVLKETLIEGDEVGMQEIITKPVRLETLKRAIARAMHHKT

SEQ ID NO: 16532 - protein, 443 aa, Magnetococcus sp. MC-1
MPSTNPLTRRRSTKMSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNLR

SEQ ID NO: 16533 - protein, 929 aa, Magnetococcus sp. MC-1
MILGFEKPYPLRHTKEGCMSSPVGHKAQDAGLNLTQQSEAFSHAVIEGLSGIFYLFDGQARLIRWNKNFATVTGYDDTTLQGKQALDFIAPCDQALVSSRIQQVFSEGHATIEAALRAHNGQETPYFLSGSLVMIDEQPYLSGTGIDISARKRVEETLQAEQQLTQASLDALPDTYFLFHPETGKALRWNRAFREISGFSDRQIGALPAPSSYYSQSDLSIMATALEQLRKTGTAKLEINLICHNGQTIPFEYAISSLAHQGQNLIISIGRDISERRLAENQLRESEQKFLRLFKEVSIPLVLVNKQGMVTHINDRFTTLLGYSMADIPDLDSWWQRAYPDPRYRAWVKETWTLAVQKAMADGQDIAPLEYQVTCKNGEQREIQISGVTFGEDTLATLIDVTERSRAAKTLQQERDFADSLIHTAQTIILVLDTQGRIMRINPYMEELSGYTLAEVQGKDWWNTFLPQQDHATLRALFAKAVGHIHNQGHVNPILTKDGRLLEIEWYNKTLIDSHDEVMGLLSIGYDITHKRALEAENREALARAESANQAKSEFLAIMSHEIRTPLNVLLGMGDLLHESLLTEEQTGQLELLIKAGKHLVVLIDDILDLSKIEFGGLTLTREPLQPHRLFLLICDIVRLQAQEKGLTFNCDIPTELPPWVLGDEGRLRQIMINLLHNAIKFTQQGHVTLKIAYQPAGSLFSITISDSGIGIAAKHLNHIFDKFSQADSSISRRYGGTGLGLAIARNLVTLMGGHLTVESCVNQGSHFQLTLELPPTQPPIRPSTVALTDLATLKPLNILLAEDSLDNQTLFLTYLKPTPWQVEIAMDGQQAVERVKQGGLDLVLMDLQMPIMDGYRATQAIRHWEQTSGTTPLPILALSAHALRAEQQKSLEAGCNAHLVKPIKKKALIEAIHQNMARTTAKVSHETP

SEQ ID NO: 16534 - protein, 287 aa, Magnetococcus sp. MC-1
  unsure (1)..(287): unsure at all Xaa locations
MFGLKDKPPGARTMDKQRRIERIVPATATADGDGVKIKRTIGSPSLRALDPFLLLDTLESDQASDYSGGFPDHPHRGFETVTYMLEGKMRHRDSSGGSGLLESGGAQWMTAGRGVIHSEMPEQHEGRLHGFQLWVNLPARRKMIPARYQDIPSSAIPEVEVEQGGLLRLIAGRVAGQQGPVSGIDTDPLLVDVRLQGGAVILPIPIGHCAFVLVYGGSMQIAAQRVDQDALAILAEGDHVRLSGLGGALVXAGQPLGEPIARHGPFVMNTHQEIQQAVQDYETGNFL

SEQ ID NO: 16535 - protein, 1100 aa, Magnetococcus sp. MC-1
MSCCHAHYGGSRLISKLNMTTKRWIMSRLVKWLLVLVLLPVVADAQQGERPWPVTVAVLQDFPPLYSLDTHGKPQGLAIDLLQQVAQQAQLKITYKVVQNWGQAMQLVRQGEADFVPGIGITEVRRAEFLFSHPMESVPVSCFVRKQNRSIQGLQDLPGYSVGVIAQSAAHTRLSQIPNMRLKLYQSIDEAFFQLLAGELDAFVTSRPVMEKKARKIAPQEMIKVVGEPLMDLKRGYLLSTQNRALLQRIDPIIQHLTRSARYGEIYARWYGTAAPFWSVEQVFWIMSALLVAVLVVGGLYRVFAIARYNRELQRSIAAQQQAEQRLQRSEERFALAMRGSNDGLWDWDIPTDRVTFSPRWLEMLGYQGAPQDADMRHWQAHIHPDDQPRVEQALGRFLSGDQQHYHSEYRMRHKDGHTIAVLSRAFVLRDATGRAIRMVGTHADITALKEQARRLRESETRFRAYFEQSVVGMVMASLDRHFIDANHAFCHMLGYSRGELLKMNFPQITYPDDLERDLVQFEQLRSGQVSAFEMEKRYLHRDGHPVWGLLSATTVKDELGQASYLIAQVQNIDTQKKALEQLRQSESMMRGYFELGLIGMATTTAQHGWVQINQRLCEILGYPEMALRQKSWAEITHPQDRQADEVAIERLRKGLSEGYALEKRFIRQDGAFIYASISAGCLRKEGGEIGHFLTLVQDITARKRMELALQEQKEQAEAANRAKSTFLAVMSHEIRTPMNAILGMAELLRESDLTSRQHWCVETLNRSGESLLSLINDILDLSKIEAERLTLEHVVFDLVQLVGDVCSLFGYEAQSKGLALKHHIAPTLPRYVVGDPIRLRQIMMNLVGNAVKFTKQGHVSVELNPLADGRLSFVIRDTGIGVSVEQQRNIFKPFTQADSSITREHGGTGLGLTICMRLVALMGGEMQLESTLGEGSCFHFELELPAAPPGAESVVGTPRTLADVASALRLESAAHHNDPILVVDDAEDNRMLVNVFLKKTRYTLVMAENGLEAVNAFKQQPFALVLMDIQMPLMDGYEATRQIRQWEQQKGSGRTPIIALTAHALSEESQQILEAGCDIHLTKPIRKSKLLEVLAEVLA

SEQ ID NO: 16536 - protein, 297 aa, Magnetococcus sp. MC-1
MTTQSVAISRPAELALGQGEEGFQRFLKQAAQAPMLSADEEYQLATNYRRHNDLEAAHRLVHAHLRLVLKIAREYLYYRSSLPDLVQEGSIGLMHAVKKFDAQRGNRLATYAVWWIRAAIHDFILNTAHMVKVATTKLKRHLFFKLRQAKSSLAPLNQQEAEELAVKFATDAQTILEMDSRLAGADSSLNQPLFDEGGELIELLEDERPNQELQLQSAQQQQRLGRLVKQGLKQLNEREQAIIISRFMGEHAEPREQLAQRFQISGERVRQIEQRAMAKLRSYFQSQPDAQELAMLI

SEQ ID NO: 16537 - protein, 597 aa, Magnetococcus sp. MC-1
MPMYLPRIKTTFGVVGWHDGFANQSGKHTMVGLACHPFKVCVEERCVMIHQGEDGVSQDALLGAMLAEHQDEILQSWIRHIVTHAGMRQLEKAGEAELRRQAAQLWAHLVALFEGLPLEDTRCPAYGDVVIVLREMSGLRAEQGFSPMETCQFVFLLKDALLPLLQRRFADHPELFTWALIRLNRWVDRLGMITFECYMESRERTIMEQSRAMVALAESSNRTKSMFLAAMSHEIRTPLHAINGLAELLEREELNQDQKHYVHIIYRAGSRLLALINDILDFSRLEAGRIELESLVVEVRPLVHETMEMLSFKAKDKGLALQWTLEPQVPQWMMSDPTRLGQVLVNLVGNAIKFTQSGEVALEISVAEQQLCVMVRDTGLGIAEDKQQIIFEPFSQSDITISRRFGGTGLGLSITKQIVALMGGTISVQSRLGEGSRFYVRLPLKEVAAGDLLAAQQATQEVEVITLPTLNILLAEDTLENRVLFRAFLKHCPWAIDEAKDGAEALIKFTTGHYDLVLMDVEMPIMDGYAATQAIRAWERAQQRVATPILALTAHALSEYRQQSINAGCNGHVVKPLGKRDLIEAIRQAVTPPVQGG

SEQ ID NO: 16538 - protein, 1176 aa, Magnetococcus sp. MC-1
MAPQSRDRKQMIKELTAYHDISSPKKRMAGIAFKLLVLVLLFATAFENYPLFHILAELFSVIIAITFFVITWNSRRFFDNHFLLFIGISFLFVGILDLIHALGYKGMMIFERKDANLATQIWIATRFLESFSFLGAFLFIRRKVVPELLMALYGIITTLLLLSIFEWNLFPDCLVEGQGLTPFKIYSEYGVSLLLVVGMLLLHHHRDRFNKSVLGYLHWAMLITICAELCFTSYLHAYGVSNLLGHVFKIIAFYLLYKAVVETSLKTPFQTLYHNILLGQEALESANQALIHQNIQLEMVQTVAHLGHWFWEIKPDRFVLSTEAYHILAIDPAIAQPTVEMIHNHIPDPYKQQVIEQLEQVLTGNAVHFQTEHPVRHADGRLTHVFARAEVIWESGVAVKMIGTVLDVTEQKLREQELDEGKLKLRTALEEREKALQCAEQANLAKSDFLANMSHEIRTPLNAIINLSYLILQTPLTSKQSNYLEKIESAGRTLLGVINDILDYSKIEAGHLVLDHVAFQLDDVISNVANIAIARKEDKDLDLLYHVTPSTPTQMMGDPMRLGAVLINLTNNAIKFTEHGEVVIRVDAKQQREQHYLLHFSVQDTGIGISAEQQKRLFQSFSQADSSISRRYGGTGLGLAISKKLVELMGGTLSLQSVVGQGTTFEFTIPLQAVEIKPDEVPSATSLNGVRVLVVDDNATAREILEEQLNAFHMEVCSVASGEAALDVLHHEPRPELILLDDQMTGLSGVETVRRLRGQINLARIPEVLMLSDHGREKVRQEAEALGITHFMCKPISPSVLLETLLEVRGECLPRKQRSRRPLIHPELRDGLSAIAGARVLLVEDNAINQEIAIELLGYAGVAVTPAASGQSALDLLNSEAPFDLVLMDIQMSDMDGYATTRQLRQDPRFKTLPVVAMTAHAMVSDREKALQLGMQDHIPKPIEPEQLFAALVQWIKPRQANQQPLNLSPQAPRPLEEMVLPELTGVDVQAGLARVGGNAELLRKLLVRFAQENSAITQKISNLATENPAQAGELIHSFKGVAGNLGMPQVAKSARAVELALKGSESLDAALHGLTRVLDPILKGLSKLDTTLEEAYSEAQPLEPARVLSRIEEMSAMLEQDFAVAQHVQGQLQTLLQQSRYAHKFQQVVAAMDEFDTDRVQALLTEIAGQLSQPA

SEQ ID NO: 16539 - protein, 112 aa, Magnetococcus sp. MC-1
MKKVEAIIKPFKLDDVKEALAEVGIQGITVSEVRGFGRQKGHTELYRGAEYVVDFLPKLKVEVVLTDDHVERAVEAIENAARTGRIGDGKIFVSPVDTAIRIRTGERDSDAV

SEQ ID NO: 16540 - protein, 1274 aa, Magnetococcus sp. MC-1
MRSSYDVSFRVVHPSGQTRWIVSKGSAVKMHSEGTVHRMVGTVQDITEQKEADQALRSLLREVNFQKYALDQHAIVSATDAAGRIIYANEKFVSISGYERDELLGQNHRILKSTEHPPAFYQEMWRTIQKGETWHGEVKNNKKQGGYYWVRATIVPFMDDKGKPEQYVSIRTDITEQKESERKLISLLHEVNFQKHALDQHAIVSITDRDGFITYINEPFSLITGYSELEIVGGKHRLLHSGVHDHAFYRDLWGTISSGKAWKGELCNRAKNGKLFWVSTAIVPFMNEAGQVERYISIQTDITQRREIERELENNNYLSDMALRLSNSGYWHLLLEDEGYYISSERKALIMGDPPHPGFRYHIQDDWLANIRKTDPAMAEQVFANFTQSIATGQDIHFSYPYVRPVDGRTIWLETAGYVERDETGKPYRVYGVTQDITTRRAAEREILRAKEIAEEATQAKSDFLANMSHEIRTPMNAIIGMSYLALQTELSRKQQDYINKIHNAANALLGIINDILDFSKIEAGKLDMENLPFLLSDTLESLTNLIAVKAREKGLELLIAMDPAVPDGLIGDDLRLGQILVNLVNNAVKFTDTGEIVVRVKQVEANDREVMLQFSISDSGIGMTEAQVAKLFNSFSQADASTTRKYGGTGLGLTISKKLTEMMHGKIWVESTPGVGSTFLFTARFGLSTHPAKSKLKLTGDLQGLRVLIVDDSATSREIFEQLAISLGFDAHLAASASEALLAIYRAEAADTPYQLVYTDWKMPGMDGVELTHRLKTATDLQHPPKIIMVTAYDRDEMLRRLGSNTVDGFLTKPATCSSLMEAAMLVFGLEARTDLENGGELLGLEELQSRAGARILLVEDNEINQQVATELLEMAHLEVAVASNGQIGVEMVRAEPFDLVLMDMQMPVMDGYTAARTIRQEARFQTLPILAMTANAMAGDREKCLAAGMNDHVAKPIDPKELFTALAKWIEPRQQPLPTTTKLAVVDDAQEQLPELPGIDTRNGILRMGGRVASYKKLLSKFILNQANSIVEIEQALEAADIKLATRLAHTVKGIAGTIGADLLQTRAAEIETTLNKGDTAQALAQCPAAQAALQETIAVIQQALPSTAATPQPQAYEALPLPPDFILQLETVIAQAEQFSGEAIERLETLLPTAQGNPCAHSLKNAYQAMAEYDFEKAIAEIQEVVASLRGEDNAAATGVDPAQRDALFTQLYAQLQQYSAQGVDTLEALDALLPAGDDKEAVQKMRQALSQYDFEGALEYLTPIMAVKII

SEQ ID NO: 16541 - protein, 350 aa, Magnetococcus sp. MC-1
MISQERSFCWLTILFSALRRKDMGDFNAVALVLSIIAGGAAIVWAYQKRAWILTLPAGNEKMQAISGAIEEGAHAYLKRQYETITYVGMVLFVLVAFTLDWLTAVGFAIGAILSGMAGYFGMSISVKANVRTAEQARKGLDQALQVAFNGGAITGMLVVGLGLLGVTLFVAYLLLSADATHTMSQALKPLMGLAFGGSLISIFARLGGGIFTKGADVGADLVGKVEAGIPEDDPRNPAVIADNVGDNVGDCAGMAADLFETYAVTVVATILLGVLLMPTFGNVVIYPLTLGAASIVGSIVGVRFVHSTPGMSNVLLAFIKAWVRGGSGRGWPYGGEGGNGGFQGAHLGYD

SEQ ID NO: 16542 - protein, 1261 aa, Magnetococcus sp. MC-1
MAAVDRTERVMVRPLYIWVLLLVLSIPGLGASLAHGEGLLSNDLQAYLKQLGKIRMCVAPDWMPYEQVDAQGRHVGMAADYMRLFEQRLHTPIQLVPTASWAQSLEASRQGLCDILSLVNETPQRQAWLDFTTPYLRSPAVLVVRRDRPDRVQDIAQMRGLKLGITKGAVFAETVKPNHPEITHVSANSVDELLEMVSNGQLDGAVASLYVASHRIRDLGLANLIIGKVAGPPLMLRVGVRKGAPELLQAFQAVVDGISQEDHIRIRTKWHPVLAGELDAWRLSLNPAQQAYLQEKKRISYCVDPHWYPLESMDEGGFHVGMSADYMALMGQRLGVPLRLVASHSWSDSLRMVRLGQCDMLALAQETAARGSFLKFTDPYFSTPVVLVTRKDAPFLAGITDIGDKEVAIPLNFATYDLVRQDYPWIPIRDVATVDEGLQKVSRGDLFALISALPVAYYSLTLGPLDNLKISGHTDYKLKLGVGVRKQDAMLHEIMQLAVRSITPEEHIHIRQKWGMASLSPQTDIALLLKVGAGLLLAFVMVLIWNRKLSRLTKQLQLASAEARVASETKNLFLANMSHEVRTPLNAIIGMSRLAQDLREEHVRQDYLVKIHGASQSLLAIINDLLDFSKLEAGKLALERTPFQIDEVIANINAILGHKAVQKELSIRYYVDADVPNHVVGDPLRLGQVLINLMGNAVKFTDQGYIALRVEQVAHSEHRLRLRFSVKDSGVGISPSAVAGLFQAFTQADNSITRRFGGTGLGLVISRELVKVMGGDIHVESELGVGSRFFFEAEFVPIDEGLHAKTEQPWQGRGAVVVDADRDEQNYLKHILERCGLGCHCYSDPTLLLSEAFARLDPAPHYLFIRESSLSSSALEHLSHHLRHHGVVKPMKQILLCRRQGGDERSGWHSPLMDKMLVEPLHAQQLRRLLAQLEGIETQEGGGLNDGVSAARLRRIQGARVLLVEDNALNQQVAVAFLEQAGMEVAVAENGLRCIEMAEQSHYDLVFMDIQMPVMDGLEATRQLRQRSALAKLPIIAMTAQAMPSERECSMVAGLDDYLTKPVSPEAIQQMLVRWISPRHPAKVRTQMVEPAVMPVKVVEPTLPFKASPGLGDTPTQRLQEDAHEEVAAGRAEDLARFDTITQMDVSVGLSRTGNSAKLYEQLLRGFLERYLDAPLRLDAMQSKQAWAEIGDLAHAIKGVASYMAAEALVHAAQAMDQAVKQESTHRFEEIAGMLNHELKLVLADLQVWRSGQPPQQDASQ

SEQ ID NO: 16543 - protein, 831 aa, Magnetococcus sp. MC-1
MVSCWSRLFRGMWRLGWLGGSPSPIGCCRILIWRRCGLARLSLNRSFLGWLSAMSNRALDQALLRDGRKFNVTVLFPIFGMLVLFMMGGYWLFLLEPKLDANNQSQARTLAGYQARVLAEALQPVGGHYDATRLDGAIDEILVVKEPIANTPIVLGLRVEVDYDMVAAKPGSLDRAKGQTDCKRCFLTTVPLYSKQTGELLGIAEFYANTTFQESIKRDVRTTLIFGTVFILVVLAWMWRTVALSIQRERLSERSTRAIFEAAPFPMILAGIKDGRVRRLNQAAQQFFKVGGDLPVSYPASALFLDQQAFNVIRRRLQNGASVRHKEYEVRDLEEHASWSLVSAYALNKNVGEALMVLGFAEITTLKKVQADLLLAKEQAEEATRAKSAFLANMSHEIRTPMNSVIGFSHLALKTNLDKQQSDYLNKILFSARSLLGLIGDILDFSKIEAGKLTVESLPFTLDEMLDSVAALNANRAEEKGLDLIFSHSSNLPQALIGDPLRLGQVLTNLVSNAVKFTTEGHVQVLVEPLHQQEQELLLKFSVIDSGMGMSSEQVSLLFTPFTQVDVSHTRRFGGTGLGLAICRNLVEMMGGSISVRSQEQVGSHFEFTICCGVQMAQSESHLIHGAKERMVFVQEAGVVRRAIEQNLLGFGVKVEMVDDAEGLLALLKQAYAHPVALVIIGWQAYEAGVVERLKRRLQQQPHKPKVLVLAPSFKVASLNAGAAHYGVDGVIPKACSPLKLANSVERLLQGLPLLIEQSELVQEGAPPQWLQGGRVLLVEDNPINQQVAQELLEQCGLQVSIAQDGVKAVAAVERERFDLILMDIQMPEMD

SEQ ID NO: 16544 - protein, 791 aa, Magnetococcus sp. MC-1
MRFGLSTRFIFFISVLLTVAFVASGVLIMQLEKRFMASQFSQRADALGNFVAKIAPESILSFDVVQLEHFAEMLMGQPDLILAAIVDRSGAPLAIHLNESLPRPLHFKFRGSLFESATFKNLIAFYKNHPQAIYFSYPIRHQYNLLGEVLIILDSSSQREVQHKIFLQRIIVAIGVILLVVLSLYLGFKRYILSPILDLVEGANRMAHGNYKEPIPRTTKAELDTLTVAVNHMMLSIRTNTEEYAKIFRAVEQSPASVVITDAQGNIEYVNPKFCQLTGYSAQEVLGKNPRLLKSGEMSPNFYRDLWHTVTTGLEWHGEFYNRAQNGSLFWEAASISAIRSEQGKITHFVAVKDDITARKKLERELQQARDRAESSNRAKSEFLALMSHEIRTPMNAILGMSELLAESNLSGEQRELLTVQRRAALALLDLINDILDLSRVESGRLELDHAPMHLPDFFIEIQDLFRQQAIKKNLAFSITLEDDLPKTYFADRARLRQVMINLVGNAIKFTQQGGVWISVERLSQQGEMVKLKFSVVDSGCGIPSEAQSQIFEPFTQADAYVTRHHGGTGLGLTISQRLVQLFGGTLQVESTPNQGSRFSFILILQVTTEERSTQPNTQAQTTPEPNTAPSSGAPNARILLAEDMPDNALLIKRFLKNYPCELTLVTDGRQAVEQFCRTTAHFDLVLMDMQMPVLDGYSAVREIREYEAIHDLAPTPILALTAHALKNDAEKSLAAGCDEHLTKPIRKEVLLAAISRHLSLAKHDKPQQHVINDILPAPSRMPQEPDPSAL

SEQ ID NO: 16545 - protein, 265 aa, Magnetococcus sp. MC-1
MVLKIWLHWQSCCKVKEYKSMQNRVAIVTGSTAGIGQEAAKLLAKRGCRVVITGTRETKIMETVEAIRAEGGVAAGVAANIGVDADLDKLVAFAQEQFGEVEILVNNAGITRDNLFMRMKDEEWDEVMALNLTSVFKLSKRVIRAMMKGRYGRIVNVTSVVGFSGNAGQANYTAAKAGLVGFTKSLAQEVATRGITVNGVAPGFIQTAMTDKLNEKTQEAILAQIPMGKMGSVEDIAAAIAFLASDEARYITGETIHVNGGMYMG

SEQ ID NO: 16546 - protein, 1429 aa, Magnetococcus sp. MC-1
MPHRSPIQSRPQPPLQSDALRANLAQTAVAAVEIPPHQQPLLQVVEPHAGIYQPLEQLLKELNHPFRNWRLLLPEWRAFVLKNLYHYLQHPLASTTLPLLGAPFFQALDDASQSREHVAALGAMCAYIEKLAQAVTPQNNALLQPCIEDLLGALQQRPDAQFCLLAQTHHPLKRAIKRLLEIPETPITQLNWQGAAQVMQRHLRLTYAFWLQQEDPSPFTTPLHGALFTALSHPALYQQQKQLERLAERHPPHGATALAFVQGLLELPDAHDMVRLYGEAGNRLSQSLKQSGDAHTERANVARCLQFLFRILENEGLTLLHEKTLREVNQGLVRLLSIAHDHDQTEAFFIRTFESLNHNVLHYPRTALQCIEALGSKVIQLANPRLVELFLEQAVGFGFQHSCVAGVDAQWKTIANPAHLHNIRVWLALIGQQPKWCSTLLSALIINIKLTGTLIRDTDLFQKDISKLLNSEVEPVYNLVKQFARLLPVYYNDIGAEGALRDVSTQLDEIHHRQDPLIHFLRKQCHVESTNLIVPLTAAVIRYWQSGEPAHVAPYLSEPVRMSLLQQAPLLEGVQRVMAALFDQLALQQPEALLNLPLTTLSPIVQAVDGVEASEKQRVLLLIELYQLVEQKYNPGFAGVLPLLQRMAQLGVAEATPLLQALEQGTAPTLPLLLEAMEGLKRLILDPQQHAAQEEIFQKRHIAVGIPSVYGRYSEPKFDALALIFRLERQATALLDGLTANVPEAFVTRATITQVIEDLSLFQRALRLDGIKSRKLRNDLLVVRYFVETNPFTYHQFLDLFRSLSQVVKGIIYTHYTSHHRDNMARIIPTLPAAAMQSKYAALLQAGDTTGNLERVNESFMRDLIAETFSLQALDNYLGRVLKMLHRQLSMLDAQRAQQLLTYDPTKLFCPIHHPNMAILHPIHLGNKGYNLARLVVNGAPVPAGTILTTEFFRCHRLIHDHPPAWQDFMARLRAEMAALEQQTGLGFADPQRPLLVSVRSGALISMPGMMQTIHNVGINETIVAGLSQQSGNAFFAWDTYRRFIQSWCMAHDVERGVFSDIMRSFKQQYGVKKKGQFSAEQMRQLAFAYRDAARGLAITLPEEPWQQLLAAIELVLASWHGEKAHHYRAIMDLSDAWGTAVVIQKMIYGNLLQSMITEETDGAACPRVLSGTGVLFTAHPYRKLTQVMLWGDYTPGNQGEDIVGGLVSTWPISMEQCYSDHRDPQQALEHRFPLIYQGLLELAKTLIYTRDWNHQEIEFTFDGPTVEHLHILQTRNMITRESLHSVVSGFKLHGSLKEHLIGQGIGVHGGALCGRAAFNLEQIETLRQTYPSDPLILIRYDTVSDDIKEISQSQGLLTARGGQTSHAAIVAASLQKTCVVGCESMRVWELQGYCKLDGVTVKLGDAIAIDGHNGHVLRGWHEIERTLY

SEQ ID NO: 16547 - protein, 1788 aa, Magnetococcus sp. MC-1
MSHRWMIWASLWLWLALLGTATAAEGVMLNEAERAWLAEHPVVRVGMDPAFAPYSFIEDGRYQGIVPEMLQALAAETGLVFETVAGLSWSEILAGAKARHLDLVASLVQTPERDRFLQYTQIYLPTPLVVMARNDDSSMSSAADLVGKRVALVRDYATSAKLLQEHPESIPYMVESVAQGLLAVSVGQADAFVGAIGVSDYTARQKGLSNLKVVAPYGGLQYGQRFGVRKDWPLLVSILEKGLASMTEKQKIALFDRWLPVQNQLHPAPVAKIPVKLQLAPHEQAWLSNHPKIRIGVMRGWPPIDFADAQGRPQGIGTDTVHLLDEMLGGGVLEIVSDTWPTLYQQVIDKKLDGLMGITPTEARRPFFEFTAPYMTIPHAIFARSDAPYATGLKSLQGKTVVVEKHFFVADLLRHTFPSIKILERRDTREALYAVSKGDAYAYVGNRAVATYIIDQEIISNVQEMGIVRLSRSDNAIGVRKDWPILRDVLQKGLSQITMAQKREMAAKWVKGSVQAPLELPLTKGEQRWLSEHPQVRLGVRENWAPYDYQDRAGFQQGIAADYVALLDRYLTVTMKMQHIRDDSEWVRIKDTLDVLTTLTPQSAKSTGMLPTSSYLRLPLVMMMRRASPLVEGIEDLKGRTISVVQGVVDTYALAKRYPWVMWRNMATTEQALQALAQGEVTAHLDTIPAVRVATERLALDSLQVVTPTDLQLQLSFGVRPDWPELVSIINKVMQAVPPAEKRVIVQSWMRPRTQTAMDWIYLWKVVGTLLLLAAVVLGVVLVWNRRLSQEIEQRKRVEEELSKLYRAVEQTPVSVVITDLEGRVEYVNPTFCHNSGFAEDEVLGRTNGLIPSDHTSGAEYQALWQQITAGGEWSGEFLNRTKSGGLVWERVSISAVRSADGQITHYLGIKEDISQMKEDQERLAHAKESADLANRAKSSFLANMSHEIRTPINAIVGMCHLAQRMTVEPKLRDYLGHIQVAADTLLGIINDILDVSKIEAGKLHFEDIPFKLDELISRVMRLQGLKAQDKNVELVIDLEPQVPQTVVGDPLRISQILTNLVNNAVKFTEQGEVVLSVKLQGVFDGRVTLYFEVRDSGIGMEDAQLQRLFTPFQQGDDSMTRRYGGTGLGLSICQNLVKMMGGHLQVESRLSEGSRFYFTVSLPIHQAPALERVDQTSLNLRVLVVDDNQTVREVLQRMLKSFGYWVDLAAEGPTGVALVESALQQGQPYDLILMDWHMPQMDGLQASEQIRHLQGVRAQRTPVMIMAAAYGQEDSHTAVSEPGFAGFLEKPTTPANLFGAIMIGLHGAPQEAPSGDAGWGYTVPDLSGYRVLLVEDHPINQALAREMLSLAKLQVITADHGQHALDLLQEASVDLIFMDIQMPVMDGFSATQAIRADPRWQHIPIIAMTAHAMADDRQKCLDGGMNDHLGKPIDPPLLFAKITQWLGPQQRGRASHDAARSGRAPVLMGRRILMALGGGSLGDEIEQMLQQSGALVEQLATGREDLNRWQPEVVLVDRQGYESLSSSPLPRCYTVLVEHEGHATVERPVWADDWLLVPVEGLTLMATLQHALRDQCAGTTEGGADADAVVLPQEDRHFYLRWALAQGAGNRVLLRRLLQLFVEDHARDLELLGAMIARGAMAEVAALAHRLAGVAGGMGAMKLYALAKRMERHGEQARPLAISRLYPLLAEEMEAVLERLQTLGGAAVESPSQAQGALLDRGEMLEKLVELKRLIDGGQTDAVERAEELQGGVLEERFKKDLDQVKHLLQDYEFEAASKHLDAAILK

SEQ ID NO: 16548 - protein, 519 aa, Magnetococcus sp. MC-1
MMTRKDKILVVDDERATIDHLVAILNGDHALCVAKNGERALALVQSEPRPDLILLDIVMPEMDGYEVCRRLKADPQTCDIPVIFLTVKSSVEDEAYGLELGAVDYIAKPISPPIVKARIKIHLTAINESKMRLQKERAEAANQAKNAFLAMVSHEIRTPMNAIMGMNELLTLTQLTDKQQEYVATQKRAGEDLLILLDDVLDVCDMERGAFTLTLAPFYLADVVAVVQAVVGAQASAKGIGFNITCQSGLAEQLVGDRHRITQVLLNLCGNGVKFTHEGSVSMLLETHPKGVCFVVRDTGIGIGAGDQARIFDAFSQSDVSLTRRYGGLGLGLHITRQLVELMHGTLRLQSQQGQGTTFTVVIPFEQVSQPQQQPVVKAEPDPATMQALPRLSILVAEDAEDNALLLKHYFKESGHELTFARDGQEALTCYRQGAFDLILMDVQMPVMDGYAATRQIRCWEQEEGRATLPIVALTAHAMADAVAEAKAAGCTQFLSKPIQKRRLMEEINNIIQARSQGC

SEQ ID NO: 16549 - protein, 583 aa, Magnetococcus sp. MC-1
MATRLAEGDWQATSTLSGKSELAHLGQVLNTMQRHILQERRSLQQSESRFRTLVETSPIPMLVTRAAPNQRVALMNRSFTDLFGYTVADVPDIHHWWPLAYPDPTYRQEIQQLWQARVEEMSLKKTQIMHPVTANVTCNNGNIRFIEVHMSVIDDHALVIFQDLTHRKQESEELRQAKEAAEAANQAKGDFLAVMSHEIRTPMNVMLGMVEVLQESTLDQEQQEQLHSVQKAGKNLLALINQILDLSKLDAGHLQLQPEALNLHELIKEVVGLVAVLASEKNLLLSHQIDTSVPQWILADELRLRQILFNLLGNAIKFTEKGSVNITLSMRDPQQLALVIRDTGIGVDPAHHHAIFEPFTQQDGTITRRFGGTGLGLTLSRRLVELMHGQIRMDSQLGCGTQFEILLPVERTQPPRSDQPQALSLGIIEAHPALAPTDTLCPRLDPALNLLLAEDSPDNQSLIKAYLKRTPHILTIVANGEEAVTAVGNGSYDLLLMDIQMPIMDGYTATRTIRQWEKAEARTPMLIVALTAHALVGDRERSLAEGCDLHLTKPIRKKDLLALLESIAQRLVRQDHQPPAETL

SEQ ID NO: 16550 - protein, 701 aa, Magnetococcus sp. MC-1
MEMERDILNQKVLICEYIDLNSRLENFVSAFNFHILVVDDTTANRYTMKAILGGLEHVVILEANSGEQALALTIEQQVDLILLDIQMPGMDGFETAHLLKMSASTRDIPIIFITAIYRSEHFYKQGYQVGAVDYLTKPVDENLLLNRILSYMRLLQREKSLQRTMAELQRKEHALQTAHDEIAETLRERTVALDRASDAIISADQQGHVIFWNHGAERIFGYPKQTILHTPLLRLIPDQLHETFLSHFSEVIASGEIKNSDSIYEFSGLRANGEVFPIEVSVSYWQGAERHFFSAVVRDISQRKQLETQLRHAQQISESANRAKSTFLATMSHEIRTPLNTILGMGQLLEETDLTEMQHWCVNILGNSGRALLTLINDILDLSKIEEGHLSLEHTPFDLHQLLQEVEELFTFSALAKGITLRGHFSESLPQWVMGDPTRLRQVLLNLLGNAIKFTKQGFVELSAQTMAEDEICFSVFDSGPGIAKERQQEIFLPFTQADSSTTRKYGGSGLGLTISRRLVKLMHGQIQLESRLGKGSRFYFSLNLPQAPTERIPPPSLPATTVVHSSPQRALTILVADDSDDNRILIEAFLKKSPYKLVMASNGLEALEEFKKQPFDLVLTDIQMPIMDGYEAIRQIRQWESSQKMTTRTPIIALTAHVMKEEAEQIEQAGGDLHLSKPIQKKRLLEVIQTLTHDNRLSVR

SEQ ID NO: 16551 - protein, 1361 aa, Magnetococcus sp. MC-1
MRSLSFHLPTPFSLFSRLGVGAKFTLLFYMVVLLSLAAVGFYGYSHASKAYREKAQTVVANQASALSQSIANYLSGVPKDLHFVSNYYALNRYLYWNDLGVADKTLLWKNATIDTFRALLEARNDYLAIDFLDNQGVEQIHVHSTEATNEQALATTPLIPNREQSDYFTATHALPKDGLYVSALTLNKVNDKIEKPVVPVIRFAQPVYGKNGVKYGVMVIHVLANAFLDFIHHANMDAYRRYYLVSPEGYYLYHPEAGKSWGHLLNHSAGCASEHPQLLAKIKDLERGSIDWFEHLVSFQRIYPDPHDRTKYWFLLGFIDSKEALVQRSNFVTIFFIILALTLLAVVGAIRYSIGSIITPMLAMTEQLEQLGQGKVTVTPIHYPHADEMGRMIDSTQRLMQSMQALTDQANAIALGNYAQRVKILSQYDVLGNAINNMSFALQLNEQQQRQREWHNENLNRLTHDLSGDLTPETLAQQAITLIGEAIQAGRGGLYIYDDQTQPHKPLLLVGRYMFTQHDEGQQRFSMNEGTVGQAAAQKKPILLECLTPPADQLSSGVANFSARNSYTLPLLYEDRLQGVLEVATLNPLNTQHRQFLDAACQIIAATLFTSLQRERIANLLVLSKAATQRAEAQSHQLQLANAQLEEQQQQLQQQTEELQQSNTQMEHQQQLLQQQAEELRINNEALQHSQHELNQRAIQLEEASQFKSDFLANMSHELRTPLNAIILISNLMSRDETGRLDQESIERTRVIYNAGNDLLRLINDILDLSKVEAGRMEVHLETVHSQELVEELEPLFRDSAQEKKIELRFDDQLQGCFTSDHQKVVQILRNLLSNAIKFTAQGSVILRLAKSDHPQYPIRLSVTDTGIGISKDKMPYIFEAFRQMDGSISRQYGGTGLGLAITHRFATLLKGEVELHSEEGKGSQFTLLLPLAHPHENTEHGQTEPNAPLSETNGPTAEPTLMPPLPSRFLLKGRPKILVIDDDLLFVENISYINQAQGLDTLSAHDGREGLRVAKSHHPVGIILDLGLPDMRGEEVLEQLKRSPELRHIPVYIISAKDKQRALVDQGAIGFLQKPVNDAQIATAQRTLLQHVSANYHTLLILEGPALQQDLIAEKAMNAGMQQLVVQKPEEVLAKTAGHPFDLFLTDYDIEGMTCVELCQQVRQHQPELPIIIYSSRSLNEQQLSELHDVTEHIIQQAPKASDRVLRSIERFLTSTTQKRSRAGITKVNPFGQNRLEGHTILAVDDDPRNLFVLTASLEQNGAEVHKALNGLKALEILKQHSVDLILMDIMMPEMNGYEAIHEIRANPSYCEIPIIALTAKALKEDKQKCLDAGANDYLSKPVDYEILINMVQTWIKRTV

SEQ ID NO: 16552 - protein, 683 aa, Magnetococcus sp. MC-1
MDGKSNMAEDTKREDMKKLIARGKERGFLTYDEVNDVLPNDMTSAEDMEDVVGLLDNMGIDLIDDEREEGARPKSRPAAGIGNLDSLDDDVDEEILGISDFDSEDDESDDEDGLRSDGAIEDIDLGKTDDPVRMYLREMGSVELLTREGEIAIAKRIEEGCNEVIATICDAPSTFNEVMMLAERLRAGEISLREVLDISTPQDEGSEDEDLNNDDDEVEASTESDDEDVDEDDIVNGPVKVRNPVPEPPPVKTEEEIAAQREADNEQFRELYEATLAIFDEITRENEVLVELRDPLNDALQNDPEGETCKRLLAEYQAHKARIVEIVAGIKFSPKQRDRLVERIKSYVAAVRAQEQKIITIVTQCNVKKPEFIEQFTGNESDTTWIQNFAKTRSAPWKRLYEQSELICEAQLVIRSIEEEAGQTVADLKKCNKKLMDGERRANQAKKEMVEANLRLVISIAKKYTNRGLQFLDLIQEGNIGLMKAVDKFEWRRGYKFSTYATWWIRQAITRSIADQARTIRIPVHMIETINKLVRTSRQMVQEMGREPTPEEIAERMSMSLEKVRKVLKIAKEPISLETPVGDEEDSHLGDFIEDKSMLSPSEHAIMSNLRDTTGRVLQTLTSREEHVLRMRFGIGLPTDHTLEEVGKQFNVTRERIRQIEAKALRKLRHPTRSRKLRSFLES

SEQ ID NO: 16553 - protein, 1220 aa, Magnetococcus sp. MC-1
MAVVQRLKRDVKQLETMLGVYESPGIDEALTPLKRMLALNQAYVENFKSHRALLNNFLDYFPNAWSESLAQLRMQQGDAVLHPLLDEVMAAFITMAHGTPLRDRAGVHALLEQVMASALTLDTRQRRGIITMVRYAQAILHYEDDLKEILQGIEQTDLNAQLGVLEERYMQLYSQHQQKSSHYRLLLFMGTLLLAGLVVWSFLRQRRNGLSLEAAIKQLAFQKFAMDQHAIVSIADATGNITYVNEKFCLVSGYAESELLGNNHRVLSSGHHGATFFQEMWHTIEQGNVWHGELKNRAKEGGFFWVASTIVPFLDSQGKPYQYISIRTDITQRKRVEEQHEKQKIFLQGITDAMGEGLFAVDREGACIFINKQAERMLGWSAEEIHLKKMQGLIHASTRIADAYQWPALRSMDEAAPARSEDEHFINRSGQMFPVSMVAVPLEEGERIVGSVVVFQDISVRKQQEQVLQGAVRAADQANRAKSDFLANMSHEIRTPMNAILGMSHLAIRTSNDPRQRAYLQKIHGAAQSLLHIINDILDFAKVEAGKMEMEMVPFNLDEVLDTLATLTSVKADEKGLALIFRRHLDLPQRVVGDALRLNQILLNLTGNAVKFTEQGSVVVNVEKVQQQGDQIVLRFSVQDTGIGMDESQIQQLFVAFEQADSSITRRYGGRGLGLAICKQLVNLMAGELSVQSTPEVGSCFTFTVPFTVVQEQVVDAIVPQGIRGRVVLLADGSALARRVVAEMLKHMGCDVLEAEQVEQLLTALQAKIGPDMVLLDSSMVDAQGAHAYAAIRQADAGGACPVLVMHTHGDREQVLAWMAKDKQLGHVQKPLTPSRLLEGMVQLLVDEGRVTGLSGETDVIARYKPLLTGANILLVEDNGVNQEVAFELLSMVGVEVTVADNGSQALSFLEQASFDLVLMDIQMPVMDGYAATQAIRQNMSLTLPIIAMTATVMEADQARALAVGMNGHVSKPIEPHKLYEMLLRWLPSKGEPSRAVARLRLPGDETEPDVTLPEQLPGINIPLGVQRLVGNKSLYLTLLQRFYQDQKEIMVQIREGLARKDFNTCMMQAHTLKGVAVSLGALPLAACAGVLETACKQRDERATTQALIPLAQSLSEVMAGLQPLTVEAQTALPERPVGGDSRTAQLYSLLQALVEPLEMRQPKACQPIVAQLQESSLPGSYETPITMLLSHIQRYRMKEAEQLVQTLLQRLAGECTDES

SEQ ID NO: 16554 - protein, 843 aa, Magnetococcus sp. MC-1
MGYDAKLPWGWAPLLVCLVVLAWPAQLLANRVPDPIIVGVYQNKPMIFLDEKGEVQGLYKDILGIIAERHGWQLEYRYGKWSALLEQLQRGEIDLLGAIAYSDERALSMDFGKQSFFVNWGQVYTREERKVASFLDLQGKRVGVLKGDIYGHRLAELVKKFGVSIEIVGYDSYSYVLHGIKQGEVDAGVVNRLTGGAEQQRFGLYGTPILFNPVEVTVAVPKGKNMALLSAIEHDLVVMKADKDSAFHKAFDRWLGIASKPEMPSWYRTGFWIIMVLMLLGVGWNLSLQRRVVLQAKRLEQEVAERQDAEQGLQHAHQELEQRVDERTQALEVSELRFRTLFHAALVPLFRSSLDGGRVLLANLALVELFGYSSVEEMVTLHDPLKSYADPLMREHFIDILVRDGRVECLDVELVRPDSSRFYAEISAIHYPEGGYLEGAIIDITHRKRTEHALIQAKQSAERANRAKSEFLATLSHEIRTPLNGMIGLLTALQASRLDAKQQEQVGLISRSSNLLLDLLNDILDFSKIEAGELVLEQIPFSPLQLVEDVCACLSERAQGKGVGLRLETHGWIPPGLKGDAVRIRQIMLNLTNNAIKFTQQGEVVLHLWGLEQQPVPLPSWVSMRFGVVDSGVGIAAKDMGRIFDPFCQADRVLDRRYKGTGLGLSICKRLVEAMGGEIWAESQEGQGSSFRFTLTLALVEHLPGQAMGRELVHEVLPMRILLVEDDPVNQMVAVELLESAGHKVEVADNGASGLVKAQECSYDLVLMDIRMPGMDGITATRMLRAFEQAEGRERVPVLGLTADTLKETLLACREAGMDDVLTKPVRVNVLTDRVARLGFENP

SEQ ID NO: 16555 - protein, 890 aa, Magnetococcus sp. MC-1
MLTRDYRCSTPPWIMATWRSLGLPCPRSKLAPALWLFRGAAALGGGLTALMLIPLGWWFIRRQLVSPLHTLLHEIQQFHQEGRIPPRQIRYGASEFRTLTLEFRTLAHSIIEREKRLRTLSTGLEQAPISVLISDTQGNIEYVNPYFEQLTGYYSHEVLGKNPNLLKSDLNPPELFRDLWRTISAGAPWRGEFINRKKNGALHWQMAHIAPVLDNDGQITHFIALSEEITARKQADAALNESNERFRTLAQVSPVGIFQTDHDGEYIYVNTTWESITGTTSPQALSSQWDIHLHPDDQPRVQQRWQETVLHGNAFHEEYRFLRGDGTIRWVIGSAAPQRDPDRVIQGFVGTLTDITERKQMELELGKERALLRSLIDSIPDLIFYKRADGTYMGCNRAFELFCKRPEAALIGHTDQALFSPELAQLLKSGDELVINKNSCFSHEATGLFGDGHQVPFLIQKSPMHGYQGELLGLIGVARDITQRLRVEQELQQAKEDAEAANRSKSEFLAAMSHEIRTPMNVVIGMGEILLETPLNAEQTRYINSMQHAGDALLELIDNILDLSKIEAGRMTLEERAFRLDTMVISITDFFRLQALNHNLSLVVEIAPELEQQYVLGDAGRVRQVLYNLLGNALKFTEEGGVSLHLSLDANQHIHTRVSDTGIGIAPQQLERIFDNFTQEDSSVTRRFGGTGLGLAICRRFTELMGGRIWVESIEGQGSTFHMTLPLVLSHTPLHETPTTAVITPYNQGIVEAPCAFTPEHPQRPLSILLVEDSEDNRTLFKAFLQHTPHALVMVENGADALERVIVERFDLIFMDMQMPIMDGYSATRAIRQWEQQRGVPPHIIYALTAHALSGDRERSLQAGCDDHLTKPIKKRKLLEIIQQHAQPVE

SEQ ID NO: 16556 - protein, 393 aa, Magnetococcus sp. MC-1
MPLVTKRGHPLSTIKRSPKPAPLSRPTAPFTNPCSTACVMSPWDAIDVKQTFWTQPATLEIKNMAKIDVFGIGNALVDQVYAVEESFLTQIGEEKGRMSLVDPQRQAELSRALASTPALRACGGSAANSLIALTQLGGSAFHACRVAEDETGHFFAQDLTANGVQHQLHTLPAGSSGSCMVFITPDAERTMCTFLGASADLQPEDVPDAILTTAQWCYVEGYLVTAPNTLAAALKGLQQARANGVKTALSFSDVNMVKFFRDGFSQMLGESGVDLIFCNAEEALAFAETDDMAQATAALKKQSRTFVITLGAEGALLWDGQQEIQVAGQPAKAIDTNGAGDMFAGAFFYGITQGWDFTKAAQLACRCCAVLVTHAGARLPKSRTQEILAQFVP

SEQ ID NO: 16557 - protein, 1691 aa, Magnetococcus sp. MC-1
MVDSNDKLVNILLVEDSKSFAALLQGQIQKRLGFRVVWADSLAQTRQHLEQAKHPFLLAILDLHLPDGPHGEVVDLVLQHNLPAIVLTGDKQVEMRTQLFKKGVLDYFVKDNRSVIDAVIHSVLRVARNRHLTMMVVDDSRSARAVLGQFLQRYGFQVRLAQDGAEAWALLQETPVDLVVTDYEMPNLNGVALTAKLRSRYSRDEMGIMGLSSAGQSELAVDFIKAGANDYINKPYEPEELISRVYQMAESVERYGELNQMVARHKAVLDNAQDAIITTDQQGDVLSYNPAAERLFGYPRQNVMGVSLTERLIPESLQNKQAPSLTNAMHGALEMVPNKGRLEAIGKRIDGELIDLQVALSAMPQQGGELHYTAFIQDITDKKQLLKSLEETLSAAESASKAKSAFIANMSHEIRTPMNAVLGFTDLALRGDLSPKVRDYLEKTKNASHSLMGIINDILDFSKMDVGRLELDPVKFDLHFLLERLADLFSKQAADHAVDLVFLAPLNFNQVLYGDAMRLEQIFINLIRNAVKFTKNGFITVRAQPELLEGHRVRLTCSVSDSGIGIDPEQLPHLFAPFVQADSSTTRRFGGTGLGLSIVKRLVSLMDGSVWAESEPGKGSQFHFEILVDLYAEDRRNRSLLPDVLWGERVLVVDDNPDSREHLQALLSALSLSPSLCATPAQARALLLSEQGGPQPFRYLLVDWGLPGKDGVVAVIEMRAMLKAELPEGLHPRIILLSAFGQDEIKNQAERAGVDYCLDKPISRDRLVTALSGGWHDQEQHKDRRKVQQLAAESEIGRLVGGAYLLLVEDNPINQQVAAELLERVGLVVDIAENGQQALDRLARFEYDLVLMDLHMPVMDGSEAMQRIRAQEAWRSLPVLALSTGTGEEEQLDLQDLGFQGFLHKPIRPERLYGALKRWITRPTLDASWRIVARGDEVPLLRGVDPEIGINRLAGNQELYVVLLSRFFQLYAEVLPSMQQQLQRGQWAVLGRQIHGLRNRAAALGAVELAKAVVALELAMADGHEAMIEAAFQSFSHRLEQVLQGIASHQVEQKGVALSSNLLHDDLPELVVDLHQVGPLLDQLAGRLKYHSIDAAALLQALGELLKETPLATAYWTVCKQVDRYNFYEALQSFLLIAKALKYPIIDQNVRCPASVKERILIVDDQPDNVDVLKDILEDYERMAALSGPEALMLAQCDPAPDMVLLDIMMPEMNGYEVCRRLKAMEATQEIPVIFVSAKKEVVDEAEGFLIGGVDYITKPYHGEVVRRRIHSQLELKRHRERLEKQVRMRTAELELATREAELRKDEAEAGNRAKSEFLAIMSHEIRTPLNAILGTHELLSESALSSEQQRLMEISRNAGELLLNLVNETLDLAKIEAGKLDLEYTIFDLPRLVEEITQIKRVAAEHKGVRLESEMALEVPRFVMGDPDRLRQILVNLLSNAIKFTNSGTVSLQMSRGVADRTFFKVSDTGVGIAAHSMEKIFHPFTQADTSTTRKFGGTGLGLTICKHLCEAMGGDIQVESQVGVGSTFSVNLPLPRAESSMDEPSAPEEVIVEQVQAPLRILAVDDAEDNRKLVQAFLAKSGHHLDLCEDGAQALDRFKREHYDLVLMDLLMPVLDGYGATRKIRQWEQQQHRLPTPIIALTALSVRRDLDKALACGCDFYLTKPFRKHQLLDAIYRIHGMLAGSIHQG

SEQ ID NO: 16558 - protein, 853 aa, Magnetococcus sp. MC-1
MVNIHMITIRLGIHQSIQIWLFTLYCLCVGVAWAEPEVGATTLSNRVEWSPAEQQLLKENQKLTYCIDPNWMPIEAISDEGAPVGITPLIARKLSQLLGIDIHFQSTPDWETCINKLRAGEIDLLLIAGQSAKRRQFLNFSHSYYTFSPVIATLRNTPYLQHIEEIGDRTIGVIRNTATESRLRDNYPSIHLKTFNNLDEGLDAVEKGQLFGFSSVSYAISYSLVKEQRHTLQISGRFDLEQPIHIALSRRHTALTPLFNKAIDYFPMSERAVIFSRWIDAIPQPLVDPIILIRTAAVLAILLIFAIGWNRIRILKAQQAQKQVEHELDLSRVAAQAKNTFFAQVSHEIRGPLNAILGYVVMLRQTELKAQQLHLLEHLGSASHALLTLLNDILDYSRMEAQKLTLAPQPTHLPTLLKRMEESFAPRIAKKGLHFSLSMAKDLPAWANLDPVRMEQVITNLLDNAYKFTLQGHITLEARLESDASTPPRLTIIVSDSGIGMDTSQEQSLFEAFNQADPSIARSYGGSGLGLAICRHILSLMEGDIAMESTPNQGSRFTLRIPYCPVSETEIDTLHTSPAVAQAPKEPRHPLATHHSGCHILLVEDNPLNTHVLQLFFEEAGLVVWHAENGQSALDQLAQHPVDLVMMDVEMPVMDGLSCTRRLRRNYPTLPVIGMTAHSDAGIRQACLEIGMNELIFKPMDWAQLFELLHHWLPTTTSPRPTIPLQPPTPDAASTKKLPALEGIDVTIGLQRVVGRETLYLHLLETFAKDHQQTQSLLRSALLNSDHVGFRSQLHGLKTSADYIGAIPLAHQAETLYQLLGKTWNGSSKIEANTLIGNLEKLLEGLRGWQQAQ

SEQ ID NO: 16559 - protein, 948 aa, Magnetococcus sp. MC-1
MNIRSIVFLFGFSGSAILAAGIWSFSVSYGEVTALFQRQNIISQITDQGYRLALLTNEVLLQREIRAEQQWLSLYRMLEQFLEKNAAQLTPVQSYVQGIQHSLQNLHQLFERVTEGFKIGPLEGNAYQAQQRLYLLQMSQISIRIAELQTRLGELTNISNDAAEKTAGSSYEGVLFQFGLFLFALILYAVLAILFFYTRLLEPLNRLHKGIQRIQQGDVKHRPSHRVMDELGALFAAFSHLLDELQIAITYRKNNEEHLRQLLKLNEEASHLSERELCDRGLGIVVSLTQSEVGYLHMVHSDQETLTRVTWNHPRMALGHALDDALVFLNQAGVLTDWAAREKPIIQNNKPNFQDDQEVSADRFTFFRHLSVPVIEGNNVRMVMGVGNKAEDYNQNDVRQLQTVANEVGKFVQRRRSEIALRIASDEALKANRAKSDFLAVMSHEIRTPMNAIMGMTELLEETELTTIQRNYLSICRSSGQNLLQLINDILDISKVEAGRMEVAVAPFHLHRIIHDANQVILFRAQEKGLNQIVYIDPAVPTILLGDQARIRQILINFLGNSVKFTQSGTIATLVTTRAHANKEDQLVIHVVDTGIGIEQSEQEAIFKAFHQVDSSNQRQQGGTGLGLAICLKLVALMQGSVSLSSRAGKGSTFTLTLPLTVAPAEQIQSLKVERGLTGYHMVIWHTHPISTLYIEEMFKERGAKVRSCNQSMTLANCAIQGDAVLATTDMMIIHYHEEDKTNPLELINTIRSEQSLHEIPVLVYGRCYDPALLKQLNQLGVRFLPESLMQDVLCEQIVTELSKRPRSAVTSGQGGTLPMHILLVDDSPDNIFLIQAFLKKTSYQISTVYNGKEAVEYVMQADTPPDLILMDIQMPIMDGYAATRQIRLLEQQQGQSRIPIIALTAHAMAEEAEKLKAAGCDLHMAKPVSKRILLEVLGRYHEKMAYS

SEQ ID NO: 16560 - protein, 1101 aa, Magnetococcus sp. MC-1
MIPLSQSDARLMCTGIYFSRLLGGAALVILVLGVCLLVLFNSFQNQREATQAGMLKTTRYLQLGMTHAFESVDNALERVKDVVHSLKSPKQLNDTLTQVLKFSPHLRQVIIADKEGQVIADSALALFPTLPRVKLDLPALGLSQERLRSLGDRMLLGIPQQGRFLGAAHDIGARNDLWFMPIALLDEGPQGRHSIVAALNPQALFGSFQSAVEGSQGSSALVHLDGHILFAATAKRHRGAAMKGKQLHASWQETWSQGDEGLVPRLPFARQQSGFTAYRISPIYPLVTLVSVTDEDILSGWIHKNTAFIVLISITPIATMLLIGLLLWQERRRLRLNDRIRVLSEVVEKSPAAVMITDPKGAIIYINKSFETLFGYSAEQVLGNTPRMLKSGLTEDFVYAELWQTITAGGVWSGEMVNRTACGQLCWTSCIVSGLINDQGEMGYYVAVESDTTEAKQRELDLHKLSTAVEQSPIAIVITNQEGAIEYVNPHFCNISGYSAQEVLGENPRLLKSGEMAAAYYQELWSTITRGEVWRGEFRNRRKNGSTYWESATIAPVRDINGQTSHYIALKEDISLRKSYEEQLIEERHKYQEASRVKSDFLATISHEIRTPMNTILGMTGELKESHLSGEQLKLLQSIQAAASNLLQIINDVLDFSRFEAGSIELFIAPLLLRQVVSEAEQIVAFQIRKQGIRFLTYMDSTVPPFIFGDAQRLRQVLVNLLVNASKFTEQGTIALLVHLQPGKAEASDQQELCFRVVDTGIGISEAHRDKLFHAFSQADGSITRQYGGTGLGLSISKHLVGMMGGTIGFESCQGVGSTFWFTLPLQADQTEDGTPQWRPILKEMQIYSLHDHPIHLNFYESFLEQLGGIVTPDHFSVDEHVGVVDRLREHPQLLLFHLENMGQIQIQGMVSAIRARYFELPMVFCADCSENLPLLNESMWGVYFVHDQQDPSRLYQILEQAVSAPRPIRELAQSGPQKRILVVDDSTDNLELIRLFLKRQPYTLEFAESGQEAVDKVRQRPSFDLILMDVQMPGMDGYQATRTIRLWEKANDLASIPIIALTAHAMPEHRENSLRAGCQEHLTKPIHKLVLIQELQRFLA

SEQ ID NO: 16561 - protein, 1134 aa, Magnetococcus sp. MC-1
MAYIRRGWVDLKKGNRYSMSKLNEILMVAVVYFITARLGQLLAISPGNVTPVWLPSGICLAWVLLRGRHLWPGIFLGAFAGNIWAYFDTNTLSAILKSILAGSANGLGDVIAIVGAAWMINTISPATALFNNSKNTTIFLIYGGIIGPFISASIGIFGLLLTGNILPNDAFFSLITWWTGDAMGVLFITPVILELYHLKNIQTIRPNRDVILHFVLFLSITTTVFFLSSNQDPSIWIVFLAPMLVWATLRFSQVILFSELFILSTISIVATATQHGPLLILDDLASTLIHLQVFLGSVALSVFYLNSVNRELRASKHNLELNVIERTKDLQVLNSNLLKEIRSRQHAEDSLKESQKALLEAQNIAQVGNWTWTIETNTLSWTDEIYRIFGLIPQETPPTYQAFLSAIHPEDRLFVQNAVNQALEQLNTPYQVEHRIIRPNGDLRTVVELGRVERDQQGTPFRMIGTVQDITARKQTEALLLSSEIRFRSLFDSMNEGGALHAMVFNEHGNPIDYRILEVNKAYTEILGITKEQAEGRLATEIYGQTSPPYLELYNRVVKTGQSLRFETEYSPMVRNFEISVFSPGENQFATVFTDITERKKTLQKLNGALDELEKKSNFLQSLVQNLPDLIWMKDPEGVFLTCNPAFERFVGSQEQQIKGKTDYDFVDQKLADFFRMNDLLAIEKGGPVINQEWVTFAADGHKALLETTKTPMFDKQGRIIGVLGVAHDITATKQAEQDLIHAKEKAEAAYQAKSEFLATMSHEIRTPMNVIIGLSDILMETPIDHEQRDHLLRLQKANKTLLDLVDSILDLSRIEANQISLKQEPLNLALMVEETMSMMSIVADQKGLRLESQVTQATDDYWSLGDESRIRQILVNLIGNAVKFTEKGSIWVTLELFTDTLERTLVRLCVKDTGIGIGPEHLETIFDKFTQVDSSYARRYSGTGLGLAITRRIIQLMGGKVWVESNPSQGSLFCVELPFIPVQPIALKEDTTLQNDVNRSTNRPLRILLAEDSEDNQMLVQTYLRRTHHELVIVMDGQQAVDAACSKPFDLILMDIQMPIMDGYQATGIIRDDQHRHNKPHTPILALTAHALDEDVAKSLAAGCDGHLTKPIRKAKFLQCIERYQPITFLDES

SEQ ID NO: 16562 - protein, 1314 aa, Magnetococcus sp. MC-1
MQRPRESDGMPQSTNPSMQPNPAQASTPQAVPPSPRPAQLRLTRRVLTLLTLFALLVALGIGLLLGALPFLQGFNLTAWWQALQPRLWTLLPGVVLLVGTTLWLLRGVVYPLLNSYHHQLNVLDQQRLDQHDQIKQHQHQLHEANAHALRLQRMSQFLHHITESTQMSMDEKIEQGLEYGQSLFGMEISFVGQVREGICRVIHVLNSDTLQKNSRLVMDNRCCLKQLAQNEQGVVSPLLSACCAEMVCAQLHQFQALICAPLVVEHQSYGVLAFASMQPFQSLDSRRDEALLELLAQWVGTHLAQQQRMQALQWSNERLARFRATLDHLDDMIALADPRTLRFVDVNRGMVESTGLSLDGLLSKRLADLTTPQSQAKVNRIMNRLVVGLDRMLRFEVTLQHTNGSCIETDALVQWVELEAGKPVVVHMLRDATERKRAETALRVSEERLTFALEGSNDGLWDWNIAEDNLHCSPRLEAMLGFRRGSLTGSMARLKSMIVEQERPGVEALLRIHLDGHVDLYEAEYRINSASGRLLWILDRGKVVQRNSKGQPIRAVGTFTDITARKDMEAALHDAKVEAESASRAKSRFLANMSHEIRTPMNAILGLSSLALEQAKEARQRDFLEKINHSGHFLMGLLNDILDLSKIEAERMDLESQPFRLDELLKQLAANVLPAMRNKAVEVHFFIASGTPLALVGDALRLGQVLHNLLSNAMKFTHEGEVRITLTAEPYVQLTDHYLFTFEVKDSGIGIPAEVQPKLFESFIQADSSTTRQYGGSGLGLAICRRLMEMMHGKITLQSSLGQGSTFTCRLPLQIQSCTVTCCPMPEDAFKGQRLLVVSNSGSLPESIQFSMGSLDLQLRHTVDPEAMAALVAQGFYPDVVLLDDNCGDSTQLVNAISQFTLMMTEQKKPTILMTTVHQDSTLLERLSAAGMDGVLDKPLLPMALYDVLMRLLHTGSLNMGGLESVSSRDHAAHLAGLHVLLVEDHDLNMEVAKAILERVGIRVITAQHGGEALALLEQTEGAAFDAILMDLQMPVMDGFETTRVIRSKTAWAQPPIIALTANAFSQDRERALQVGMNDHITKPIAPGLLYAALERWIDRKDRAIGHLDLLSQAEEVVVFPPLQGWQQQQVLIRFEGDEALVRRLLDRLVEECHRLLSHVEPLLTQQAWPELLASVHGFKGITGNLGLEILQKNASIMEQGLCKERVVASQVAQHWHILAGSIRDFVGTYGQWQQQCMEGDKGHGKRDEQGKGDDILQELLELLAGRQMGARDHYKRHRRVLMAWLGESKAAALEKAMAELDFVTAEKVLLSRS

SEQ ID NO: 16563 - protein, 112 aa, Magnetococcus sp. MC-1
MKWIVAIIKPFKLDEVREALTSVGISGITVSEVRGFGRQKGHTELYRGAEYRVDFLPKLKVELAVDDSILEQAVEAIQKGAKTSKIGDGKIFVYDLESAVRIRTGESGPSAL

SEQ ID NO: 16564 - protein, 685 aa, Magnetococcus sp. MC-1
MDRASTSTRSFRAPNRVVLSGGLTLLLSLLLTGLLAVQENGRYQNQLRVTVLEQLSQLRGLLENEINLSFHLTMGLLAYVAIEPNISQQNFQLMAREIIAQSRNIRNLGLAPDNVLSYIYPLSGNERALGLDYRKNAKQWPAVQLAISERRTVVAGPVKLVQGGEAFISRTPIYRTGMDGKKGAYWGLASTVIDKDKLFTTAGIYEVSKQIKLAIRGRDGLGAQGDLISGEGELFNERAVLQNVQLPDGRWQLAAEPLNGWDQDSPYVPVIWGAGIGGGMLAGGLVYLWLIGVARHQHILQQALQDAQAADRVKSEFYATMSHEIRTPMNVVLGMSDILLETVQEPEQRQQLARLQQAGSALLELINNILDISRIEEKRLTLHMAPMDLRSLVEDLLGFFQLPYHEKGIALVSEWEQGLATHILGDSGRLRQVLTNLLGNALKFTERGQVVVVVRRDPEDATYLRIEVRDSGIGLHADQLLHIFDKFTQAESGLTRRYGGSGLGLAICKQLVVLMGGRIWVESEDGVGSCFIFTLPYQEVTELERRQMQDEAAEWSVDVPRKVLLVEDSVDNQQLIVAYLKASPYQVSIAQNGAEGVAMAKQDAYDLILMDMQMPVLDGYAATRSIRQWERQQGREPVPIVALTAHALEGDLEKSIEAGCSLHLTKPIRKAQLLNQLRGFFKEAP

SEQ ID NO: 16565 - protein, 1059 aa, Magnetococcus sp. MC-1
MKLSHKFILTLLPPILLALFGLGWWHHHTTMAEVTKANERYLQTLLDGFMENALQRRFVILQENNLNDIASFVQTYRREIYADAERIAQKHEVQLIIYDTRGNVQYATSKPITKQPPIELKQLLLPDSTGRLTALPPSGDEATGALYLQQGFSPWRWQILLLASDAQLTAAVRNIRHTTLLVAALLTAAFILLVYGLLRHLVLQPVALLRQASKCIAHHEPLPKLPLTEGDEISHLAIAIAAMSRSIGEYHRHLQTQRNRFETLLAANPDLISLKNRVGIYQVVNPAFCHFLGLPKEAILGQDDARLFTPHQAARIRQADQWVLSSGAPSAQEEEAVGPDNLPLWLHVIRTPITQATGEVSGILTTVRNISARRMAEEALRTAHEGLEQEVAQRTQALRESETRLRIVTENLPAVVWMSDPLLTSMHFVSPAYEQIWGKSRESLLQDPQSLWTSIHPSDRSFVLKRILNSNGQPWEAEYRILHPDGTTRWIREQGAAFRDTHKQILFLIGCAFDVTPLKETERALSTAKQEAESANHAKSAFLATMSHEIRTPLNGITGMIELLQRSALSVEQRQQVETISKCSVVLMDILNDILDLSKIEAGQLVLERAPFSPTQLLLNLLEVMQPQARNKELDLQLNMDEKLPSTMLGDATRLRQVALNLIGNAIKFTPRGWVKISLLVHERIDDIVWVELAVQDQGIGIADEKLVHLFNPFTQADSSITRNYGGTGLGLAISKRLVEAMAGAISVTSIEGKGTHFRVTLPMQVAHTPLPADAFAPQETLALRPLQMLLVEDETVNQQVVCALLEDEGHHVDVANHGEEAVLMCQQRAYQVILMDLRMPKMDGLSATEQIRQQGMNQQTPIIALTADVLKSTLDRCLEVGMQQVLTKPIRLVQLNHALAHIGLPMAPPRPPAQALSEPAPEATESALPTESEEDTCLNLTRLRYLVSNMDQDHLLNIIQAFKTTSENCLSGMQQALENGDEGALRHTAHKLAGSAATLGLQRVMEMAKIMEEHSSQPSVQHNQLSLLRYQVELGFSAIAKETGLSLQMQETEHVASL

SEQ ID NO: 16566 - protein, 803 aa, Magnetococcus sp. MC-1
MGASRFVQAINPTGAIPRQPSMRATHPKPKILIVDDKPANLMALRRLLKNTHAELIEAESGNEALGLMLEHELALMLLDVDMPGMDGFEVSRMASGLDRTSNVPIILITAAYKDYSHRIKGYQAGAIDYIEKPIDDRILNAKVAIFLNLYNAHRESEQLRQDLTLNQERLELALEGANEGLWDWNILSNQVYYSPRWITMLGYATNEVNQDFSTWKTLIHPDDFESALACLERHFTTPEEPYRAEFRMRTKQGGWCWILARGKVVARTADGQPHRMVGAHQDISQRKQLEADLLAAKTEAEQANQAKSRFLANMSHEIRTPMNTILGMGEILLNAPNLTPKQHRYLSISQRAGDTLLGLINDILDLSKIEAGELHLEHTLFALHDELKSLITMLRPMARDKGLSMQCVIDPQLPTHVHGDPQRFRQIVLNLLSNALKFTDQGSITLHAKPIETGRLQFTVSDTGIGMPEQVITKIFRPFVQAEANTTRRFGGTGLGLSICRQLVTMMHGEIYANSQVGEGSQFIFEIELPAANSETVKQERLSPPTKQNIPMRLLLVDDMEDNRLLVKAFLEGTPHQIVEAEDGLDALEKSQQSQFDLILMDGMMPKMDGLEATRRIRARESEHNLTPVTIVALTANAMPQDVADSLAAGSDYHMAKPIRRAKLLQLLASIANERRLFSHEEVKQTTTLTSVETIAADILDALANDVGSGYRQSILRFYSTLPARVAQLTAHIGSEADSVLIEAQGLQQDASYFGAHKLAHLCTQIAQMARTKQPREMIASLCPLLQQALQTIERRLTNEGYF

SEQ ID NO: 16567 - protein, 960 aa, Magnetococcus sp. MC-1
MTYDVGLHSLVSGAHPMFSMPRSFRRSIGIRILLGFSLILALIVAQSMVTNLSLDRAIYHFKQYGQTNSHLREILTLERNVLDLHRGVLAYTYSGYEGLAHRVKEMQQTISRQMDEARSRVKDPQRAALLAQMDAHFKLYAENFDTAIEERLLRDKMAFEQLEDGGDQVLLRLNALHSQLLNNQDRQGAERVDHALVQLALVQRNAMRFLIKPNARLVANTNQHLKQLNQELLELSNHNSPLIASTQSQELTELTQSFQRNFNKMVQASRAYLHLIYVVMGGEASQIAYLANRLKQLSEQQQGVVEQQMDIAVHETLQITRGVSLLGIMLGIFLAWRIGRNISQPIHAMTVALTGLARGKQDIEIPGRGRSDEIGAMAMAADVFKVKAHELANASRYKSEFLANMSHELRTPLNSLLILAKMLSNNEEGNLSEDQVESAQVIYESGRDLLHLINDILDLSKVEAGRMDLYVESRPLQALPQMLERTFKPVAQQKSLAFHWSIADDLPKELATDWPKAEQVVRNFLSNAFKFTESGHVTVAIHKPQAHRIFMNSDLTHKNALMISVTDSGIGIAEDKRELIFEAFRQADGTTSRAYGGTGLGLTISRKFAALLGGEIQVESAPGKGSCFTLILPLESPNLEHQAGRGEQMEPENPLSPSEQVEAITHFRSHTTTLLVVDDDRRNVFALKKMLEDRVGLVLSAYNGKQALDVLSQHPEVDLVFMDIMMPEMDGYAAIEAIRRQPHLQHLPILALTARAMPGDRELCLSHGANGYLSKPVESDALFQALITWLAPNPEQAKPDTKPIKSFTNTLSHRQRPDENEPESTEQVAPLGTPPIQILIVDDDMRNTFSLAHSLQKRADKVFIARDGEKAIAELEKHPQINCVLMDIMMPHMDGYEAMRRIRQDQRFAQLPIIALTAKAMEEDRQQCLAAGASDYLCKPVALDKLMDSMRTLIANQQQE

SEQ ID NO: 16568 - protein, 969 aa, Magnetococcus sp. MC-1
MSVHSHDDVGHFDRKLAVSFGAVVLLVMLTVSAVSWYAFDAIMKDQEARLARIIGSVVGEAVGRVSFSGKHHTRLLVKDLIAKNPQFSHIGVINLEDQIIAHSNDQLNDRPMLWPQGMSLQKALTEPNQVYHFSLFGRPTVRELFLPYHSGFNNRLAGIIHIGIRQDATTRALKSGFLSLLSMIALLTMGAMILVHRLSKRYSRPVKRLANQMAALLEHAPMLIAIQKGQQQPHVTSRLWHQFYRTHPLPDQPPLHPLLPTKQEDLTKINSSAQELNVTLDGHEYHFLFTRFILSEELQEHAQPQICTIALDISDHKLVERQLSESENRFHSLVSNLPGAVYRCNLDSAWSMLFISDGIERISGYPKESFIHNLERSFASIIHKDDLIMVEQKVFEGVNLNRSYHMEYRIIHQDGATRWVYEEGRAHFGKHGQALWLDGVIFDITDRKQMEHTLHQNRTRLQAAVVASRAGTFYYTIENDQNSWDARMLEIYGLEASQFDNNYAAWVRCIHPEDQHSTEQAFFRALSASYHTQTYDIEHRIVRPDGSIHHLRTQAWIQRDSQGKAEQVSGLVFDITEQKEVETTLRLAREQAESANRAKSDFLAAMSHEIRTPMNAVIGMGEVLLETKLDQEQRHYIETLQHAGEALLDLINAILDLSKIESGRMELVEQDFDLHKMVVETCQLFQVQCRKQGIELNLNWEESNPTYIHGDQARIRQILFNLIGNAVKFTDEGSVTVEIRSIEQEKTLLFKITDSGIGIPADKQETIFQKFSQADSSLSRRHGGSGLGLTICRHLVEHMKGRIWVDSEEGQGSCFSFTLPCRPTAPKAEIISNPHDAQQKQSKKARILLVEDSKDNQILIRTYLKREPHSLVVAWDGEEALTRFNEDGPFDLIFMDMQMPIMDGYAATAHIRALEQARHLTATPIVALTAHALQGDEQRSLQAGCNAHLTKPIRKAHLLAAIRDHANPS

SEQ ID NO: 16569 - protein, 1128 aa, Magnetococcus sp. MC-1
MDFYAHFFMSPAQRGVAVYEGIYDPLLVTLSVLIAVFAAYTAFQLSSRLRDSENAKVLLAWRAGGALALGMGIWAMHFVGMLAFRLECGVAYDLWITFISILPGFGAAWLALGVLGRATLSWPLLVSRGVVMGAGIGTLHYTGMAALQMDAILRYDPWLFMLSVVVAILLAVVALSVKSFLQYRTALGPGHLSSLIGGVIMGGSISGMHYTAMEAAYFIPQGETGVAVYNSPLPLAISVAVATLTLLLIALGSALASRRIAHSRRWMNSILQNMSQGFVMMDLQGRILEANPALLSWVALSPSQVQGEPFQKLLSVQDHQPLQLALQQLLEGQPVRCALSLCCLDAPPIPVQMHGNTHRDEEGQIMGIYAILTDIRAEQAAAKALRDARDAAEQASQAKGEFLANMSHEIRTPMNAILGMTHLCLQTDLNERQRHFLEKVYAAGSALLRILNDILDFSKIEAGSLEIEKTSLKMDEVLASLADLMSIRADEKKIELLFHRDANLPEILVGDPLRLGQVLINLVGNALKFTEQGEVVVRIEVIQSAERQVKVRFSVKDTGIGLTNEQMSNIFQSFKQADSSTTRRYGGTGLGLAISHRLVQLMGGVLKVESTPGQGSCFSFTLDLGVTQPTSLLSRLQLPSGLQVLVVDDNVLSQHILHDILQGFGCQVQVASSGEEALLLLAQLEGPFDFILMDWQMPGLNGIETAQRIYQKFAKVEMPTIIMVTAHGREEVMQKAREAKLDGFLMKPVNPSMLLEVILQLQRKRHGTGPLLESRSEQKNFRIEVPNLQGKHILLAEDNDLNVEVVQEMLSPSGVTLSCVSNGLRAVEAVQKRSYDLVLMDLQMPVMDGREATKQILGLGLDQPPPIIALTANALSGDRERCMALGMVDHIAKPLVPELFYATIKRHLGDVTTRVVRSVAPAPELPSGAPPGVDLEQAWLGLNRNTLLLNKLLHGVCDQWPEQMRLLEGWLADPQSHHLAINQAHGLRGLASQLRMEKVATLAGRLEQGLKQGEANMEACLAPLQQAVMVVVNWLKENLDTPPPEPPRRDATALDMDKAALKTQVAEIMIHLDQDLAEGLRQLREVLNRMPSGEPEALLREALNHAEGFDVPEAKAALMALQAMLQKG

SEQ ID NO: 16570 - protein, 310 aa, Magnetococcus sp. MC-1
MSGIKTMRDAMIARILDLMATDERLFFLSADMGAPLLDTLRESYPKRFINVGIAEQNLINVAAGLAMEGCCVYTLAIAPFYLRAFEQIRNNLSIAARFNPLNVNMMGIGGGVSYDISGPSHHALEDLATLRSLPDVAVISPADWLAASQLPDFAQTAPYPKYIRLDGKGHEPVTTQPMVWRQGFQTLQQGARAALLTTGFMTQKGQKLVAELGEADIGHIDLFQFTRDLDEQALAQTLRGYGRLVTLHEGYLGRGGLDTLIDTLCRQHGLSMPVTHLGFPLAHQFLFAPREHLHAACGMGIEDVKTALLA

SEQ ID NO: 16571 - protein, 139 aa, Magnetococcus sp. MC-1
FHEIADVMEGRHKPDYSRAVDLLTQAAIKEMVIPSLLPVLAPILVGVLLGPQALGGLLMGTIITGIFVAISMTTGGGAWDNAKKYIEDGHCGGKNSEAHKASVTGDTVGDPYKDTAGPAVNPMIKIANIVALMIVGMIV

SEQ ID NO: 16572 - protein, 1041 aa, Magnetococcus sp. MC-1
MSHPSRQERELAQRFQTLRMDFLAEIPPLCRHLDRLVAEPSEGKRHRRWHCAQWHARLQGVVGSCATFECRGLRDLAQDAGNLLQKLARQDVPPQSSQQMRQELRDLLAALQESAQLKLNEPELVFLPKEYSLFLQEEVLSHTVLAFSHDARLLEQLGRSLASKGYRLVPMPSYRAMRDEVVRSSAAAVLVDLEAMSAGVDEGDIPGLLCQEQPMPMPLLVLGGSDNMDHRLCAVRLGSTAFRARPIAADELARQLIAHHQRHNHAQRARVLIMDDNEPLGRFYQMLLELAEMEVVYIREAEELLPAIQRFKPEVLLLDLYMPDANGLEIAAVVRQSDSNADLPILLMVENNAGRRILDQTKESESFLIKPVQPGLMVRAVIERVRQRRQTVGRVEYMRSALHELEQLQLALNQHAIVSVTDQDGNITFVNQKFCQTSGYTPNELIGNNHRMLKSDQHPASFYQEMWATITQGQTWHGQVKNRRKNGTTYWVSATIVPFLDGDGTPREYISVRTDVTAQKAAQERYRASEQRLRAILDNTHEGVVVMEASGQIEMLNPAAARIFGYTLADMPQPTIQWLLPEFPLTDILNDAHLHEGGGAGDVSHANLYREMAANRSDGSRMLLGVSVSSFHLEESAVCVAVVRDITARKMEEIELKQAKEVAERASAAKTRFLSSMSHELRTPMNAILGFAQVMQSDPNEPLSESQRECTREIIQAGGHLLELINDVLDLAKIEENRISLKMAPVHVQEVIREAVALVTPMANRKGIRLYHGMGEGVCERCDVQADRTRLKQILINLATNGVKYNREGGEVEISCRLAEAGRARIEVRDTGIGIAALKQGDIFEPFHRLVEDGTIEGTGIGLSIVKRLVEAMGGTLGLESQEGQGSRFWFQLPNSGICSPTKPHASLVEPVSVRQVVLYVESNPVDLQLMSVLMRRYEHLRLDAVRDLEVAQAQLQQGEVDLLLINIGGGVERCAPLFAWMQQTPHLKALPVIAISADDEVESGVRNLPGSPRFMQKPLDLEPLIAHIGLLLEKPQAREA

SEQ ID NO: 16573 - protein, 408 aa, Magnetococcus sp. MC-1
MAVDFWQGKKLVVAVSGGIAAYKSLELIRRLRELGCCLLGVVVTPAALQFVTPLSLTALSEAPLYDDLFSLTQEREMGHIRLAREADLLIVAPATADLMARMAQGLGDDLLTTLLLARRGPVLLAPAMNSAMWLHPATQRNVAQLREDGIHMVGPASGSLACGEVGPGRMAEAEAIIEAAQGVLTPQRLAGRRILITAGPTREAVDPVRFISNRSSGRMGFAIAAAAQRMGAQVTLVHGPCGIPPPRGVLPVAVESAEQMLAAVQVAWPQSDAAIMSAAVSDYRPLQVAPQKLKKEAQGGQQIQWSLTENPDILAYAGANKQPGQWLVGFAAETEKLLQHGTEKRRRKGCDLLVVNDVSRQDIGFDATHNEVMVLGPGEDAVESWARCRKDEIAQQLMERLAACMETA

SEQ ID NO: 16574 - protein, 2664 aa, Magnetococcus sp. MC-1
MERLLFWQDSMMRMLLLVLVGLLAWLPSSWAGDEPPIHADIRHRPPEMIVHGGFMGGPLKEVLEQAAAKLQRKVVWRSVPFSESYKDLQSGAVDVVPRTIRTAEREPFVHFLGPIGQQNKAILFLLRKGQERQIRSLADLHGLTVGVKPKTAYFPAFDQDESITKLPTEGGDYGLVTRLIEGTADVVAVLDQAAMESALAGLGFKDYAYAPFRHEQIIENYFGFSKNSPLAAVAPALNHLLQEMAASGQIEAIYARHQANPMPIAEHGSLLTVAEKAWLATHPEPLLVHNEQDYPPFNYVVEGRPSGFSIDFMDLVAAKLGLTIRYVTGPRWSEFLEQMQQGKLDIMLNIVQTEARDHYLNFTRPYVDNPPVFVTRQDQPPVRRFEELVGRRVAVPEGFFYQELMGNRYPEIQQHLTKGMLEALQAVAGGEADAAVGGLAIENWLIQTYGLTNLRVDSLIRDTAFSNQLRMAVHKEQPLLAALLQKGIDAVTQEELGALQRKWFGGAVDPGSERVAVGENLGLVPQERVWLREHPNIRLGVDPARPPFEFMDRNGIHKGMISDYVKEVEQSIGVRMEPVQNLDWEAMLARAKRGEIDVISALSPSPERRKQFLFSRPYMQVPIAVLTRNTVEDLQKMDNLRETRLGVVKGYMTEELVRRNHPQQKIFPYKNLEVALKALSVGEVDALLANQLAAVHRVNELAITNLKVNFVSPYSDDLAFGIRQDWQPLVAIMDKAIAAIPASERERIQRSWGGGSLTQGMEPSQLESIPYGRLGWMVLALVGVLLVVERILDRSGADVQSFYRSRSAKTLGVSLVAVLMVFVVVMAWLFIEHQERQTRQRTGESLSTLLQTTHEALSIWVRGNRNFLQAMARDLEIRHYTQALVASDLADLSRNPAQQEMAAHFQRVILAREAQSFALLDATGTIRFSTNSHDLGKQHALASLRADALAKVFAGEGVFIAPLLEPVEGEARPSLFMMEPVKNATGQTLAALAQRLDPTQEWTRIANVGRLNKTGETYLFNQAGILASESRFLYQLKQLKLVGEQENSILNLRLGDPGGDLFKGYTPHKTRDQYPLTRMAQAAIKGQSGQDIEGYRDYRGVPVLGVWLWDSELGLGMVSEVDVQDALTSYYANRNALLWVLAVTLLLSLALTVFSALLGERANRQLLKSKDELEDMVQSRTMALNRASEGLNLALSSMSNGLIMLDQALTILIVNGHYLSLLQLPETLVGVGKPIEPVVRYLVVRGDYGAVDEESMVRQQLQSMRQQQSGNIELNTPDRRSIDVHQAPTETGGMVFTLTDVTERKRSEERLNLALEGGSLGYWDVNLITDEMVVNQRWAEMLGYGLDEISPVLRQTWLETIHPEDRELVLARGNDYRAGVLDRYEVEYRARAKDGTARWLVSRGAIMEHQEDGQPRRMVGTVQDITERKLMEAALSESEERSRLILTSVTDGIFGMDAQGCTTFVNPAAAAMLGYREDELTGMLMHDTVHHSHPDGSPYAHEQCPMRAAFAEGAVRVITDEVLWHKDGHAFPVEYTAVPMQKRGKRVGAVVVFRDITQRKADEKRLAESEQRLVLALQGANLGLWDWQAETGSLITNDIWSAMIGYTKEALDARYGNTFERWLALVHADDLPETQQRLEAHLRGETEEFRAEYRMLTESGEWKWILDIGRGVEWDEQGVAKRLVGIHQDIDALKRSAEQLRLANFLSDQALDLSQAGYWHVPLTAEDGYYNSSERAAAVFGDPPRPDWRYHVMDEWFANVEAGDKLASAATLANFTAAINGTVPRYDSIYAYKRPLDGKVVWIHAMGHVERDEQGKATDMYGITMDITASKLAADAIQQAKEIADAANQAKSDFLANMSHEIRTPMNAIIGMSHLALQTDLNGRQRNYITKVKRSAEALLGIINDILDFSKIEAGKLTMEFIDFRLEDVLDNLSNLVGLKAEEKGLELHFSLPPGLHTALKGDPLRLGQVLINLGNNAVKFTAHGDVVVKVQQLERTTERIKLYFSVKDSGIGMTPEQKGLLFKSFSQADASTTRKFGGTGLGLAISKRLVEMMEGEIDVDSVPEQGSDFHFSAWFGLGEVRGEETLRVERDLANLHLLVVDDNSTAREILAEMAQSFGFRVDTAESGAAALAKVEAAAALNDPVQVVLMDWKMPDMDGLQTARAMQHNDDLQELPMVIMVTAYGREEAVQAATGVELKGFLTKPVSPSTLLDAVMGALGREGVSGRRAHERQVEESEAIILLRGAKVLLVEDNEINQELALELLANAGILAKLAENGVEALQALQREPFDGVLMDVQMPIMDGYTATREIRKQAAFKDLPVIAMTANVMAADLEKAKAAGMQAHVSKPIDVREMFTTMAQWIKPSGLVVEPVLAVTTAEPVDVGEGDAFPTSLPGIHLQEGLARSGGDVSLYRRLLGKFRENQAAALVRMQGHLQQGEREDAVRQIHTLKGVSGTLGARDLFEAAKALEANLKAHDTPVDEALLATTEQALQQVLGGLAFTAQVSSPADGVQAEPLAQRLSALRRLLEEDDVASARLVEPLLPMLAGSPLAPLAKQLSEAVSGYDFEAALLALQALEAAVAGADEGAQIDLPQVREAARALLHLLEEDDTAAGEAAEALSQMLQSVSSLGEDAHQAGQLAERYAFEEAATVVRALLAKLEQLG

SEQ ID NO: 16575 - protein, 957 aa, Magnetococcus sp. MC-1
MAHINVHTNLRNSRPLILFAGALLLLLLTQLWVITGKYQQDMREDLHGSIKAQLALLGATLQEAAIRGDLAQIKRNLEMWGQAHSEILAIRAISPNGFELVHYQAGALQGDMYVHKSAITVDGRQLITLEVTHNLSMINDRLRTMTLYMGVVSSLISGLFALTVWWIMTRFAIAPLNQELAARQRAENMIRESQQALVKAQLVAHMGSWSSDVAIEHMEWSQGLCQLLGVKVDEAPLPVERLLGLVPQPQQQSVLEMLDRLSQQQQNQVQMEHRIHRETGGVLQVLHRCERVEGANGPRVQGILIDTSQSEALRGALAASEEKFRNLFDNMGSGVAIYEAIDNGDDFIIRGFNKASTVFTKLDRESILGKRVTEIFPGIRAMGLLDLFKRVWHSGVPEHLPLTQYSDQRITQWVENYVYRLENGEVVAVFDDVTSNRQAQQELAQSELRFREMAETLEDVFWITSAHGHRILYVNPAFEKVWGYSVQALEQDINLWSQSIHPEDRARVEEALLQSTSHADGFDQEYRIVRGDDGQLRWIHNRGYPIEEQGQVVRVVGLATDITAKKENEAALQQAMRQAQQASQAKSEFLAAMSHEIRTPMNTVIGMTELLLETPLSEEQQRYVRSLRSSGTALLDVINAILDLTRIESGRLELTEERYDLHELMRETCEVMGYAAAKKKLEMVLEMNPNTPNYLVGDAPRLRQILINLVGNAIKFTEVGQVCVRVWLDEAVERLRIEVEDSGIGIPKEHINTIFDMFAQADSSMARRFGGSGLGLTISQRLAQLMGGRLAVQSQVQKGSCFTLSMPCQIGEEPAQEVVTETQSLTRQTLRILLAEDSVDNQNLIQAYLSRTSHELIYAINGEEAERYVKSGQPVDLILMDIQMPLVDGYTATRRIRAWEQQQGRPAVPIVALTAHALKEDEMRSLEAGCDAHLTKPIGKKQLLQVLAHYPRRESTP

SEQ ID NO: 16576 - protein, 874 aa, Magnetococcus sp. MC-1
MMSFRLKTVLGIALIQAFVLLTLVSSALDDLRQSHQNNLLAHAKTLTTLMDTATKAPILEKNHSALQAIAHEIVQKNAITYLSIYDNQQQILYQFGPAPTPHIKPDINLRDIDDATFDLRHPMLHEQSVYATLALGLPVTPIIKALHAAQNQQLRLALLAMSASILVSWLLGSYLTRQLVHLREAATAIGHGHFNHRIPVQGQDELALTATAFNRMSGELDKTYQRLKKSLYTSNRMAKLEATIMHTVMDGLITMDSSGKVLSFNHAAEGIFGYAAAEVVGEQITMLMPEPYRSQHDDYVQRYLQGAAPRVIGSAGRHVTAQRKDGALLPIRLSVNEMVFEGERLFVGLVADVSERLQEERALIEAKEQAEAANMAKSRFLAVMSHEVRTPMNGILGMLGLLNDRRLDGQQQEWLATAQESAESMLTLLNDILDFSKIEAGHLELEQSAFSPEQILKGVHDLFLPRATAKGITLELEQGANLPAWVQGDPGRLRQVLMNLVSNGIKFTHQGGVTMRVAQQAKREDSLLLQFEVQDSGIGIPPQQLTQLFQPFNQLDPSYSRKYGGSGLGLAICRHLVDLMGGEIRLESPPSGGSRFTFTARFGYAHAPQDEVLDNSEQEVQLHGVRVLLAEDSPTNQMVAVAMLARVGCHVDVAVNGLEVLEALTRAPYDLILMDLAMPEMDGWQAIARIRGMNAPLRDIPIIALTANAYPEVRAQCLAAGAQDFITKPIQRNILLNGILALVTQAQQTGQQGVGAKRCHSNAPIRDEKVLERLAEDTHCSLLPRILEVFIDEADARLQAISTALDNEAWQTVALEVHPLKSSAATFGAARLAACAMQLDAACKAQQWTQMHDLCNCLIEVYRETRGLYKGQQV

SEQ ID NO: 16577 - protein, 927 aa, Magnetococcus sp. MC-1
MSLIEPKILIVDDRPANSMALRVSLSKLDVQIIEAPSGNDALGLMVEHDFALMLLDVNMPGMDGYEVAKIARSWEQTKDIPIIFMTAIHHDDAHRATGYQLGAADYIDKPVDTTILLSKVKVFVDLYRSRQKLLEANRQLRESISLRRGVEEQLRMTQFAIDRLGDMVFLISPQGKIVYVNEKACQKLQYEKEQLLQLSIEQIGCGHIETSWKEHWLKLKSYQTLTFQSHLRTKNSIQFPVEIQSNYVKTSSHEYNYAFIRDITDRVHQEERLRLLSRAVEYGPASIVITDAEGHIQYVNPKFEKITGYGAEEVIGNKPSLLKSGQTEPAIYDALWDSISRGHEWRGELINKRKDGSLYWEMAHISPVLSKTSGKITHFVGIKEDITSLKETEAHLELTQKKAEAASLAKSEFLATMSHEIRTPMNAILGMTELLGETQLSIEQRGFLSVCRSAGENLLQIINDILDISKVESGGLELQHVPFNLRRIVYDAGEVIRFRSHEKGLHQLIFIDESVPEWLLGDPARIRQILINFLGNAIKFTEAGTIATVVSTTAGKGSQVEIVFRVIDTGIGIPESKQSVVFDAFKQLDSSTQRRYGGTGLGLTISKKLADLMGGQLGLKSQEGHGSTFTLSLRLSRSTGPSKSSAQPAPIFAGMHILIWHTHPIKRMNIEETLIRYGATLHHCSEVDPFLRCAQANHAATPIDLLFIHFDHADVDVLSEIKRLRAVSPWEKIPVLIYGRCHDRSLPAKMLQQGVNFLPEPVFPDVLLDELCRITQKSQQPEVDSKPSRASLRVLLVDDSEDNLLLASTFLKSTPHIVQTATNGKQAVERFTQTSPRFDLILMDIQMPEMDGFQATAAIRAWEKAHKKPPCPIIALTAFAMSDDESKCLSAGFTGYVSKPISKARLLEAMEACTAAKAPTQAEGQVD

SEQ ID NO: 16578 - protein, 776 aa, Magnetococcus sp. MC-1
MGDCSMLPPSVKKHLLGYTIARRLRRSIALLVLLVLVMSLLALLALYKFQWGFQQTWQHDQVQLLIAADLNRQSERVGHIADTLLLAADRQSLEVQNELLENQLTLFQQLTLTLRTAGRQAGLVHRVEQVYQSLGDSVRQLYRLQGRILALQNAKSHKIQQIMQHYTQLQSTLLDQPSLGHYPQSQDRVLIGHLLWAGEARHEVLFEKRKAQVDHALANLREKLEHYPQQREQWQPMLETLNSMVQNYLAQIPQWLLADRQRQGVMVENRRYITQFAETTQALYDAYRQQVNNQARQQQSMMRWSIIIVVTLTLISLIILYLLVRYLLRDVLGRFAALHDTMSSHAQGKSVPIVATGEDEISRMARAFALFVYKRAEAEQALSQAVEQAQRADRAKGIFLATMSHEIRTPLHGIIGTSRQLNRMPLDRQVAHKAQVIEQASQALLGILNDVLDFSKIDTEQLVLEEVVFDLPRMLQELYAVVHSQAEEKGLQLHLQLQEPLPRACRGDQTRLRQILNNLLSNAIKFTQQGEVTLQVALTGETDPAPWVAFAVADTGIGIDEAHLERLFEPFKQMDESINRRFGGTGLGLAISAKLAEAMGGSIRAKRRTEGGSLFTLMIPLRQVPIEQLPKPAQSHMEAADAMPGLKILLAEDDPINQEVAIGILQEDGHQVHCANNGQQAYEMAQQQAYDLILMDLRMPIMDGLQATTKIRAAHTGLNHATPIFALTADVLKDSLQACRTAGMDEVLTKPIHLQHLRYMLERVQPQHLSPPQERP

SEQ ID NO: 16579 - protein, 488 aa, Magnetococcus sp. MC-1
MLRIAKMALTFDDVLLVPDHSNVLPHEVDISTRLTRNIRLNMPLLSAAMDTVTEAGTAIAMAQEGGIGIVHKNLSIKEQADAVRQVKRHISGTVINPWTLGPDEPLKAALELMARRKVSGIPIVEADGRVAGIITNRDVRFATDDSLPIRDLMTQGEKLVTVPQGVDMGTVKHLFHLHRIEKLLMVDDQYKLTGLITVKDIEQNHAHPMACKDGSGRLIAGAAVGVGKDNKKRLAALVEAGVDVVVVDTAHGHSQGVIEMVAWTKEKYPELDVIAGNVATPQAVKALVEAGADGIKVGIGPGSICTTRVVAGVGVPQITAISDCAEEADKANVPIIADGGVKFSGEVAKAIAAGASCVMLGSMFAGTDESPGEVFIYQGRSYKTYRGMGSIGAMAKGSKDRYFQADVSDAEKLVPEGVEGRVPYKGPLKHIIYQMVGGLRAAMGYTGCEDIETLRAKAQFVQITSAGLKESHVHDVTITKETPNYRME

SEQ ID NO: 16580 - protein, 434 aa, Magnetococcus sp. MC-1
MCHDTRDFSPRWGVMMDYFHYQDDQLFCEEVALEQIAQAVGTPFYCYSERTLLHHLQVFQQAFASQDSLICYSVKANSNLAVLDALAKQGAGFDIVSGGELERVRRVGCPGERVVFSGVGKSRAEIQAALAYGVRMFNVESIPELQRIQEVALAMDVAAPVTLRINPDVDPKTHPYISTGLKRNKFGIPFGEAVAVYQQAAQMSHVQVVGLDCHIGSQLTQLSPFVDALKRVMVLIQALKGHGIEIKNLDLGGGLGIPYEDGDTPPSPAELAAALLEQLDGMPVTVILEPGRAIVGNAGVLVTRVEYVKKGEQRHFVITDAGMNDLLRPAIYNAYHGVIPLQRKFDREEQVVDVVGPICETGDFFARDRYLSEVYQGELLAVRSAGAYGFVMSSNYNTRPRVAEVLVRGDRYAVVRKRESVAQLLENESLFEDA

SEQ ID NO: 16581 - protein, 922 aa, Magnetococcus sp. MC-1
MHTIIRFMLLPMLMLVGLECHAALPYAHGTAPPEGVENQGVSTYQAPEATKAVQRNLDPRALLAPPQREAVFSPDGNRLAETAQGGGIQVRTVGLEDQAVRLTGHRNGVTAMAFSPASQRLLTAGGDLLVKLWDLDNSQLIYTLAGHAAPVRDAAFSSDGRFILTASDDGTVRLWDTESGRMLGGHQRRTRLLTFTPDRRYALSVDTDEPRLMRRWEVVTGKTVGYYQGHNKAITRMAYAPGGLRMATADAGGGIILWEAQNQTPISILEGHTAPISELVFSQDGTMLLSADRVQSWILWDARTGQPLQSVQAPPGNILAATLHGGPPAKPLFLGERGMLRVWDSLGGGGAYSLLNPPTHDPMLPNQGVSLGMPPGTAGPHVPGTWMHQNAAIAAPSVGGEAPAFSGSGHGYGAPAPGMPGGPALNGAGAVTTPASPPVEVQPGTALPGMHSAPPQDSGQNRGGATMAPPMAQPAQSFSMPSGMLPNQGSTPHGLMPAAPPAVQGKRADQSSVYRPVALDATPVMQGQVIPGPGHPTGGAGGRGVAIPERNKALGQVLTAPPIPGAVLAARPQVTPKHKTAIAIPAPEPVVTKKAETLPKKAPVWVKPARPPAAPVNLVATVNPETVPTQDTNSVVDADTGITFVEVPGGCFSMGGNDKNMTPAERPAHEVCLTPFWMSRFEVTQGQWAAVMKKNPSFFKLGPNYPVEQVSWEDAQSFVQKINRKVGQPYYQLPTEAQWEYACRSGGKDEEYCGGDDLSAVGWHQGNGGLSTHAVGLRRPNGLGLFDMSGNVLEWTLDGFQENYYTKSPRNNPSGPKVANHRAARGGSWRTPPLDEARATMRHDLSPKLRHASLGFRVIRTTPPRPAHTVVRRTDERRAAAITVEQLNIAQAQQPNMINGIPRFVTPQAGSMDPPPVILPTP

SEQ ID NO: 16582 - protein, 745 aa, Magnetococcus sp. MC-1
MDYGSVTFRHLFLIISIIIALLDAAFVWLNYTADKRVLWQNLSRRANNHRDVFNHTLISTAGHMQQISTLLANTPEVRSRFLQGRLAVDREGGGAGGVQAARIRKELYNFLKPGWQAVQNSYEIRQLHFHLAPGDISFLRVHKPDKFGDDLSAIRHTIVHSNRFREPTQGFESGRVYAGIRGVVPVIMAAGEDKPEMLVGSVESGTSFVELLQNLKGQMGADYAVLLTTEYARNTLWPKVYQKMVTEGPTNTHYVTEATTSNSLAELFKDDALFSDQEGMCRLQVVPLGGQPVALTCFDLLDFRNMQDPQSKPVGKVVVWSQAGAEMLAFNAKFRDNILFAISTYLAVELLVFILLRMGTGQFRREVLERTVALHKNNRQLALAKREAEEANAAKSRFLATMSHEIRTPMNAIVGMADLLKDTPLDREQARFVATFQRAGDQLMDLLNDILDLSKVQSGQIHIEVVETDIRTLLDDLSAMMVAKARVKQVDLLFNPHPNLPARVGVDPLRLRQVMINLLGNAIKFTANGEVELRAYFTSSSEVPYGLGFEISDTGIGIDETRLKAIFEAFTQADLSVTRQFGGTGLGLTISRHLVALMGGDIQVESTIGQGSRFWFEIPIDEPVQRQPLSILEPRPVLYLNGMSPNHAEVLRHQLLHHCEEIRYSHGEGELGAQLMEAAPGSVVWLESGHDPTGAFRLLESLRGQYGKRGFHWIVAGWESVEKCLEQANFLGSHYIQKPHSMGQV

SEQ ID NO: 16583 - protein, 441 aa, Magnetococcus sp. MC-1
MNVKVNKMQLVPGEDFKVADIGLAAWGRKEIEIAETEMPGLVSLRSEYGAEQPLKGARVAGCLHMTIQTAVLIETLTALGAEVRWSSCNIFSTQDHAAAAIAAAGVPVFAWKGETEEEYVWCVEQTIKGPDGWVPNMILDDGGDLTEILHRPEYVEIMKGVRGISEETTTGVLRLYEMAQKGKLECPAFNVNDSVTKSKFDNLYGCRESLMDGIKRATDVMIAGKIGVVCGYGDVGKGCAQAFRGLGAVVWVTEIDPICALQAAMEGYRVVTMEEAASQADIFVTATGNRDIITRAHMEQMKDQAIVCNIGHFDSEIDIASIRELKWDNIKPQVDHVTMPSGNRIIVLAEGRLVNLGCATGHPSFVMSNSFTNQVMAQIELFNRGEMYENRVYVLPKHLDEKVARLHLAKVGAKLTTLTQVQADYLGISVDGPYKSDHYRY

SEQ ID NO: 16584 - protein, 922 aa, Magnetococcus sp. MC-1
MYMYDLENTLMRQALELNGLGTIILDPQQTIVFWNAWMERGSQMFAAHVLGSKLLDVFPELQGSRLDRAVVSALRTGLPTMLSHRLNPTPFPLETASKNEELGQRMSQMVQIKAIRNEAGERYCVILIHDITNTVSREQMLRNQARELHSAKDEAQQANRAKSDFLANMSHEIRTPMNAIIGMSHLALKTDLNAKQRDYVGKIHDSALLLLGIINDILDFSKIEAGKLSMESVAFYLDDVLSNVANLVSMKVEEKGLEISFQVDRGVPLHLVGDPLRLGQILINLVNNAVKFTEQGNIVVAITAELDCESHVVVQFQVRDSGIGMTKQQIDRLFQAFSQADSSTTRRYGGSGLGLSICKRLVGMMDGDIWVESQPGRGSQFTFTAQLVSQRQDRRRFRLPSMHLVGLRVLVVDDNPVVRQILVESLAIFSFCVEALATVEEVIEALGQAIARGEPYGLVVLAGRFGGKGGVALAGEINRCYPQLTLPKMVLVGASERDDVVAMAGAQLVELFVTKPITQTILFEGVLEVLGYVVQAQQHAGGRDRTREKRVLSGCQILLVEDNEINQQVACELLQGEGVTVVVANSGQQAVDRVLSGERFDAVLMDIQMPGMDGYEATQVIRKQPQFSDLPIIAMTANAMAGDRERCLAAGMNDHIGKPIQPKLLFETLGRYVIKGDGVVEAGNKGILLPPIELTPLDGSVTTPLPPPVLPAAVGRAAMISPRAGAVPERLDGVDMEKGLVHVGGNEALYVKILKEIGERYKDVVVEIQGLFAARHFAQAIQLVHTYKGLTGTIGAMALSQSAAQLEEALKAGAYERLPQLLGDFSQLAERLNVALLPMVGVANVQALPSGAEQAGLEEGLLALGALIRDGDAEALDRVKQLRGMAAGQVYQPLMAQLESELDEYEFERAKVTYHHLLAQLK

SEQ ID NO: 16585 - protein, 1301 aa, Magnetococcus sp. MC-1
MAFAQSDLKPEARPFSLDMCQKGWLCSALLMSLWSLLVLSSLLWNLSVQTAHQQQQLLERNRHTFQLIQFTRQWNAQHGGVYARVTAETQPNPFLKNLPQRDLTSTDGVALTLINPAYMTRQIAELARHSGMLFHITSLKPLRPANRPDNWEAEALKRFETNPSERLERLGHGDSALYRYMAPLYVEQSCLKCHATQGYQLGDIRGGISITVSAKPLDAAQVDVTQKLVASHAGIWLLMSLILGLVWRRHNRYVETIKAHEQQLETRVQDRTDALRQANDRLERDRSQLQQIIDGVSEPLMVIRTDYRIVLMNEAARSYNPELATKQANCYCHLMTHQRNTPCEGHDHPCPLEQVVRTQQPFRTVHRHINRDGLARFVSLQASPLFDQNGALWAIIESSRDITEYMSMQEQLKQESDTSNAIIDALSGLFILLDADGCLVRWNSNLAKMTGLDEQSFAGRSILDFVAPTSRNAFIEAMEKVLTEGLATQESYLQTMGRQQIPFAFQINRIEIEGKLYLSGMGVDISEQLSMRHALQESQDILDQVQKVAQLGGIVWKPASGFMQWSAQVYPMLGLQPGQRSLSLRTLLHGLSRHARKGLLQRLGELRDTRHHVIERELHLLGFDGIKRYLHLRGQHRQSHDQEHPQILITLQDLTPHKIIQHQLQHQLTFQQTLLNTIPIPVFYKDRQLRYQIANEAFSKLLNQPLETLIGRTVYETSPLEMAKIYDIADHNLLDHPDRVQQYQATIQPQSDNPHHVVFYKAVVPGEQGQHAGIVGAILDVTEQTRAQKALEESNRRFETVLGSLESYLFVTNIESNMVLFTNHAARLRFGETVGQPCWKTFHLGCKEGGCQSCIQGGASIPHHGHHWEYHNKESGEWYTIRIRLIPWTDGHYVRLLVANDITVLKQAQEASRQAMEQAERANRAKSEFLATMSHEIRTPMNVVVGMSDILLESLPNPQAQKHIQLIQKAGTTLLDLINDILDLSKIEAGQLELEHAVFNPILLIEDTIAIFQMQAKLKGLTLTSSMTGHIPHALMGDRARLRQILVNLLGNAIKFTEKGSVEVQAGYANQQFWYAVVDSGVGIGSDSLLRIFDKFTQADSGVARRFGGSGLGLAICKNLMELMGGTIETQSTLGQGSRFYCAIPAPIADHLLPSDVVTKEPITAALPALTILLVDDSEDNRILVRTYLKQSQHKLDEAVDGAQAVKMAIEKRYHLIFMDIQMPIMDGYRATAEIRAHEQQQGLSPTPILALTAHALSADVEKSLAAGCNEHLTKPIRKKDLLRVVNHFAAQLETDENSPV

SEQ ID NO: 16586 - protein, 886 aa, Magnetococcus sp. MC-1
MSTEKFVYVFGNGQAEGDAGMSHLLGGKGANLAEMTRLGIPVPAGFTLCTEVCGLYLQKRRYPELLKEQVNEALLKVQSAMGAGFGSGDDPLLVSVRSGARVSMPGMMDTVLNLGLNDHTVQGLIKRTGDARFAYDSYRRFVQMYADVVLGVDHHHFEAMLNALKQQTGKVQDTDITADEWKSLVAQYKNKVLEVTQKPFPEEPQDQLWGAIGAVFDSWTIPRAITYRRLNEIPESWGTAVTVQAMVFGNMGTDCATGVAFTRDPSTGHNRFFGEYLINAQGEDVVAGIRTPQQITLEGKRLNGSTLPAMEEAMPELYKELYAVQNRLEMHYREMQDIEFTIQRNKLWLLQTRTGKRTAKAALKIAVNMVHEGLINTREAVSRVSPESLNQLLHPTLDPKADKRIIAKGLAASPGAATGRVVFEADEAEQWAATGQMVILVRDDTSPEDIHGMHSAKGIITARGGMTSHAAVVARGMGRPCVSGCAGLSINMENEQFSVGGVTVAKGDWVTIDGSTGEVMLGQVPTVPPELSGDFTAFMEWVDGFTRMKVRANADTPDDARMARSFGAQGIGLCRTEHMFFGAERIIHVRGLILAQTESDRMRAIDKILPLQRSDFAGLFREMKGYPVMIRLLDPPLHEFIPHDEEGQNEVALVFGMPIDKVRERVASLKEFNPMLGHRGCRLGISFPEIYEMQVRAIMEAACQLVKEEGFIITPEIMIPLVGLESELSYLRERVVAVCETVMGENSVRIPYMIGTMIELPRAALIADQLAKSGEFFSFGTNDLTQTTMGISRDDAGPFLQEYVQKNLLPKDPFISIDQDGVGQLVRLAAEKGRSTRPEIKLGVCGEHGGDPESIHFFEKVKLDYVSCSPFRVPIARLAAAQAVLA

SEQ ID NO: 16587 - protein, 742 aa, Magnetococcus sp. MC-1
MGLCCTERSDGKFAPAATTLTGRPRFMNTYANPLYLILISPHGLIRGENLELGRDADTGGQTKYVVELARALAQRPEVGRVDLLTRRVVDAQLSSDYAEPVERLSDKARIVRIECGGLAYLPKEQLWDSLDNYADNALAYIHEQPHMPHLIHTHYADAGYVGAHLCSMLEIPLIHTGHSLGRSKRKRLLAGGLARQEIEAIYNISRRIDAEERTLAAASSVVVSTHQEIQGQYVLYDYYQPDQMQVIPPGTDLNKFYAPQGDEAQSDIAKQLARFLTHPDKPIILALSRPDPRKNITTLVEAYGQSPQLQEMANLVIIAGNRDDIRDMDAGAQEVLTSLLMTMDLYDLYGKMAMPKHHQADDVPQLYRLAALSKGVFVNPALIEPFGLTLIEAAACGLPLVATEDGGPIDIVSNCKNGLLIDPLDGEAIAQALMDILSDQGQWQRFAQAGQQGVRAHYSWQAHVEKYLAMIQPLVEGSRPLQRMCLSRRPAHYREAAIITDLDQNLLGDDTSLSAFVALMRQYRKQVSFGIATGRNLESALSVMRKHKIPQPDVIMANLGTEVYYAPDLLLDSAWKKHINHLWFRHEIVEILSQVPGLSMQPKGSQSPFKISYYMDPNVAPDLQEINRILHQQEQTVNVIFSRGQFLDILPHRASKGYALRWVSAQLDIPLENMLVAGGSGADEDMMRGNTQAVVVGNRHDEELSTLAEVDKIYFAQQSYAAGIIEAIDHYDFFGTGKGAAS

SEQ ID NO: 16588 - protein, 277 aa, Magnetococcus sp. MC-1
MRRLLLCTDMDRTLIPNGKEPEQPGVRALFGRFVAQPGIALAYVTGRHQALVEEAIQRYQLPQPDFVVADVGATLYHVQQGVWRPNQAWQAQLDAVWQGMHAGQIHQLLEDWPGLRLQEPEKQARHKLSYYCGLEEDAPRLIEAIEQHLGAHHIQANLIWSEDVLQQVGLLDILPASASKRHGVMFLLQQLGYGLHETLFAGDSGNDLDVLLSPIPAVLVANADLSVVAAVEGVGAEQLYRAKGSHLQMNGNYAAGILEGVVHFYPEFKALIQALRE

SEQ ID NO: 16589 - protein, 894 aa, Magnetococcus sp. MC-1
MDQETPSLRSMMRRTSLTFKTLLATLLVGVATWGVLDHWQTGHLKALFHDELLHQVWERALDSRVDFERKVLGYQDALSLLAGQQRMDAYLQTPQSRWVGRTTPRIHNATPEWLPEQSLINSLLPVPYLMMTNAKGHALEIYHRITTAPPPKGLLTLDTLNRSLSEEPVMMVEIDTIPYLLFTEPVESAQANRLLVAATPLDDTFMTSHMGASQPSNGIIALATGSPEHIIASNAPQTLLPGTLLKALEREYIIAGKTYINLEGRGTSRTMIEMVSLISSELAEERSQDILITERQQRAITAFVLILASILIMLWVTRTIRRVSLRISEFSQDKLGAPLTQEGSHDELDTLASRFERLMQEVVRTRDNLRGEIEERKRIEAEVTKLSQAVEQSPTALLITDTEGSVLYVNPEFVSLTGYRPDEVIGRNPRMLKSGETARETYRDLWGTLNQGRAWQGVFRNRKKNGKRYWEKNTISPIRDSDGKVINFMSIKEDISARIALEKEIEHARTAAETANQVKSEFLTHMTHEFRTPLNIIKGCVKLIRDENNLSDKQGRQLENILDGATHLATMIQDLVDLSRVESEQFHLHEEPCDLSHLLTELHDEMELKSQEKQLTFAVEVSPTLPPEIMLDAARLRHALTNLLTNAIKFTHEGQVSLNCWYEGETKARTGTLHFVISDTGVGIPSEQIHAIFEPFNQGDMPAMTRGGVGLGLTITKRLVEVMDGTIEVRSEPDHGSVFHIQLPCRKVWRPQEALANSATTTVFDQALLVSHNPVARMILKRILEELGLNTVELDGCQASCGFLENAQAARFGVIIMDCAHQPDGGLSEVRRIRRAETVNATTPIVLLGEPSEDDEVNAKHRATPLPPRVVVLPKPLQRDQVVSAVRNFLNITP

SEQ ID NO: 16590 - protein, 667 aa, Magnetococcus sp. MC-1
MMELCPKILIVDDRPENLFALHSILKVLRVEIIQAPSGNDALALANEHDFALIYLDIDMPGMDGYEVARHLKSYDKTMNIPILFLTSAYHDEFHSLIAYHAGGIDYIEKPICHEILLAKAKLFLELYINRKKVERTNIILQSEVLRRQATETAYRECESRHEAKRVFIAKMSHEFRTPMNSMIGMLDMLEGTPLSEEQFEYIDSMRQATDHLTSMVGNLLDITQLEAGIIKIKEKPFSLIALVKNVINIIRPLAFKKKILFIPYISPDIAPWFIGDANRLQQILVNLLGNAIKYTHWGSVALLISAKPVNSRYNVEFKVVDTGDGIDLENQEKIFQAFVRGAYNNAETTEGTGLGLSICKNLVDLMQGTIELKSTPQHGSTFSVSIPLTRYTAPVQTGKEKKLQGVNLSILTDHLVQGMLFEEQLTRHGAHSHLCFNGQSIAACFAEEKDTDLLIVHHDNTSKKKLLQGFEKFKQEVTDCKAKILICGRCYQRDDMEALADRGVSIFPDFHDEDELIDKIQSVLGLHKNRKKPDPLDAKKRVLIVDDSEDNRVLLSHYLRDYACEIIQAVDGHEAIDTYIASRHSLDLVLMDLQMPGLDGLSATQKIRAWEKAHRVAKVPIVIISAHATESHRDASLNAGSDAFLNKPIRKKTLKRIAAQFLLHAEP

SEQ ID NO: 16591 - protein, 1220 aa, Magnetococcus sp. MC-1
MSAMANQRTEQFRTLLQQRILILDGAMGTMIQRLGLEEADYRGSRFADHPAELHGANDLLVLTKPQVIRNIHTAYLEAGADIVETNTFNGNAPSLGDYGLEALVYEVNLEGARVARQACDAVMAQQPGRICFVAGVLGPTNRTCSISPDVNNPGFRNIDFDALVADYANGTRGLLDGGADILLVETVFDTLNCKAALFAVRQVLEQRQLDLPLMISFTITDQSGRTLTGQTVEAFWNSVSHARPDTIGMNCALGADQLRPHLETLAEIAATRISVHPNAGLPNAFGEYDETPAMMADKVVAFAQGGLINIVGGCCGTSPDHIRAIAQRVAGLAPRQIPTLKPACHLSGLEPLTIDADSLFVNVGERTNVAGSARFARLIREGQYETALAVAREQVESGAQIVDVNMDDAMLDAQSAMVTFLNLMAAEPEISRVPVMIDSSEWRVLEAGLKCVQGKCIINSLSLKEGDEPFLKQAHLARRYGAAVIVMAFDEQGQADSYQRRIDICQRAYDLLVHTVGMEPNDIIFDPNIFAVATGIEEHNNYAVEFIQATRWIKQNLPGARISGGVSNVSFSFRGNNPVREAMHAVFLYHAIAAGMDMGIVNAGQLAVYEEIPVDLRERVEDVILNRRSDATDRLLEVADHYRQSGVTEDKADAAWRSEPVQARLRHAMIKGITEFIDADVEEARSLAAHPLEVVEGPLMAGMNAVGDLFGEGKMFLPQVVKSARVMKQAVAYLVPHIEEANRQGGIENRASGAGKILLATVKGDVHDIGKNIVKVVLQCNNFEVEDLGVMVAVETILDRAQESGAQIIGLSGLITPSLQQMTHVAKEMQRRGMQHIPLLIGGATTSKAHTAVKIAPVTEGCVVQVKDASRSVGVAAALLSARERDDFMAACVAEHEKYRAIHEQRSTRKPLLSMQEARARAFATPAAVTQAAQPGVHVLADYDLATLVPYIDWTPFFRTWELHGRYPEILSDSKVGQAATRLFEDAQQMLQEIIAQGSLKANGVLGLFNASRVGDDIELADGLGTIHTLRQQRDGGEAPCYALADFVGQGDTIGMFAVTAGIGVAELVAHHQAAHDDYRAIMVEALADRLAEAFAEHIHERARREFWGYAGDEALSKGDLIAERYVGIRPAPGYPACPDHTEKALLFKCLNAQEHAGMALTESFAMTPAASVSGYLFAHPQARYFSVGRIGGDQLEAYAKRKGMSVEEMAKWLAPNLDS

SEQ ID NO: 16592 - protein, 693 aa, Magnetococcus sp. MC-1
MDRYRPARFAPSQQAFISKESVLHHAQAATDQPALVLPLFEDRQVIALLGVLGASTPYDNRDIQHLHYFAQGLWRVLQRRRDQEMVKQATAEAQRANAVKGRFLANMSHEIRTPMNAIMGFTELSLTQHPPAPHDRHLQAIRTASQTLLALLNDVLDFSKIDAEQLALEQIPFSPTEQLQQIAQMLAPQAQAKGLHFHTFQQGSMPTLLLGDALRLRQVLINLVSNAIKFTHQGKVVLGMYGNEPTPEGRCLLRFEVIDSGIGIEASQQERLFQPFVQGDLSTTRTYGGSGLGLAISKRLVHLMGGEMQLESTLGAGSKFSCLLPFSLCKDDLAKSLTPSAQTLSIPHWPDVTLLVAEDNRLNREMLQELLARAQIGCLHAVNGTEAVAMLERDNFPLHGVLMDMQMPQMDGLTATQLIRLHHPKGTLPIIAMTANGTAADRQRCLEAGMDDCLIKPIDMQTLYSTLRLWLPEPQGEEDPYQQPLLASQQRWQQWQPDPQLIDKQDLFLRLGGDFDRLMNRLGYFATECERYFTPLTHAYTERDTTTVLSAAHAMKGIAKNLSLLQLADYLERLEAMVQQHGCDAPGLSSLWQHLLTCQQATCLAMPAQLPPATTPPSPQLEADMTQFMALLNDNDLQAKALLQQLFPLLQQRGQGQLAADLENALAQFDFAQARALLQNPNPSYNPLKPAVP

SEQ ID NO: 16593 - protein, 415 aa, Magnetococcus sp. MC-1
MSGADIKKKLVFKQKSKQPEQVSDQPPWVLGVVDDEPHLHEVTAHVLRNFSFQGRRVELVQGYSGAEAKQLVCNHPDMAVLLLDVVMESDHAGLDVVEYVRDVLGNQSLRIVLRTGQAWLFPEDEVFEKYDINDYLDKAELSAHRMKVALKAAFRSFETMRDLERSQQREQVLRQIAEQASQAKSDFVASLGHELRSPTQSIMGFNRYVMDAVSQSNIEPDVKAEIAKFIRYAQISSERLAGLINNLLDLSKLESGRMEFAIEPHNIWDAVRFLQMEMEPLLQEKGVTLEHPQCTEPLELLFDMGKIIQVLVNLLSNAIKFTPAGGVIRITAHALDTGRVKIAVSDSGRGIPEEEIEHIFGRYQQSTSNQQSDGGTGLGLAIAREICLNHGDSLVAENNPNGVGACFSFTLAVVG

SEQ ID NO: 16594 - protein, 893 aa, Magnetococcus sp. MC-1
MSVFHHNQPRKVDRPIGRRLTLVMIGVSSLITLLATGFQLYDDYQGGINRIQSSLEMVQQSRLKALSHAVWVEDNEQIRLHLEGIMQLPDLDQAAIFVEGTMQWYRGIVSSAHYITRHFPLNYPYGDTIQELGSLRVVASVDRVRARLIHSIPFMLASNALKITAVALLLLLLFHLWVIRYLGQLAHYASSVDLEQPPPDSIVLRAPSHHTDELDTITDALLGMHHKIRTVYQDFKSREESLRTLLESTRAVGWRLNLTKKRLEYISPQIYTLLGYPPESWLDLAVWQSRIHPDDRLATLTSMERILAQPREHSMEYRMLAADGRTVWVRDMSSPLSGDKPGTFTHLGGFLLDISAQKDLERRLRTTTERAESASRAKSDFLAVISHEIRTPLNAIIGMGEVLLDDPLTTEQKHYAMVSQQAAHTLLDLINDVLDLSKIEAGEFQLEHAPYDLVGLIHSVVEVNTITANQQGLPIECNLPDTLPTLMHGDLRRVRQVLFNLLGNAIKFTEQGLIRVETERLETPVASWIRISVKDTGIGIAQEKQSLIFDAFTQSDGSITRRYGGSGLGLTISKRLVEMMGGKIGVDSQLGKGSHFFFTLPVTARWDVLEPLYPPPATLLQQQRILLIHSDVENRDRMQTLLEQAGATVILGGDCRQPTACLAQLDASLDGIVMNCGTLNSAGLNHLEQHLAHYPKLAKRTVILTNKVRGSLLDRTTPLGIHYLNTPVQAEQIYPLLKGISDTSSLYQTPFVGHTEGATPLLTQANVLVVEDSEDNRLLIRTYLKKSPYILDFASNGLEAIEKWQQNHYDLVLMDIQMPLMDGLTATRHIRKQERREQRPHTPIVALTAHAMASDHQNAMAAGCDDFLTKPIKRDTLFKALHHHLPALETNQS

SEQ ID NO: 16595 - protein, 764 aa, Magnetococcus sp. MC-1
MLIMLLLTRTLMGSLESNYLLAKQRQANENNIEILLASATEALENRNIIGLKKIFAQALRSQPQLLELTILNDDGKPLFSSTREQAPNTTLTHFRTPIMVQGSFQGILVGAWDLAPDLRAIDTHVNHILLLTSLLFGLITLMVIFMVHRLAIQPVDAIYNRLIKQISPPQSKPETFHAARELRRLHQTVESFSRTAASHLENARTLQESEALLKQRVERRTRELRLAKEAAEQANLAKTEFLATMSHEIRTPLNGVLGMSDLLLESDLNSYQRHHVETIHRSGRTLLRVINDILDLSRIQAGRMPLEVTAFKLRACLEDVQALFKDQARRKGLSFSINCQEELPQRLLGDATRLNQILFNLVGNALKFTERGFVRVSVQAEQVREADLLLRIQVEDSGIGISDEYKNRLFEIFSQQDSSISRRYGGSGLGLVITRKLAQIMGGKLGFSSRSGAGSTFWVTARFGRVPDTLPDHPLLPREEQQSNLLNQRFRAHILLAEDNPVNQDVARLNLERLGCRVTLVENGQQAVTVFQENRFDLVLMDCEMPIMDGYTATRTIRDLERQQGRRATPIIAVTAHALASHRNKAIATGMNDFLSKPFSTTKLIKLLATYLPPHTVIAQPDPAPPVVTQETAPSADPAHKTLDHRALDQIRALDPADPQGMLNRMIDLYFEQSAKDFKAIENGLATQNAELIRFHAHKLKSSSAQMGGQQLSLLCRTIEEQCHTFTRVEESMSQASKAQHELCAALHALRQTAPPTPPSEGEI

SEQ ID NO: 16596 - protein, 1202 aa, Magnetococcus sp. MC-1
MSMHRLLLRQLRRSMGLVDESAVDALLQELDALPAEQISPASVKALHGLKTLLQRVEQTYEHNERDLLLRNRSLHLSSEELSDANERLRRETARQEQLLSTLRQTANHLLEADQKPTLGEDEASLEQLSDLMSRLALERSEFRRHLERQKFALDQHAIVSITDTKGVILYANDRFCQISGYTQDEILGQAHNLVNSGYHDSGFFEVMWRTIARGEVWNGEVCNKAKDGRLYWVSATIVPFLDERGKPIQYIAIRTDITRQKALEEKIEDNRRFLQSISDNIGEGVFALDVQGFCTFLNPEAERLLGWTQDELAGRSFHDTVHYQDAEGMPMNEADCPVHDAVDRGVDYRSDEDVFIHRDGGIFPVNISVVPVREDGVVTGAVGVFQNITESKQIQRQLKQSEERLQIALDASNTGFWDWDPLQDRAYFSDQWLSMVGYQQGDILNNSTGWLDLLHGEDLPHVERELEAHLNGQRKNFEVEFRMRHKQGHWVWILSSGRVIERDEEKRALRMAGIHKDISDRKRVEDELKKAMLDAESANRSKSEFLANMSHEIRTPMNGVVGMMELLSNTELTPEQQSHMRTARNSAESLLTIINDILDFSKIEAGKLELEEIAFDLAELVEDVTALLAQRVDSEKLELLHNAPADLPMQVAGDPTRLRQVLVNLVGNAVKFTPEGEVEVRMTVERQDADTVTVLTEVRDTGIGIDEAVRPRLFRMFTQADGSTTRRFGGTGLGLAISKQLVELMGGEVGFSSVMGQGSTFWFRITFPIVAKAQAVAGGVDSLQGLRALVVDDNATNRNLLGRYLSNWGVTHLECASGKQALEKIADAAKFGLSFDLAILDLLMPGMDGLALAERITQMVQDKQIKPLRMVLLTSAHARREELEQAGVVAALSKPIRQAQLRALLGQVMRGERVVGGLVERISQNNMSATFDAAVLLVEDHPINQQVARGMLAGLGCRVEIANDGHEGVRLFARHRYDLVLMDIQMPGMDGYETTDAIRQMERSERWPRTPIVALTANAMEQDRDRCLAADMDDYLSKPISLDRLKAAMSKWLKTIAKSEEPEEVLGGAVGQPESPLGAVATGGEDDSVVDLRTLAALKSSMAVIEGGFLQILQSYLQSTPKALESIEQGMIDGDAARVRGAAHNLKSTSLSLGAITLGKVAQEIETRGKEVKLDNMAPLLARAKACYALVAARLEAEQANL

SEQ ID NO: 16597 - protein, 1118 aa, Magnetococcus sp. MC-1
MDHRNSLLTLYMVMVVAVVAVAAGLLLLLYQDSFAKKQAHLQDLATNQARLIDEVANFNHSYRHDYPTGAVEATISQIRDAHGKSIGFGQTGEFIIAYRKSGHSHVHFIVAHRFTQAVTPSFRENPNHLHPAMARAMAGESGFMEGTDYRGKQVLIAYAPVVKLRMGVVAKMDVQEVLAPFERILKIGLSITLLLIGGGSVAYLWVAKGVAGRMEWQHQRLAMLVEGMPAVIYTEDLRTQLPYYVSPQAVVLLGGQGCQADEPLDVWWNRHVWAEDWETLQHARQMLKKHKRPMQVEYRMVRQDGQLIWVRDVARLVCDEQGLPLLVQGMVMDVSEARHTHEKLIASEVRFRQLYENAPIAYQSLNTEGVIQNVNQAWLKKTGYELSQVLDHSLFEFLVVGQEQEVAKKFEAFLQAGYVQDLHYELRCADGRALKVSINGQVSRDRSGRLVKTHCVLTDITEQDRAAQALQESESRLRLILASTGEGLFGLDLQGNFIFANPACLRMMGYRDDRQLLGKPMLEIVSCCSSQFVRRGKGSCPISQILKTGLPNHAEGELFRRADGSFFSTEFWSHPIQQNGELVGAVVTFIDISQRVLNQTALKASELKYRTIFESVPTPLLILDTSGVVRDVNSAHQSTFGRFAGGSLMGVSIREHPGVAGSLLAESFLALAKGEPMPLQQASYTMEAEGEAIHFNVRGVPFVTRDGEGREDLQGALVIHENITDLKQTELKLRKAVEEADCATHAKGDFLAVMSHEIRTPMNLVVGMAELLLETDVNAEQKHYLEKLQKAGDTLLSLINNILDLTKLDEGQLKLLDEPFAPQALLDEVSGIISLAAEAKGLTLSCEIQEGVPERVLGDSVRIKQVLLNLLSNALKFTQQGFIRLSLTVEGAEGAQQLCYAVSDSGMGIPDYHLDEVFERFSQGDSSMTRRFGGSGLGLAICKKLVILMQGQIQVSSQVDVGAIFQIRLPLRAAALAPASSQQQVKRRLNQGVRVLLAEDAVDNRMLIQAYLRNSPHDLVMVEDGQQALQLIEEGTDFNLILMDVQMPVMDGYSATRAILAELGAQQRPPCPIVALTAHALEGDQARSLQAGCVAHLTKPIKKKILLEAIQTYARLAP

SEQ ID NO: 16598 - protein, 308 aa, Magnetococcus sp. MC-1
MRRRCLDEVFALAQQDARVLFMGSDLGAGTLETMRQACPRQFFMEGIAEQNLIGVAAGLALEGYLPYVNTIATFLTRRALEQIAIDVALHKLPVRLIGNGGGMVYAPLGPTHTTLEDVALMRALPNMTVLAPCDADEMQRLMGQTLAWPGPIYIRLAKGGDAVVSREELPCTIGKAIPLLYGRDVLIISYGIMVQRALTAAHALAQEGIECSVLNMHTLKPLDEAAIVREAQGKRLVVTVEEHSQIGGLGSAVAQLLATRDLLDGGPRLRILAFADAFCSGYGSQNQQIAQAGVDVLDIQRTIKEAFV

SEQ ID NO: 16599 - protein, 622 aa, Magnetococcus sp. MC-1
MTTLLSTIDSPKALRQLNEAKLPQVAQEMRDHIIECVSQSGGHLGASLGVVELTIALHYVFNTPDDRLVWDVGHQSYGHKVLTGRRDQLASIRQRHGLSGFTKRSESPYDPFGTGHSSTSISAAMGMARAAKANGIQRKAVAVIGDGAMGAGMAFEALNHAGHDNHDLDLVVVLNDNEMSISPNVGALSSYLNRMLSGGAYNAFRDGTGKVLKTISRSMWDAAKKAEEHVKGLVMPGTLFEELGFTYFGPINGHDFDALLPTLRNVQKLGGPILLHVITKKGKGFPPAEEHPCTYHGVAPFDKDTGIIQSSSGGTSYTKVFAQELCALAEQNPHIHAITAAMREGTGLNLFEKRFPERFHDVGIAEQHAVTFAAGLATEGILPVVAIYSTFMQRAYDQLIHDVALQDLPVIFALDRAGLVGADGATHAGAYDLSYLRTVPGMTIMAPADENELRHMLHTAVALNKPVALRYPRGTALGLPPEPPHVLEIGRGRTLRKGEHAAILAVGQPVHPALEAAAILEQQGISVSVYDARFVKPLDQRLLQEVAMHGVVLVVEENAVQGGFGSAVLESLSNQGALDRGLKIRCMGIPDRYIPHGTQKELRGEIGLDAVGIATTLKELLG

SEQ ID NO: 16600 - protein, 264 aa, Magnetococcus sp. MC-1
MVGVRFVHSTPGMSNVMPALYKGLGVAAAVSALLFLPVTVWLMAGNPLGISSGSLYLSALIGIVLTGAMVGITEYYTGTEFSPVQRIAKASETGHATNIISGLGISMKATAAPVIAVCVAIYASHALAGLYGIAIAATAMLSMTGIIVALDAYGPITDNAGGIAEMAQMPEEVRAITDPLDAVGNTTKAVTKGYAIGSAGLAALVLFADYTHELSHFTKDVTFELSHHIVIIGLVYGGLCLIVSEIGMKPVFGSRYVVAKCCKF

SEQ ID NO: 16601 - protein, 202 aa, Magnetococcus sp. MC-1
NVLEIVLCYPGVHAMIAYRFSHKLWQWNFKLAARFISHVGRVLTGIEIHPGAKIGKGFFIDHGMGVVIGETCEIGDNCTLYHGVTLGGTTWNKGKRHPTLKDGVVVGAGAKVLGPITLHEGARVGSNAVVVKDVPHDTTVVGIPGREVRAKKELSPDQAHAFPSYGVEGQMPDPVAKAVTCVLEQMHQMERRLHTLEEENRS

SEQ ID NO: 16602 - protein, 290 aa, Magnetococcus sp. MC-1
MSVTMLVPYKGENQLAGYMQQVDSYPMLSAEEEFELAVRYREQNDLEAAHKLVTSYLRYVASIAKEYQGYYGIKFMDLVQEGSVGLMQAVKRFDPHKGFRLATYAMWWIKASIQEFVLHHWSLVKIGTTAAQRKLFFNLRKSKDTLERLDATQAEEMGQRFGVSGEAVLEMDARLSGPDDSLNRCLVEGGEEIQNMLADSAPNQEMRLLASESERLQQQMIKQALSFLSEREQMIVRARIMCAEPVTLEVLGERLGVSRERIRQLETRALKKLRAFFEADGASLEDLMPA

SEQ ID NO: 16603 - protein, 355 aa, Magnetococcus sp. MC-1
MVALSAGQNSARMIAQAKHFRPEVVAMADTKAAAEVTEALAGENIRVLAGEEGVIEVASWASAQMTVSAIVGGAGLRPTLAAIRARKDIALANKECLVMAGSLFMAEIGRYQVRLIPVDSEHSAIFQVFQNSNWMRRLVLTASGGPFRGWRRQQLHGVTPAQAVAHPNWSMGRKISVDSSTMMNKGLEVIEAHWLFGLPAEQIDVVVHPQSIVHSMVEYQDGSVLAQMGVPDMRTPIAVALAWPERIPTTVKSLDLPKLGQLDFYDKPDKRDFPCLELAYEALRRGGIAPVVLNAANEIAVAAFLEGAIGYLEIADLIVKTMDYLGHAPIESIDHLFAVDLQARMTAQQLGRLAH

SEQ ID NO: 16604 - protein, 273 aa, Lactobacillus gasseri
MKQLTLNNDVKIPIFGFGTYEISPDQTKQAVLSAFEEGYRLIDTAQYYQNEQQVGEAVKASGLNRDEVFITTKTMTDGYEDTKIGLDESLRRIGLDYFDLVLIHWPMGHDIDTWHALEAAYKAGKTRAIGISNFNSRQTLDLIHQSSVRPMVDQIETHLFLQQWKMHEFLEKENIVHESYSPLGNGQQNLISNPVLKEISEKYGKSPIQVILRYLVQNDVVTIPRSTNPAHIKSNIDIFDFELDNDDLKRLRVLDERKPIDGWPAEMREDEDY

SEQ ID NO: 16605 - protein, 291 aa, Lactobacillus gasseri
MTEVPTITLNDGNKMPQVGLGVFRIPDHDKARQTVEMALANGYRMIDTAEAYDNQIAVGEAIAESAVNRDDIFLTTKIWVSNMSFEKATKAIDHDLKELGTDYIDLVLLHQPYGDTFGAWNALEAAKSAGKIRSIGLSNFYPDQYMNLELAHEDKPAINQIEISPWFQQANDVKFFQGRNVAVEAWAQFANGKHDIFNNKVLTEIAETHHKTVGQVILRWLTQKSIIVIPKAVHDEHQKENINIFDFELTQDEMAKIGELDKGESQFFDHRDPAAIDDIFGESLKQLRDSE

SEQ ID NO: 16606 - protein, 409 aa, Lactobacillus gasseri
MKLRLRKMKATVYITGSIAAYKAINVVRNFQKEGHEVRVVMTKEAVHLIGTQTLAALTKYPVLTDLWEKERADQIQHIELADWTEIAVVVPATANFIAKIANGIADDAASTTFLATASPKYVVPAMNSHMWSNPAFQRNLALLKQDGIAVMDPATGRLAEGYSGKGRMPEPDNIMAWIDDSFQAKQILAGKKIVITAGGTISPLDPVRFLGNRSSGKMGIALAKAALVAGAEVILISGHIAVSLPNSPSLKNIKVETTEQMFSAVKTAFLGADALIMAAAVADYEPVNYIAHKIKKQDQGDELKIYLKETPDILKKMGSIKKANQVVVGFAAETNNLLENASKKLQEKKADMIVANDVSHGVFGSDEDKVMVLRQDKTTENITETTKVEIAKKIIVLVAEELESRKVEK

SEQ ID NO: 16607 - protein, 476 aa, Lactobacillus gasseri
MLGFLLVIITSIVIIGSSTIHFATIQAYSQSYSRLEGYGTSIGKLALAKDNPRHELDAKFLKNLQVVMEGEDVNLRIFNNKNRQVYPETTMNWALPQKLFKQLKNGKTIRIRNDHEDGRVTSFSNKDPYTSVIVPWRSNGKLVGVIWIGSRVQNVEQMIVREKHNLITALLSSLVIGGLISFILSYYISRKIKLLSSATKKVAQGDFNVHLKHKDTDEIDDLARNFNIMVNALKESNDEIKAQEKRREQFMADAAHEMRTPLTTINGLLEGFEYDAIPEEAKPKSIALMHSETKRLIRLVNENLDYEKIRNNKISLIQSRFNATEVLTNLLTQMKQKAIQKNDKLILDCPSEVEVYADKDRFTQIMVNLVQNALQFTENGKIKISAWRIKHGAQFEIADTGIGMSQKQMKYIFERFYKADPSRAKIGSGESGLGLSIVLSLIKQHGGKIDVDSEPGKGAKFTVTLYDKGYKEFIKD

SEQ ID NO: 16608 - protein, 153 aa, Lactobacillus gasseri
MIDAQRFGLIRSVGVSNFEPEHIEYLYRETGVMPAVNQVELHPYWSSKKVREYDNQHHIITEAWSPLQRGGEAFQEKEIIELAQKYHKSPAQIILRWETQINVVPIPKASSYEHQLSNLDIFDFKLAPEEVQSLINLDKESARRFDPNEHEEF

SEQ ID NO: 16609 - protein, 285 aa, Lactobacillus gasseri
MNFHSIEDTYTLNNGVEIPIIGFGTWQTPDGDIAKHAVEVALNAGYRHIDTAAAYGNEKSVGQAIKKSGINRHDLFITTKLWNADHGYQSTKAAIDRSLQNLKVDYLDLYLIHWPNPVAMRDHWAEANAESWRAMEEAVQAGKIRAIGVSNFRKRHLDELLKTAEIKPVVNQIMLNPSDLQSDVVKVNNKLGLLSEAYSPLGTGGLLGNETVKEIASEVGKSPAQVLIRWSLEHGFLPLPKSVHDKYIQANVEVFDFNLNSEQMNKLDSLHGVSGLATDPDTANF

SEQ ID NO: 16610 - protein, 428 aa, Lactobacillus gasseri
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATACAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTESHKDRIQIVLDDFICTNPKLLNKAIHEGAGNASLIKLNQIGTVTETLETIRLSRKNGYNTMISHRSGETGDTFIADFAVAVNGGQLKSGAPARSERVEKYNRLLEIEEELGKGERLAFFPDNVDLD

SEQ ID NO: 16611 - protein, 453 aa, Lactobacillus gasseri
MMREKTMNENDKVAGLPELAKSVIWMINFGYLGIQIAFTLETSQMSRIFQTLGADPTKLGWFFILPPLAGLVVQPAIGSLSDKTWAPKLGGRRLPYLLIGMIFAVIMMLLLPNIGNFGLGYGSVEALVFGAIAIAILDVSANMAMQPFKMMIGDMVNDEQKSYAYGIQSMLSNSGAVIAAFFPFLLTILGVANTAKKGVVPQSVVISFYVGAAILVITSLLTVTKVHEYDPQTYARYHGINEEDNKKDGNWFVLLKKAPKVFWEVSLVQLFCWFSFQYLSTYATGAIAANVWKAFDPASVGYQLAGNWFGVLTAVQSIAAVIWSYILAKVPNDHHKLGYGISLLLGAVGYGSIFFIQSQNLLILSFILIGISWAAMNTYPLTLVSNALSGKHMGTYLGLFNCSICLPQIIASLLSFVLFPLLKCSMPAMMLTAGISGVLGAISVLFIKETYGN

SEQ ID NO: 16612 - protein, 384 aa, Lactobacillus gasseri
MSLWETKFAKKGLTFDDVLLIPAESHVLPNEVKLDTKLAPNLQLHIPLISAGMDTVTEGDMAIAMAENGGLGVIHKNLSIEAQVEEVKKAKTKAVDPNLSHPAVDTQGRLLAAAAVGVTSDTFERAEALLKAGADAIVIDTAHGHSAGVLRKIKEIRDHFPKATLIAGNVATGEGTAALFDAGVDVVKVGIGPGSICTTRIVAGVGVPQITAIYDAANVAQKYGKKIIADGGIKYSGDVVKALAAGGNAVMLGSMFSGTTEAPGTIFTNEGKKFKSYRGMGSVGAMSQQHGSSDRYFQGGVNEANKLVPEGVEALVPYKGDVSNIIYQIDGGLRAGMGYVGAGTIEELIENSQFVQITNAGLRESHPHDVQMAKEAPNYGGSDL

SEQ ID NO: 16613 - protein, 579 aa, Lactobacillus gasseri
MSKTLKGIAASDGIAVAPAYLLVEPDLSFSKTSVSDVDAEVARFKKVVEESTKELEKVRDKAKESLGAEEAQVFDAHLLFLSDPEFTGAIETEIKDQKVNAEAALDETAQKFITIFEGMTDNAYMQERAADVRDVSKRIMAHLLGKKLPDPAAIDHEVVVVAYDLTPSDTAQLNKKYVKGFVTDIGGRTAHSAIMARSLEIPAVVGTESITKDVKDGDMLIADGLDGDAIVNPTDAQVEEYTKKGEAFAKQKEEWKKLKNEPSVTADGKKFIIAANIGTPNDMKGVKENGAEAIGLYRTEFLYMNSKDFPSEEAQFDAYKEVIEDMDGKQTIIRTCDIGGDKHLDYWDLPEEMNPFLGVRAIRLSMQYKDIFRTQLRALLRASAYGPLGIMFPMIGTLAELREAKQILAEEKDKLVKEGVKVGDDLQVGMMIEVPAAAVLADQFAKEVDFFSIGTNDLIQYTMAADRGNDNVSYLYQPYNPSVLRLIKHTIDGAHENGIWCGMCGEAAGDDIMFPILLSMGLDEYSMSATSILRIRSLMKKINTEDIKELANKACFVSETADENKKLVEETMKKLNIND

SEQ ID NO: 16614 - protein, 69 aa, Lactobacillus gasseri
MTVYIEKVRAMEIFDSRGNPTVEVHVALSDGTIAKSEVPSGASTGEKEAVELRDGGECLDGKGRYECRK

SEQ ID NO: 16615 - protein, 412 aa, Lactobacillus gasseri
MAIQLLKFMLHFLMVLLQNLKFHQVHQLVRKRLLSCVMAVNAWMEKGVMNAVNNVNTEINEALKGRSPYNQAAIDNLMIKLDGTPNKARLGANAILGVSMAVARAAAKSKNEPLYRYLGGCDLELPQTFHNVINGGKHADNGIDIQEFMITPVNKTSFRDGFEKIVNTYHTLKKVIEDAGFETGLGDEGGFASNLKSSEEALRMLQEAIKKAGYEPGKDIAIAFDAAASSFYNKEDGKYHFEGHVWDGEEMLAYYDKLLTEFPEIISAEDPFDENDWDNFEKFTAKFGDKIQVVADDNVCTNPKLVRKAIKDKLCNAVLIKVNQIGTITETLETIRLARKNNMTTMVSHRSGETGDTFIADFTVATNAAELKSGAPARSERVEKYNRLLEIEQEIGVENERLAHFPNDVDMD

SEQ ID NO: 16616 - protein, 431 aa, Lactobacillus gasseri
MNKHPEFLLNKIENPKDLKKLDLKELEQLASEIRTLILEKDAAEGGHLGPDLGIVEATIAYHYVFDAPKDKIIWDVSHQTYPHKMLTGRAYAWLDPDKYEDVTPYSNPDESPYDYYAVGHTSTSVALATGMARARDMMGNHENITALIGDGSLTGGLAFEGFNNAADEKHNLIIVVNDNQMSIDDNVGGVVTALKKLRESNGQAEDNPFTAMGLDYKYVGQGNDIKSMIDAFKAVKDIDHPIVLHINTLKGKGYEPAIENEASHHWVLPFDLKTDKPTVPAPKTPNASTVILDFLKKHIENQENILVINAAIPGVFGLGEIKNNYPKNYKDVGIAEQESVAFAAGAVKEGITPILFENSTFLQRAYDQLSHDVAANDLPVVMIVAGGGITAASKTHLGIFDNTMVANWPNWEYLAPTTLNELKSMLEWAVK

SEQ ID NO: 16617 - protein, 293 aa, Lactobacillus gasseri
SRTFKIPVVPANMESVIDDDLAIWLAENGYYYVMHRFHPEKRANFIKMMHDKGLFASISVGIKDSEYDFIDYLAKEKIIPEYITIDVAHGHSDYVIKMIKYIKDKLPDTFLTAGNIATPEAVRELENAGADATKVGVGPGRACITKLKTGFGTGGWQLAALRMCSKAARKPLIADGGIRHNGDIAKSVRFGASMVMIGSLFAGHEESPGNLITIDGKRYKQYWGSASEVQKGAYRNVEGKQMLVPYRGSIKDTLREMQEDLQSSISYAGGKDLSAIRVVDYVIVKSSIFDGDK

SEQ ID NO: 16618 - protein, 374 aa, Lactobacillus gasseri
  unsure (1)..(374): unsure at all Xaa locations
MEVFYMNIGLFTDTYFPQLSGVATSIQTLKNALEKNGHSVFIFTTTDPHLGKGTIEPNVFRVSSVPFVSFTDRRIAFRGLFQATKIAKEVKLDIVHTQTEFSMGMIGKYVAHSLGIPAIHTYHTMYEDYLHYVLNGHLLKPYHVKQFTKAYLHNMDGVVAPSERVKETLTRYGVTIPMRVIPTGVDLTAINENPRRNVRKELGIDSNQKVILTLSRVAAEKKIDQILDVLPTVLENEPNVKFVIAGDGPDVQPLKDQVARLSLEDYVIFAGSVEHSDVGNYYRMADLFVSASDTETQGLTYIEALAAGTKCVVYSTDYTEXXXXXXXXXXXXXXXXXXXXXXXXXXXXXXXXXXXXXXXXXXXXXXXXXXXDIY

SEQ ID NO: 16619 - protein, 366 aa, Lactobacillus gasseri
MKVLHINAGLEKGGGLFHIVNLLTEANQEDADFELLTLADGPVAKAAKKAGIKTTILGAQSRYDLTVLKRLAKFINNGNFDIVHTHGARANLFVSMIKKQIKAKWIITVHSDPLKDFEGRGMVGNIFTKLNIMALKKADGIFAITQNFSDLLVEKVGIPKTKICVIYNGIFFHDNKELPKKYAHPYFNIINVGRTEKVKGQDLLLKAIKKIDDKNVRLHIAGDGSEFNNLRALARDLGISSQVTFHGFLNQKEISKLYQKMDLAVLTSYSESFPLVLLEASDNLVPIMSTDVGDIEKMIPSEKYGFVAKIGNLDDISEKLKQAISSSREDLEEMAKKEKLYLMRAFSMRNQLVAIENYYKFILGEK

SEQ ID NO: 16620 - protein, 373 aa, Lactobacillus gasseri
MAESKTTKKEATMTLDKKVKEVVKEVKKDKQITEKEFTAQLIKPYNLQGKAVDQLVQEFEDNGISIVDEKGEPSKLALKKQKDVEKAELKDMSAPSSVRMNDPVRMYLKEIGRVSLLNADQEIALAKRIEAGDEEAKQELAEANLRLVVSIAKRYVGRGMSFLDLIQEGNMGLMKAVDKFDYRLGFKFSTYATWWIRQAITRAIADQARTIRIPVHMVETINKLIRIQRQLLQDLGREPTPEEIGAEMDMPTDKVREILKIAQEPVSLETPIGEEDDSHLGDFIEDKDATSPEQHASYELLKEQLEEVLDTLTDREENVLRLRFGLDDGRTRTLEEVGKVFGVTRERIRQIEAKALRKLRHPSRSNQLKDFLD

SEQ ID NO: 16621 - protein, 432 aa, Lactobacillus gasseri
MSVITDIHAREVLDSRGNPTVEAEVYTELGGFGRAIVPSGASTGEHEAVELRDGDKSRFGGQGVLTAVENVNGEIAKAVIGLDVTDQRLIDQTMIDLDGTPNKGRLGANAILSVSLASARAAADELGLPLYEYLGGPNAHVLPTPMMNVINGGKHADNNVDIQEFMIMPVGAKSLHEAVRMGAETFHTLKGLLQERGESTAVGDEGGFAPNLKNNEEPFEILVEAIQRAGYKPGQDIAIAFDCAASEFYNKDTKKYVTVADGREYTAEEWTSLIEDLVDKYPVISVEDPLDENDWEGWKTFTERLGDKVQIVGDDLFVTNTSYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 16622 - protein, 308 aa, Magnetospirillum magnetotacticum
RLLLCLCLWVGCPVFAPSCLCCWLGVPGETFGVPRESCSLAPATRLSGSPAACQLSEPLRAPSSRFRAAPAADAAVAPSDIAAISEAPNPPVAPFEPAESAPVPEEALVEPQPVAASAPVSEAEAEEERDEEQDEEDESDEEADDEDSEDDESDEEDEDEESDDEDEEEETEDGEPRVAQVGGSGDALAEIPERPRAYRRHYKIQEVIKRRQIILVQVVKEERGTKGAALTTYLSLAGRYSVLMPNTGRGGGISRKITSAADRKRLKEVVADLDVPEGMGIILRTAGASRTKPEIKRDFEYLMRLWES

SEQ ID NO: 16623 - protein, 276 aa, Magnetospirillum magnetotacticum
SIRVNPDVDALTHAKISTGKSENKFGIPIARAREVYAGAARLPGLEIVGVDAHIGSQITDLTPFDNAARLLCALARDLLADGHRLHHVDFGGGLGIPYRDDNAPPPDPAALAAILRPHFRPLGLKPVFEIGRMIAGNAGILVTRVVYVKPTEGKTFVIVDGAMNDLIRPTLYEAFHALRPLSEPGPDTPRLTADVVGPVCESGDYLALGREMPEVSPGDLIAVMSAGAYGAVQAGTYNSRRLVPEVLVRGDQASVVRPRPSYDDLIRLDRLPGWLA

SEQ ID NO: 16624 - protein, 266 aa, Magnetospirillum magnetotacticum
RMRASRASSARAPDMAALAARHAVVTGGARGIGRAIAARLTREGATVTVLGRNAEALERAVAEGAAHHAVPVDVTDETAVAQAFAALAARAPVDILVANAGAAESAPFGRSDAALFQRMLDVNLFGAVHAAQAVLPGMTERGFGRIVAIASTAAQKGYPYVSAYCAAKHAVVGLVRSLAQETARTGITVNAVCPGFTDTDIVGDSLERIVATTGRDRDAALASLVRHNPQGRLVQPEEVADAVAWLCGASATAITGQTIAVAGGEV

SEQ ID NO: 16625 - protein, 210 aa, Magnetospirillum magnetotacticum
  unsure (1)..(210): unsure at all Xaa locations
MEPQLRALYRAAKDHVPAGLPPMGKDAPLSIMMPMITSVPEVIRLREVCERIRRAVGPPEVPLGIMIEVPAAAVQADAFARHCDFFSIGTNDLTQYTLAIDRQNTDLAPEADSLHPAVLRLIRLTCEGAARHGRFVGVCGGIAGDPFGACLLAGLGVDELSMTPRDLPGVKARLRHAALADLKALAAKGPGXXQEDAAAVRALDDAPAGA

SEQ ID NO: 16626 - protein, 158 aa, Magnetospirillum magnetotacticum
MRHARGERRSGRHIRPAERLMTKWVYSFGDGKAEGEASMRNLLGGKGANLAEMSNLGLPVPPGFTITTEVCTYYYEHGETYPAELKDAVNAALDTVGKLTGRRFGDAEKPLLVSVRSGARASMPGMMDTVLNLGLNDTTVEALAKDADDERFAYDSYR

SEQ ID NO: 16627 - protein, 296 aa, Magnetospirillum magnetotacticum
GMSTTADGEQGATVPGGSGRVVVVGSANVDLVVDVPRHPGGGETILGGELRRNPGGKGANQAVGAARAGGAGTTFVGALGHDDAADLLLASLDRGGVRTDLVERVDAATGTALITVSPDGENAIVVAPGANSHVTVGAAQAERIAAADVVLAQLEIPLDVVRAAAAARRPGALLVLNAAPSRDLPGDVWAAVDVLVVNEHEAADLAGASGDADPSALAGLLLERVPAVVVTLGGEGSLVAERRPAGPLLTTVPAIAVEAVDTTGAGDTFCGVLAAALARGADLPDAARLAAAAGAL

SEQ ID NO: 16628 - protein, 179 aa, Magnetospirillum magnetotacticum
MARFGRLDVLVNNAGKDHLGKVDEGDIADFSVVIETDLYGVFYMTRFALPHLRESRGCIVNVSSVSGLGGDWNHSFYCAAKGAVTNFTRAVALDEARNGVRVNAVNPSLVYTPFTAGMQEQPDLVAKFEERIPMGRGAQPDDISGAIAFLASEDAHFITGVNLPVDGGLSASNGQPALS

SEQ ID NO: 16629 - protein, 268 aa, Magnetospirillum magnetotacticum
MSVGRFSKCAGGRSADNRHCPLLKLGRARYAAEPFNQIRAAALSTPPGMSLITDPMMNAPLKAFGPIKAVIFDMDGLLLDTEGIYTEVTSLIAERYGRTFDWSIKQNIIGRGAGDLARYVVEALDLPITAEEFLVIREPLMRERFPTAQAMPGAEELIRHLKAHNIPIAVGTSSSRQSFGQKTTLHRDWFALFDFIVTADDPEVGAAKPAPDIFLTAARRLGVAPEDCLVFEDSPFGVTAAKAAGMTAIAIPDAAMADEKYAHADGIL

SEQ ID NO: 16630 - protein, 413 aa, Magnetospirillum magnetotacticum
MPTPLSARTIAVVKATIPALETHGLTITRRMYERLFQNTDIRDLFNQSHHGETGSQPKALALAVLAYARNIDNLGVLTGAVERIAQKHVALNILPEHYSFVADALIGAIQDVLGEAATPEIVEAWGEAYWFLAELLIGREATIYRDLASKSGGWNGWRDFVVESVTPESEIIRSFVLVPADGGPVLRHEPGQYLGFLLDLPGRGVLKRNYSISCAPNDRAYRITVKREAKTEHPAGLVSNWLHDAAIAGTVLKVAAPAGDFFLDRSSNAPVVLVSGGVGLTPMVSMLESITETTPERPTWFVHSALNGRVHALREHVRNLAANRDNLRVRIFYTAPEAQDRVGEAYDIPGPVTAEWLVANTPSEQATYYLCGPKSFLASLANGLVRAGIPAERVRFEFFGPADALLEEPKQAA

SEQ ID NO: 16631 - protein, 314 aa, Magnetospirillum magnetotacticum
MSLTERVVRTNSRAPILSSSAATVRVTAGGLMARWRAADAKPPLSATFTKTRIACQRSIALPPPPRRDDYSVQRNSRLLRTSLHVTADQQSDGAYGRSRGRKETNPVKLYSLSLSGHAHRARLFLSLLGVPYEVVEVDLAGGQHKSQDFLALNPFGQVPVLDDDGTIVPDSNAILVYLAKKFGRGDWLPEDPEGAARVQRWLSVAAGPIAFGPAAARLVTLFGASFDTGEVIARAHAILTLVDAELSARDWLAAGHPTIADVALYSYIAVAPEGNVDLAPYAHLGAWLARIEALPGFEPLPRSAVGLSAEEGRA

SEQ ID NO: 16632 - protein, 92 aa, Magnetospirillum magnetotacticum
MTSPDPVPQIALNDGRSIPQLGFGVWRLPEGETPSIVGTALGSGYRSIDTAAAYDNEAGVGRGLRETVVPRSDVFVTTKLWNDSQGYDATLR

SEQ ID NO: 16633 - protein, 166 aa, Magnetospirillum magnetotacticum
MRVHKEFAALEVYRVAHWLWHQGRATLALHMQSRISEVFGCDIHPAARIGSGVFIDHATGVVIGETTVVADDVSILQSVTLGGNGKESGDRHPKIARGVLLSVGAKVLGNIKVGEGAKVAAAAVVLHEVPAHTTVAGVPARVVSRLRSDEEPAQTMDQSFGFGDGI

SEQ ID NO: 16634 - protein, 307 aa, Magnetospirillum magnetotacticum
TLEDPPNWMTRVATLGGKGWKNFVERGGRQVADLREQILTLASETGLQIGEYRKIVAMVQKGEREARQAKKEMIEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPIGDEEDSHLGDFIEDKNVVLPIDAAIQSNLRETTTRVLASLTPREERVLRMRFGIGMNTDHTLEEVGQQFSVTRERIRQIEAKALRKLKHPSRSRKLRSFLDN

SEQ ID NO: 16635 - protein, 275 aa, Magnetospirillum magnetotacticum
ARGMVSGGGTLFEELGFYYVGPIDGHNFEHLLPVLKNVRDSEETRPVLLHVVTKKGRGYPPAEAAADKYHGVGRFDVLTGQLEKPKANAPSYTSVFAKALIAEAEVDDRVVAITAAMPGGTGLDKFGDRFPARTFDVGIAEQHAVTFAGGLATEGFKPFCAIYSSFLQRAYDQVQHDVVLQKLPVRFAIDRAGLVGADGATHAGSYDMAFLGCLPDIVIMCPSDEAELMHAVATAVAIDDRPSAFRYPRGEGVGVELPERGTVMPIGKGRVCAKR

SEQ ID NO: 16636 - protein, 88 aa, Magnetospirillum magnetotacticum
MHGLTVTEVKGYGRQKGHTEIYRGAEYAVSFLPKLKIEVAVASDLVTSVIDTIAGAARTGQIGDGKIFVMPLEKAVRIRTGETDADAL

SEQ ID NO: 16637 - protein, 465 aa, Magnetospirillum magnetotacticum
LALVLMDAGYSTSLRDLMRNWRPIAGLAVGAVAATTAAVADIALWLVPDMPLSAAIVLGAVVAPPDAVAALSVLAHVSLPHRLATILRGESLLNDAASLLIYRLGVAAAVTGHFSAAEVAPAFLIGVVGSLVAGPLAALVYLRILRRVEEPMSTIVLQFSAAFGLWIVAEAVELSGVLTVVSFAITVARRAPGQTAPRLRVVSKAVWETAIFVLNVLAFVLIGEQIGPILARMSPEQETAYISVAGAVVATVILIRIAWVLPASALRRLGFEGGEAAGDPRQARDLGLGAGFALAWSGMRGLVTIAAALALPEGGPGGGAFPYRDLIVLTAFCVVIGTLVVQGLTLRPILGRLGLRDSDPVGFEVGRARAEAYGAAVEALRDDHSEAADALRREFHAALAEAEAHEEGLAPEGLPTDEPRRRAVRAARDRLLALRRSGSIGDDAYFVLEEELDWAELNATPRAEA

SEQ ID NO: 16638 - protein, 238 aa, Magnetospirillum magnetotacticum
MHARVDGAALTARRPGAVHRPRPGRMGTMPDGPAPTPRTVTILGSTGSIGTQAIDVVRAHPDRFRVEALSAGGSDVDLLARQAADLGVRAVGVADATRAAALAEALSAACAGREVVPEVLAGPDAAAELAARGSDVVLNGVTGSVGLGPTLAALRAGSTLALANKESLVAGGALVRAAQQRPDQIVPVDSEHSAIAQCLRSGTRPEVRRLILTASGGPFRGWAADAVKAASVDQALAH

SEQ ID NO: 16639 - protein, 197 aa, Magnetospirillum magnetotacticum
WQPRTPMPTARAAGGATPLDGTIHVVGGSGSGRGNVRSHEVYDPARDAWTRAADLPTPRDHLSVQNVEGRIVASGGRIDGDSGKNLSANQVYDPVRDAWSEAAPLPTARSGTASAVLGREVFVIGGESNRKTYDEVEAFDLPGNVWRALARLPTARHGFGAVTYKGRIYTLTGSPRPGGDKSGTVEVLDPNNAAPAR

SEQ ID NO: 16640 - protein, 244 aa, Magnetospirillum magnetotacticum
MDPATRPAIPPRHPVFAVKAETLTEYWDYTSKLFDWHDGGMPNMILDDGGDATMFVHLGLRAENGDTAFLDKPESEEEEIFFALLKKKLAEKPKGWFAGLADSIKGVSEETTTGVHRLYNLAKEGKLLFPAINVNDSVTKSKFDNLYGCKESLVDGIRRGTDVMMAGKVAMVAGFGDVGKGSAASLRNADCRVMVSEIDPICALQAAMEGYEVVTMEEAAHARRHLRDRPRATRTSSRSSTCGR

SEQ ID NO: 16641 - protein, 144 aa, Magnetospirillum magnetotacticum
MRAMKDRAIVCNIGHFDNEIQVAGLKNLKWQNIKPQVDEIEFADGHRIILLSEGRLVNLGNATGHPSFVMSASFTNQTLAQIELWTNPGKYEKQVYTLPKTLDEKVAALHLEKIGVKLSKLRPDQAAYIGVPQTGPFKPEHYRY

SEQ ID NO: 16642 - protein, 411 aa, Magnetospirillum magnetotacticum
QVWTLPARERPETCSRCVVSPQCTKWLPARCWQRARRGPKEGAGQPRSALMSSAAPRASTPDDVLDPRAMREPLPNAWYCVGPAASVAGGKMRAVALNGEQVVLGRAKDGALFALRDRCPHRGMALSKGKFDGDTLMCPFHGWRFGTDGRCRDVPTLSEHDASDFSCIAVQRFPIVESAGFLWVNPHLGPSDLEAVPAVPSLGFEPAGSLVLELEVEASFDLTTLSLVDPGHVAFVHDNWWFRASKELREKVKTFQPVPHGFVMTSHATTTSSPLYRLLGGAPEVEIEFRLPGVRLERIAAGTKRVANYTFATPMGPNRTMLTNALYWSMPALNLLKPIARPLMRQFLTQDQQVLQHAQAGLDRKPTMVLLGQGDLPSQWYFRLKRETLEAAREGRPFANPLVRQELRWRS

SEQ ID NO: 16643 - protein, 237 aa, Magnetospirillum magnetotacticum
MPLPRMARLHGPARRLRRTRDHAVRSENARTKNARTREAGMAEIAGMRRQFIRTAMEAPFLARDEERGLAVAWKEERDERALHRLISAHMRLVIALAGRFRHYGLPMADLVQEGHVGLMEAAARFEPEREVRFSTYATWWIRASIQDYILRNWSIVRGGTSSAQKALFFNLRRLRARLMQSTEEQVGSEIHGRIATAIGVSREDVALMDARLSGPDMSLNAPVGEERRSFLRADGLL

SEQ ID NO: 16644 - protein, 110 aa, Magnetospirillum magnetotacticum
MPAGPREDTVSDIRLHLFQTGSLVCRRQDIFLNEGMGEPFEIPVPWYLITHPSGHVVIDGGFPAICATDAEGHWGPAAEVFVPRVRPGEDCAAQMRARVSIRRMCARDPL

SEQ ID NO: 16645 - protein, 467 aa, Magnetospirillum magnetotacticum
MRAVAALVAAGGATAPRDADGACPDNFPRIDGLAPPRGRLPSLTSTPMASFKTVMKSGHPPTLFAAFLYFDFCFAIWVLNGAMGPFITETYKLTPAQTGFMISLPILAGAIMRFPLGVLAQYIGRKNAALTEMSVIVLAMAYGFFFVSSYNDVLAMGVLLGIAGASFGVALSLGSGWFPPEHKGLAMGIAGAGNSGTVLAVLFAPPLAQAYGWQAVYGFAGLVMIVPLVVMILLAKEPPDCHGQSFKEHVSCLFTKDGWAFSLIYIITFGGFIGLSNFLPTFFYEQFSVTKVEAGRLTMLAALMGSGIRILGGYFADRMGGILVLSLVLLAAIGSFLALTATPSLAVTTLLFMLCFAALGAGNGALFQLVPLRWPTNTAVAGSMIGEVGALGGAILPNVMGFSKQYTGGFATGFVVYALFTGLVLGCLFLWQRKWVGTWVGPRGKVLDPAGETLGEAEGARVAPATA

SEQ ID NO: 16646 - protein, 268 aa, Magnetospirillum magnetotacticum
MGLAAIKASSARMREDVLGRLFSHDLKASGVRFEVAPASEGPATARCFILVTPDGERTMNTYLGACQALSPDDVDEATVRAARVTYLEGYLWDPPAAKDAFRKAVKIAHSAGNAVALTLSDAFCVGRYREEFLELIRNGSIDIMFANIGELQSLYQTDDPEAAIAALRDERDAQGKHMLGLVTRSAEGALVVRGGEVRSVEAFPAREVIDTTGAGDLFAAGFLAGYTRGIDYVASARLGALAAAEVIEHIGARPQRDLLALAREHKLV

SEQ ID NO: 16647 - protein, 116 aa, Magnetospirillum magnetotacticum
MTAPRLGLAPKIGAGTVICPRCCISTDCEIGEHVLINSASGVGHDAIVGPYSSLLGAVSINGNVKVGEGVLFGAGSMVYPGKKIGDWAKIGLGSVVLRNVPDRAVMFGNPAQRIDA

SEQ ID NO: 16648 - protein, 196 aa, Magnetospirillum magnetotacticum
CSSVWPQLRWPRPPFAVPRMTARGLYPRTSPSASRPRGGRRADLMPDFLDLAFAAAREAAASGEVPVGAVVVRDGVVLGVAGNRPRALSDPTAHAEILAIRAACTALQDERLTGCDLYVTLEPCPMCAGAISFARIRRLYYAASDPKGGGVEHGPRVFNQPTCHHAPEVYSGFRAGEAAGLLREFFAGRRGRDGTP

SEQ ID NO: 16649 - protein, 427 aa, Magnetospirillum magnetotacticum
  unsure (1)..(427): unsure at all Xaa locations
MRPGEGPALAWSWAYIFALLASYYMLRPIRDQMGVXGGLDNLPWLFLATLVGMLALNLPFAWLVKRLPRARFVPLTYRFFILNILIFSGLIALAEGETAVWVGRAFFVWLSIFNLFVVSIFWATVVDVFSTEQGKRLFGFIAAGATLGAICGSAVTATLARDVPTWALLLAAALLLEVAVFAMRGLARLIGRLHAVPEESRAGEIIGGDVWAGIRRTLASPYLLNIALFLALFSITATFLYFEQAAVAERSFSGRGERTAFFASVDLAVNLLTLGVQLFLTGRITRWLGVGVTLALLPAASVVGFAALAMSPTVASVVVIYVLRRAGNFAIARPVREVLFTVVPREDRYKAKSFIDTVVYRLGDQLGAWSYTGLAALGFVGHAAAIVAVPLSAAWLVYALWLGRAQARRQGETRVEEIAAPIPPRTS

SEQ ID NO: 16650 - protein, 392 aa, Magnetospirillum magnetotacticum
MSLTVTVLGATGSIGRSTTDLLAQHAGRFRIGALVGGKDAAALAKLALELKPDFAALADEAAGPALAEALAGSGIPNGAGESAVLEAVARDADIVVAAVSGAAGLKPTHAALRLGRTIALANKESLVCAGDAFMRDAKRYGARILPVDSEHNALAQAMGDGRVSDIAKMTLTASGGPFRTWDRARIAAASPSEAAAHPTWSMGMKINIDSASLMNKGLELIEAHHLFAIEAERLDVIVHPQSIVHGLIAWRDGAVTAGLAMPDMRVPIAHCLGLGDRLEIARGRPLDLAATGSLTFEPADEARFPCLRVARAALAEGGAAPTVMNAANEIAVAAFIRGAIPFYGIAELVERAVEHFAAEHRRAPEDVDTALAIDAQVRAWSLEAVPSARAAG

SEQ ID NO: 16651 - protein, 291 aa, Magnetospirillum magnetotacticum
  unsure (1)..(291): unsure at all Xaa locations
MSMSRGAXMTVASQCWTSIHGVVMPRIIYGTAWKKEKTADLVELALGQGFRGIDTACQPKHYHEPGVGEGLAAALAKGLRRDEIYLQTKFTPLAGQDPQRIPYDPSACLSQQVAQSFERSCANLRTEFLDGLVLHSPLGNPADFREVWSAMEGIFESGGTRQLGISNCYDPEVLRHLCETSRVKPAIVQNRFYAATGFDRILRAYCRKNGILYQSFWTLTANPEILVDDRVKALMAKHGRTAPQIFFRYLSQQEIIPLTGTTSAVHMGQDLEIGDFELSDAECQTLAPLLN

SEQ ID NO: 16652 - protein, 367 aa, Magnetospirillum magnetotacticum
MTSGLVPGSQCRLPEAGRDERHRPEQVGPGDEDRAAMSVANTGIFSDPTARGLTLELVRVTEAAAIAAARLRGQGREKEADQAAVDAMRAELMVLPIEGSVVIGEGERDEAPMLYIGERVGTGNGPSVDIAVDPLEGTTLCAKDMPGAIAVMALAERGTLLAAPDVYMQKIAIGPGYPPGTVDLDWSPAKNIASLARAKGVEPSGITAIILDRPRHMDLIAAVRDTGAGIRLISDGDIAAIIHCTRPDETGVDIYMGTGAAPEGVIAASVLRCIGGQMQGRLILDSADRRARAAKMGITDPGRKYDMHDLARGDVIVAATGVTTGALLSGVRFRPGIIETETVVYRSNTGTIRRIACEHRQPGNAPG

SEQ ID NO: 16653 - protein, 241 aa, Magnetospirillum magnetotacticum
MTAPSRWRAATIRAITPVTPRVKSFRFTPQPSPFEGPHRAGQHVDVRLTAPDGYQAQRSYSIASAPGDPAGLELMIEGLEAGEVSGFFDTVAEVGDEIELRGPLGAFTWGPEEGGPVLLIGGGSGVVPLLAMVRERALHAPEVPMLLIYSVRSGAEAIARAELSARSRDETGFDLTLLLTREGATAGRRIDRVMIDTAIECLGMPRHAFVCGGNGFVGAVADLLVDAGVRPSAIRTERFGG

SEQ ID NO: 16654 - protein, 426 aa, Magnetospirillum magnetotacticum
MAPSASGSLAGRRILLIVGVGIAAYKALDLIRRLRELGAQVRPLLTESAQEFVTPLAAAALAGERSHTDLFDRETEADIGHIKLARDADAIVVAPATANLIARMATGHAPDLAATVLLATTLPILIAPAMNVRMWLHPATQRNVATLKADGVTVVGPNEGAMAEAEFGPGRLAEPHEIADALEALLAQRTESPGFGFLAGRETAQKPLAGRHVLVTSGPTHEPIDPVRYLANRSSGRQGHAVAAAAVEAGARVTLVSGPVAIPDPPGVTVVRVESAREMLAAVEAALPADLAIFAAAVGDWRPAEMRPGKIKKDGSLPAPLQLVENPDILATIAGRSTGRPPLVVGFAAETDAVLDNARKKIARKGCDLIVANDVSAEGGVMGGTENSVHLVSRDGGVETWPKLGKEEVGRRLVARFADLLAQRSS

SEQ ID NO: 16655 - protein, 129 aa, Magnetospirillum magnetotacticum
MVDKEGSERRARIGLFRMKKIEAIIKPFKLDEVKEALQEVGLQGITVIEAKGFGRQKGHTELYRGAEYVVDFLPKVKLEIVLSDALVEGAVEAIRKSAQTGRIGDGKIFVSTIEEAIRIRTGETGSDAI

SEQ ID NO: 16656 - protein, 235 aa, Magnetospirillum magnetotacticum
MKWEFPGRVAVVTGGMRGIGRTIADGLLAGGAEVHVFDRETGELPKGMTAHAVDVSNSDSVNAAFAAIGKPVHLLVNNAGITRDRTLLKMSDEEWASVITVNLTSAFNTIRAAGPGMVQAGVGRIVNMISINGLRGKMGQGNYAASKAGMVGLTKTAAKELGPKGVTCNAVAPGMVLTEMTLKLDQQFRDKALAEAALSILPDTTDIANAVLFLLSDAARCITGEVIKVDSGQYI

SEQ ID NO: 16657 - protein, 263 aa, Magnetospirillum magnetotacticum
MSPPTPDVFPPTTGAHIMFDLTGRKALVTGATGGLGGAIARALHAQGAHVALSGTRRAVLEELAAELGGERVAVVEANLADKEAVEALLPAAESALGGLDILVNNAGITRDNLFMRMKDEEWEAVLNVNLTAAFRLSRAALKGMMRRRYGRIIGIGSVVGATGNPGQGNYAAAKAGLVGMTKALAAEVATRNITVNCIAPGFITSAMTDALNEKQRETILTRVPAGRLGTGAEIGAAAVYLASEEAGYVTGQTLHVNGGMAMY

SEQ ID NO: 16658 - protein, 746 aa, Magnetospirillum magnetotacticum
MYSNVVLGVEHHAFEEALEHYKEQKGLNLDTELKADDWKHLIGVYKKIVRDEHGSDFPQKPEDQLWGAIGAVFDSWMIPRAKKYRELNNIPESWGTAVNVQAMVFGNMGDTSATGVAFTRNPSTGESALYGEFLINAQGEDVVAGIRTPQDITEKARIEAKSDKPSMEKAMPESFAELTRIYGILEKHYRDMQDMEFTIERGKLWMLQTRNGKRTAKAALRIAVELAGEGLISKEEAIKRIEPGALDQLLHPTIDPNAERKVIATGLPASPGAAVGEIVFNSEAAEAARKAERRCILVRIETSPEDIHGMHAAEGILTTRGGMTSHAAVVARGMGKPCVSGVGSIRIDYKAQTLTVGGVTLKAGDVITIDGSTGQVIQGEVKMLQPELSGDFAALMEWADAVRTMKVRTNADTPADARAARKFGAEGIGLCRTEHMFFDGDRIVAVREMILADDTEGRRAALAKILPYQRQDFLELFTIMSGLPVTIRLLDPPLHEFLPHTDEEIREVMEATGIAEDKIRNRIRELSEHNPMLGFRGCRLAIAFPEIAEMQARAIFEAAVQAAKDTNAPVTPEVMVPLVFTRMEFDIVKARIDAMAKAVSEETGAQIDYQVGTMIELPRAALKAGEIAETAEFFSFGTNDLTQTALGISRDDAATFLGPYTQKGILPVDPFVSIDQEGVGELVKIGAERGRKTREKLKLGICGEHGGDPASIGFCQEVGLDYVSCSPFRVPIARLAAAQAALGKDA

SEQ ID NO: 16659 - protein, 770 aa, Magnetospirillum magnetotacticum
  unsure (1)..(770): unsure at all Xaa locations
AVMELGIDKTIESTLPLYACVVSAWIGALAADLAVNKPLGLSPPGIEFKRAHLYAINPVGTGAMGLSLVAGCLIHAGLLGATLQPFAPILALATAFAAAPAIALATRGRRYLARAPHTAWDRPEITCRVCEHPFEAEDMARCPAYSGPICSLCCSLDARCGDLCKPHGRLEAQARETLARVLPARTAAWIGAPLGRYLALMLTLVAVIGLILVIVHAGAAAGHPEHADTLRAALTSLFFILIVILGVVAWLFVLAQESRRVAQEETARQTALYEAEIAAHKVTDAKLQQAKETAEAANLAKSRYVVGISHELRTPLNAVLGYAQLLEGDPSIPEPRRNGIRVIRRSAQHLSGLIDGLLDISRMEAGRLQTYRNEIRLADFLAQIVDMVRLQAEAAGLSFRFTRPDTLPAVVATDEKRLRQILLNLLSNAIKFTAEGEVALEMSYRSQVAVFSIRDTGLGIPEADLARIFEPFERGSMPAARAAPGTGLGLTIAHLLAQVMGGEITVESRVGEGTCFRVRLMLAAVNRPAPAAMPAPAAVTRPAFPEPGRTVLVADDDQAHRALMREILEPLGFAVAEAPDGPACLASAKEREPALILLDIAMPGMSGWEVARRLREAGCPARIAMMSANVHEISPTRGADAPHDDIIAKPFDMQDFLERITKLLGSARPLPAPDPAPRPIRPPESPAAAQGKRVPPEHVAELLRLGRIGHVRGIETKLAELENDPAVPPAFVARLRGLXXTXPXXXXCXXAXXSGXSGKXGASXPAMPEA

SEQ ID NO: 16660 - protein, 310 aa, Magnetospirillum magnetotacticum
MSWNPALEPGCPNTVDIDAIETLIVPRAHDLGGFAVRRALPAPTRQMVGPFIFFDQAGPAEFITGTGVDVRPHPHIGLATVTYLYRGEFQHRDSLGTNQTILPGAVNWMVAGRGVTHSERTTAETRRAPHSLYGIQTWVALPESHEDAAPSFEHHGKATLPMIEDGGVSLRLILGHAYGERAPANVFSETFYADVTLAPGTRFPLPDDHEDRGLYVVEGSISIAGQDFEAGRMMVFRPGDRITVSAGPSGARLMALGGATLSGPRYIWWNFVSSSREKIEAAKEEWRRGAWGEGQFDLPPDDRAEFIPLP

SEQ ID NO: 16661 - protein, 248 aa, Magnetospirillum magnetotacticum
MAKLDGKVAVVTGASKGIGAAIAKALAADGAAVVVNYASSKAGADSVVEAITSAGGKAIALQGDVSKAAQAHSLIEAAVTQFGRLDVLVNNSGVYEFAPIEEVTEEHYRRQFDVNVLGVLLATQAAAKHLGEGGSVINISSAITHLNTPNASVYSGTKGALNAISGVLANELAPRKIRVNTVSPGFVVTEGTHSAGIVGSEMAAGIVAQTPLGRAGQPDDIADVVRFLASDEARWLTGEVITASGGMR

SEQ ID NO: 16662 - protein, 346 aa, Magnetospirillum magnetotacticum
MPTEVDVATRLTRTIRLNLPIIASAMDTVTEAPMAIAMAQNGGLGVIHRNLEPAEQAEQVRLVKKYESGMVLNPITIHPDETLADAFEVMKSNRISGIPVVERGPNGSRGKLVGILTNRDVRFATNTGQPVAELMTRDRLITVREGVTQDEAKRLLHQFRIEKLLVVDDHYRCIGLITVKDIEKQVAYPHAVKDEQGRLRVAAATTTGDSGFERAERLIDAGCDVIVVDTAHGHSRKVLDSVARVKQLSNAVQVIAGNIATAEGARALIDAGADAIKVGIGPGSICTTRIVAGVGVPQLTALMEAVEAAHEADVPVIADGGIKFSGELGEAIAAGASVGMLGSLSP

SEQ ID NO: 16663 - protein, 365 aa, Magnetospirillum magnetotacticum
MRGDRERMESGEEWQLTERVWAGARSGKGNPFAAAVRATRMAMIITDPNRLDNPIVYANDAFLRLTGYTRLEVTGRNCRFLQGPDTDLDAVARIRAAIASERDVQVELLNYRKDGSTFHNAVYISPVHDEDGTLLFFFASQLDVSERHALVEERDRSRATLETNALLLREIGHRARNDLQMISAMLSLQSSSTADPAVRAALSEAMGRVEALGALYREPEEESAGQGSAYDFGQLIRTVAGALIEASGRDDIAVDLHLMPLRLRPKAAGPLALILNELVAGVIKHAFPERAGRLTLRITRDADAVLVTVEDDGAEVGAGASAEGCFEATLIDALCRQIGGTRERRSRPSGGTKVTLRFPAGRIEA

SEQ ID NO: 16664 - protein, 286 aa, Magnetospirillum magnetotacticum
MSASPSLSPASGREVIAGIVDPLWTRVRTEAETVLRDEPQLASFFVATILNHPTLEAAVSHRVAARLGHGSLPTELVAHGFHEALQDDPRIGQSMRADILAVMDRDPATTRAIEPLLYFKGFHALQAHRLAHWYWGQGRRDLALYLQSRSSEVFQTDIHPAARIGRGVFLDHATGVVVGSTAVIEDDVSILQAVTLGGTGKHGGDRHPKIRRGVMIGAGAKILGNIEVGACARVAAGSVVLRPVPPHTTVVGVPARVVGAAGCAEPARSMDQLVAMSEFVDIAGGI

SEQ ID NO: 16665 - protein, 109 aa, Magnetospirillum magnetotacticum
MALADTTILEGLETPDRLRLLPESELQRVADAVRAEMIDAVSVTGGHLGSGLGVVELTVALHYVFDTPDDRIVWDVGHQCYPHKILTGRRDRIRTLRQGGGLSGFTKRS

SEQ ID NO: 16666 - protein, 684 aa, Magnetospirillum magnetotacticum
MQADHTKTREAQPEISPVELGRVPVKPLFSARLIAAVVVFGVGMALAMAVATTLGLLAGRQEAIGGAEAVTRNLARSLTESVERSVNSMDVTLASVADLALEQGMGSARLDLRAAVAQRLTFTPYLRQILVVRADGALLFDSANQSDGRSFDIGGLLVEHERLPRPLVIGLPVDGRFIGIGIRGGGHKTIPLSRAIRDASGKILGLVIGAVNPDYFVSSFQGIEGESGAHVHLWRFDGLLLAGAGGIDDQHQDRGWDNPLFSRHLKDSEMGTFMGPWGDGVTWITSYRTNLAWPLVVSVGISLDRALEGWTRSVEIIAWPVAAMTLIVLGLTAAMAAMLHKRGRDEARLRLSDMVLSNVSNGVTIADVSGPDMPLIYVNPAFEHITGYAAQNALGRNARFLHEFDPAQEGLDDIRAALAEGRPVTVVVRNQRADGTLFWNQLSLSPLRGTNGALTHWVGVQRDITQQEEARASLAKAYDDVAHYSEDLERFSFVLAHHLQEPARQMRLQAQVLLQRIEDLPEATGAEQPAHLIIDAARRLVDILRDVQAYLAIERQPVVGGIASSETALAAAINRFVDTSKTGPVQVERGLMPRVGIPQKYLDDLFEILIENAVRFRHAERPLCLNVGAQNHPEGWVSRWRITVSASILVSRTGSGPGTLLRRLWVRMAGMARSEWERLGTRKR

SEQ ID NO: 16667 - protein, 306 aa, Magnetospirillum magnetotacticum
MVAITAAMPGGTGIDLFGKAHPDRTFDVGIAEQHAVTFAGGLATEGYKPFVAIYSTFLQRAYDQVVHDVALQNLPVRFCLDRAGLVGADGATHAGAFDLAYLCCLPNMTVMAAADEAELVHMVATAHAHDSGPIALRYPRGEGVGIELPEKGEVLALGRGRVVRRPEGARVALLSLGTRLSEALKAADALEAEGVATSVADARFAKPLDAELIVDLAMSHEVLVTVEEGSVGGFGAMVLHLLSERGVLDAGRVRVRTLTLPDLYQDHDKPEKMYAEAGLDAEGILKAVRAALPEKKGSRTGRLRLA

SEQ ID NO: 16668 - protein, 274 aa, Magnetospirillum magnetotacticum
MTDRIRDYLRARRDLGRDEGPVMVLDLDVVRENYTAFARALPDTRVFYAVKANPAAEVLRLLAEMGSCFDTASVAEIEMALSAGATADRVSFGNTIKKERDIVRALKLGIRLFAVDCQAEVEKISRASEAAGIEAGDVQVFCRILCDGAGADWPLSRKFGCEPEMAVNVLEHAHRHGLHAYGVSFHVGSQQANTEAWDGALASAAAIFQDCALRGIGLSMVNLGGGFPTKYLKQVPGVETYGDAIFRALTKHFGNRIPETNHRAGAAAWSAMRA

SEQ ID NO: 16669 - protein, 121 aa, Magnetospirillum magnetotacticum
MVGNAGMIEAEVVLVSKKSESEDEVRWVYLDIGKFGGLAETMDESIRYAIRTPRDEDRTAPCVVAGPTCDSVDVLYEKNHYPLPVSLSIGDKVWIEGTGAYTTTYAAVAFNGFPPLEQIVI

SEQ ID NO: 16670 - protein, 245 aa, Magnetospirillum magnetotacticum
MFDLTGKTALVTGASGGIGGAIAKALHAQGATVGLHGTRREALDALAAELGERVHVLPANLSDGAAVEQLAKDAEAALGSIDILVNNAGLTKDGLVLRMKDEDWQTVLDVNLTAAFRLSRAAVKGQMKRRWGRIINITSIVGVTGNPGQVNYAASKAGMIGMSKALAQEVASRNITVNCVAPGFISSAMTDVLSDDQKTKLNAGIPAGRMGTAEEIAASVVYLASAEAAYVTGQTLHVNGGMAMI

SEQ ID NO: 16671 - protein, 477 aa, Magnetospirillum magnetotacticum
MEKPMTDISRRGLLGAGGLVLAGTSMISGRTQAAGLPEAPSMDKATTQPPLVPTTGVDYQPVVTLNGWTLPWRMRGDWKEFHLVAEPVVREMAPGMKAHLWGYNGQSPGPTIEAVEGDKVRIFVTNKLPEATAVHWHGQTLPNGMDGVAGLNQPGIPPGKTFVYEFILRRSGTFMYHPHSDEMIQMAMGMMGFFVVHPRDPAERRVDRDFVWLLNAYDIEAGSYVPKVNTMLDMNMWCFNSRVWPGIDPVVVRQGDKVRMRFGNLTMTNHPIHVHGVDFKVTGTDGGWIDQDRQWPEVSVDVAVGQMRAIEFNADALGDWAMHCHKSHHTMNAMGHSVRTYIGVNLKSTAKQIQKIAPGYMPMGSTGGGMMTEMEMPLPENTLPMMTGAGPFGSVEMGGMFTVLKVRAGLAANDYRDPGWYQHPPGTLAYEWTGDPLPEPSRDPKTPRGKRARETDLHVVDPRTRRTASNSGGHENH

SEQ ID NO: 16672 - protein, 511 aa, Magnetospirillum magnetotacticum
NALAEAHAELALKNRDLEKAVTQARDAERAKSEFLAVMSHEIRTPMNSILGMVHLLMDRPLAAEDREKLSVVHDSGAALLGIINDILDFSRLEADGVQFEDAPFHLGNTVEGVVSLLRGRATEKNLTLALDAPSPLPGWVSGDGARLRQVLINLVGNAIKFTTQGGVVLRLRRDGEGNRYEFSVIDTGIGLEAEQAKNLFQPFHQADASISRRFGGSGLGLAICKKLVDAQGGKIGVDSTKGLGSRFWFHLDYPDTAAPAAQSPRAEISNLPSLSILLAEDNVFNQKVAAGLLNREGHRVTLANNGLEALEKLQDGRFDLILMDMQMPEMDGPEATRRIRGLPGALAAIPIIALTANAMADDVARCRAAGMDGHVAKPIDPLLLRAAIAEVLPRHAPEARAGERSSYSIARMAEQLGSDNAAILARTFIESGEDICNRLENAGGDIQVTGAALHELKGLAAYSGTPWLEALAISMSKALEDSDMPQVEGLLHRLRRDWNNTRAELTRQFGL

SEQ ID NO: 16673 - protein, 404 aa, Magnetospirillum magnetotacticum
  unsure (1)..(404): unsure at all Xaa locations
MTAFPPVDGTEIERALRQRASEKILVLDGAMGTVIQRLKFTEEDFRGERFKDHGHDQKGNNDLLILTQPDAIRQIHLDYFLAGADVCETNTFSGTTIAQADYGMESIIHELNAEGARLAREAAKLAEAKDGRRRFVAGAIGPTNRTLSISPDVNNPGYRAVTFDQVKQAYVEQVRGLIDGGAELILIETIFDTLNAKAAIAAAWQVFEETGIKLPIQISGTITDLSGRTLSGQTPAAFWNSLRHASPLTFGLNCALGAKEMRGHIAELSRLCDTLVCAYPNAGLPNEFGLYDESPEAMGKLVGEFAESGLVNMVGGCCGTTPDHIRAIAEAVADKTPREIPEIPRLMRLSGLEPFVLTKEIPFVNVGERTNVTGSAKFRKLITTXAITPPRSMSPAIRSRRAPR

SEQ ID NO: 16674 - protein, 666 aa, Magnetospirillum magnetotacticum
  unsure (1)..(666): unsure at all Xaa locations
MSVVPIRVLLLEDDPADARLVGQMLRRVKTTPFEVTVAGRLAQALERLSDETQHFDVVLADLGVPDSSGIGTLNALTQAAPRLPVVVLTGNDDDTIALEALKRGAQDYLVKGLGDAFILSRVVRYAIERKMGEEVLREARDSAEQAARAKSVFLAMMGHEIRTPLNGVLGMARLLLETDLDPRQKSFTETLVSSGELLLGLVNDILDFSRLDAEGMTLAVEPFDVLDTVEEVRLVLTSRVAEKDLTLTTRFGTGVRRVVAGDRLRLRQILFNLVGNAIKFTDHGGIEISVEPLAVERGQVLRFLIKDTGIGIGPEIGARLFTEFWQGDSGAARRFDGAGLGLAICKRLTDLMGGEIGYDSLPGQGTTFRVDLPLPPSEAPSAEPGKGVERPCRVLLVDDNEVNREVAAGLLERRGHQVVCARDGLEGVAAAARGGFDLILLDMRMPGMDGIETARAIRALPGAAAKVPIYLLTANPVKEDEARWREAGILGCLAKPFRFEHIGRLLAGLGEENRPPASPDPDLVEVAGLLSDLGDLGRDRMVGLVELFRSSSSADLAALRTHAKAGRLAEAGQLAHRMASAASSLHLGPLAAKCRAVEDATRADDPRTDAQAEELADLWTRSLAAVGXGFXGIFRPLTICPRYVTLRGHVTWASALGGPLCSIRPS

SEQ ID NO: 16675 - protein, 224 aa, Magnetospirillum magnetotacticum
MIFKSLREDIASIRRRDPAAHSWLEVVLCYPGLHALMFHRLSNWCWNRGMRVLGRFISHVGKILTGIEIHPAAQLGPRFFIDHGTGVVIGETAVIGADVTLYHGVTLGGTSLHKGKRHPTLEDGVIVGSGAQVLGPITVGKGARIGANAVVLTDVPPGVTMVGIPARMVMRRQDADFCAYDLPVEDLPDPVARAIDSVRSQVSTLMERIKELETELHAILLSLA

SEQ ID NO: 16676 - protein, 1156 aa, Magnetospirillum magnetotacticum
MANTFYRLYDGTLKPHRHFTMKMAAGELDMARKPKEAGGTSVAVRSSTKLGAEGEVSKKTRGRRSNLYVVGIGASAGGLEALPPFVAHLPTEANMAYVIVQHLSPAYRSMMVQLLARETKLPVEEIKDGTVLVANTIYITPPNKDVRVKNSTLWLREPSAPLGPKPSVDVFFASLAEDRGQHAIGVILSGTGSDGAHGMRAIKASGGLTVAQEPETAKYDGMPKAAIDSGCVDQTLPPDSIGPELSSISRFPRPVVNQKSEETKTQDTINEIFLLVRKRTEVDFTQYKLNTVRRRLERRMAANRIETLVAYLDFVQRQPAELDLLCKDILISVTSFFRDTKAFEDIKLTLSELLMTKRPGDSIRIWVPACATGEEAYSFAMMLTDLLGDACKSYKIQVFATDIDMDAMRHARKGTYSATTVDGLDKAYVSKYFDAMGQNYQIKKPIREMVVFARQDLIKDPPFVKVDIISCRNVLIYFNSDLQDRIFQVFHYALNPEGHLFLGKSESVGRCTDLFRSIKTTSKIFQKRMGGPRSANPVFGAFRLKPTESSETMLPLGGASIESIVRDGFVEACMPASVAINENLDIVYYHGDVDGFVRFPQGRPNQNLGKLIADDFRIDLRALVHRSRETSTVAMGSKRQLRTREGDVMSRLVVRPLHVESGRELLFLVSCEKIELISEGGAVEATTSPGNEIRLIELEQELTATREHLQTVVEELETSNEELQALNEEMQAANEELQSSNEELETSNEELQSTNEELTTVNEELQVRTSELAAANADLQNIQDNVGFPMLVVDKGLRITRFTPQAARLFGLLPSDAGQLITAVPSQFHVKDLRNLLVTVVSSGLSHEEIIDAEGRIYRMGIFPYRDLREQTAGAILTFIDETDLRNTQKDLEASIDSLRSTQGELKEAKNIAESANRAKSEFLANMSHELRTPLNAVLGFAQIMADEMWGSLGNDRYKEYIGIIVNSGQHLLALIGQVLDMSVIEAGRTTLRESNVNISDVIVTSMRLLSSQAENSEINLTASVPDDLPHMRGDLTAIQRILLNLLGNALKFTPAGGAVTLTASHDQSGVTICVRDTGIGISAHDLDRVLMPFEQGGQRILRKEREGVGLGLPITKSLMELHGGTLSIDSKEGKGTTACVHFPASRSLAAHDVMV

SEQ ID NO: 16677 - protein, 333 aa, Magnetospirillum magnetotacticum
MMMQEGRLLRLAESCRVKRQDFLDAYYGSELDPNWLEQVAQRSKQWKDFAARHGKDAADIRATIAEISGEAGLPISEYRRIVQTVQRGERESSRAKKEMIEANLRLVISIAKKYTNRGLQFLDLIQEGNIGLMKAVDKFEYRRGYKFSTYATWWIRQAITRSIADQARTIRIPVHMIETINKLVRTSRQMLHEIGREPTPEELAEKLSMPLEKVRKVLKIAKEPISLETPIGDEEDSHLGDFIEDKNAVLPLDAAIQANLRETTTRVLASLTPREERVLRMRFGIGMNTDHTLEEVGQQFSVTRERIRQIEAKALRKLKHPSRSRKLRSFLDT

SEQ ID NO: 16678 - protein, 257 aa, Magnetospirillum magnetotacticum
MISIEGAKEMKFEDKVALITGGASGIGYCTVKSMAELGADVLIADINVEAGEKAATELKAKGLKAEFVRLDVTDKANIARVKEHVLATRGRLDILCNVAGWGHIQPFVDNDDAFIAKVMSLNLTGPIELIRAFFPLMIEKKTGKIVNVASDAGRVGSLGESVYSAAKGGLISFSKALAREGARYNINVNAICPGPTDTPLLKSEPEKFLEAFLKVIPMRRFGQPQEVADSIVFMASNRADYITGQVLSVNGGITMVG

SEQ ID NO: 16679 - protein, 387 aa, Magnetospirillum magnetotacticum
MSGRKGVTILGSTGSIGCNTVDLVERNPELYRVEALVANSRVDILAQQAKTLRAKLAVVADEGAYGALKEALAGTGIEAAAGPEAVVAAARMPADWVMAAIVGAAGLAPTLAAVRRGAVVGLANKECLVCAGQLMMAEVEKHGATLLPVDSEHSAIFQVFEADQHDRIEKIILTASGGPFRTKTREFMADVTPEQAVAHPNWSMGAKISVDSASMFNKGLELIEAHHLFDMPEDKIDIVVHPQSVIHSLVAYVDGSVLAQLGSPDMRTPIAYALGWPNRIEAPVPRLDLATIATLTFEAPDPVRFPSLRLAREALRAGGSAAAVMNAANEVSVAAFLGRRIGFLDIASIVERTVAGVTHCELTSIDDVLAQDAEARRFASALIDGGR

SEQ ID NO: 16680 - protein, 318 aa, Magnetospirillum magnetotacticum
MSERSKTVGAYELRRATEAAARAAYAWIGRGDKALADDAAVAAMQTELDGLDLNGLMLIGEGPKDEIGMLYHGQRFGAATAEPAWDLVVDPLEGTSFLAKGMTNAMAVVAMAPHGTLFDPAPARYMEKLAAPPAAKGKIDPKAPVAERLAQLSAALNKPIEDITVYVIEKPRHKALVNAIHNAGARVALYPAGDVAGALMAAIPGSGIDALMGTGGTPEGLLSAMAIRAMGGEFLGRIDPQLATEAAAVEEAGMDLNHWYQLDEMVRSDKVVFCATGITTGLLLDGVERTRDQEKTQTLMIGGAAGPRQMLTSWHRRA

SEQ ID NO: 16681 - protein, 399 aa, Magnetospirillum magnetotacticum
MRWAEQREFSGLFHDPAVREDFAMTAKIARFLEEVRPQTPCVVVDLDVVRDNYHSLRRWLPLAEVYYAVKANPAPEIVRMLTEEGSRFDVASRGEIDLCLSNGTPAERISFGNTIKKQSDIAYAYAKGVRLYAFDSEAELEKLALAAPGSRVFCRILMTCDGAEWPLSRKFGCEIDMAKDLLVKARDLGLDPYGVSFHVGSQQTDLKQWDIAVGKAAMLFSALDAAGIDLRMVNLGGGFPARYRKEVDGIERYAEAVMDAMTKHFGNNIPAMIIEPGRSLVGDAGILETEVVLISRKGYEDDTRWVYLDVGKFGGLAETMDEAIKYRIVTGRDGEDTAPVILAGPTCDSADILYEKAGYEMPVSLKVGDKVRILSTGAYTTSYSAVNFNGFEPLKAYFI

SEQ ID NO: 16682 - protein, 431 aa, Magnetospirillum magnetotacticum
MLCHVGETLCRALGMAEPRLIGTRPGWVDGPDSCHTPLPGNQILVELAPEAEARLRDSLRVNLEMRAIIENTFEFIGLLSPDGRLLDANRTALSFIGLESIEPILGVHFAETPWWEHSPKERAMLKDGITRASAGEFVRFETTHIDAHGGIAYVDFSVKPVPDRDGNIQFLVPEGRDITQRKRAEAALVSAKQEAEAANRAKSQFLATMSHELRTPLNAVIGFSEAILAGAAGPASLERCVEYMELIHSAGQHLRALIEDILDVSRIEAGRTELDEEDCDPTELVRAAARLLEHKSVVSGVDFTVVIAPGLPRMRLDPRRIRQILLNLAGNALKFTPTGGKVGICATLVPDGLALVVSDTGIGIAPEHHAKIWQAFYQADSSLSRRHQGSGLGLAIVRHFVEAHGGTVSLDSAPGQGTRITVLLPTSRIIA

SEQ ID NO: 16683 - protein, 894 aa, Magnetospirillum magnetotacticum
MTKWVYSFGGGKAEGRADMKNLLGGKGANLAEMSNLGIPVPPGFTISTEVCTYYYGNGETYPPSLKDEVMAALAQVEGDIGLKFGSTADPLLVSVRSGARASMPGMMDTILNLGLNDKSVEGLAKRSNDARFAYDSYRRFIQMYSNVVLGVDHHNFEEILDEVKEDKGVSLDTELDADDLKKVVAKYKDKVAEQLGKPFPQDVHEQLWGAVGAVFGSWMNQRAITYRRLHDIPAEWGTAVNVQSMVFGNMGSDCSTGVCFTRNPSTGENAFYGEFLVNAQGEDVVAGIRTPQQLTIAGKNAQSSDLPAMEECMPEVFKELNAIRHKLEAHYKDMQDMEFTVQQNRLWMLQTRTGKRTTNAALKIAVDMAREGLISRKDAIKRIDPASLDQLLHPTLDPKAPRKILGRGLPASPGAASGKVVFSADEAEDWVKNRKERVILVRIETSPEDIGGMHVSEGILTTRGGMTSHAAVVARGMGTPCVAGAGEIRVDYAAKTLKVAGQVVKEGETITLDGSTGEVFIGAVATIQPELTGDFGTLMEWVDTIRTLKVRANAETPLDAATARKFGAEGIGLCRTEHMFFDPKRIIAMREMILAETEKGRRAALAKLLPYQRQDFIELFEIMQGLPVTIRLLDPPLHEFLPNSEAEIAEVAKEAGVEPSVVKARNAALHENNPMLGHRGCRLGITYPEIYEMQARAIFEAAVHVSRDTGRTVVPEIMIPLVGAKRELDLMKASIDKEAEAVFAEQKYSVHYMVGTMIELPRAALLAGDIAQTGEFFSFGTNDLTQTTFGMSRDDSGPFLEVYRAKGIYEHDPFASLDQAGVGELIKIAAERGRATRPGLKLGICGEHGGDPASIHFCQGAGLDYVSCSPYRVPIARLAAAQAALGGSSSSGTA

SEQ ID NO: 16684 - protein, 675 aa, Magnetospirillum magnetotacticum
MPFGGLESALAGMAVGAAATLLATGWLRRGPPKGTAQTLDAQRQLLEALGNSRDGVALYDSANRLITCNDRYLQMLSPIKDSIRPGARFEDLMAELAEAEKMEDGWLARKLSGGGLTDATAGDDKFRDGQWITVNAYATSDGGQLRILRDITQRKQAEIALEDTVSWLRGVMDTVVDGIVTIDETGTVLSFNPAAEHLFGWAAEQVVGRNVSMLMPDPHQGAHDGYIRAYFSSKSGKVGANGREVEGLRRDGTHFPMELAIAHMHQGDMLTFIGVIRDISERKRSEKALRDSTTRLSHQANRLQAIIDNMPQGVAVFASDDALIALNESAIRMLGLPKAEITPGTIDISLFMALLAANDTPPGHHSAQLTADLSESIRERPEMVFEHFTPSGLIMEVRSSSMPGGGLILSFTDITDRKHIEQTLREAKDEAERGNRTKNTFLANISHELRTPLNAIIGFSEMMKHEIFGPLEPASYRAYVDDIHESGMHLLELINDILDMSKAEAGMTDLMETAVHVPDLIRAAIRLLNRRAENAAISLTEDLPPNLPTLLADERRLRQIILNLGSNAVKFTDDGGAVTIGAKVTEAGFVIRVADTGIGMTPEDVQRVMEPFVQADTRLSRKYEGSGLGLPLAKALVIAHGGTLNLDSQPGRGTVVTVTFPPSRIIDQSGSGADI

SEQ ID NO: 16685 - protein, 543 aa, Magnetospirillum magnetotacticum
  unsure (1)..(543): unsure at all Xaa locations
MLCCLDRQGQAAFAMAEIIICYVRASGGNLSMHHGAGSAEFKWRHLIEAVEEFGQGFTVFDRDLNLILCNNRFLEMLNFPASLVHPGTVFADFMRFNALRGEYGPGDVEELVAERVDRARGFAPHCFERERPDGTVIEVRGTPLPGGGFVTTYTDITERKRAERMLIHAKDKAEETARIKANFLATMSHEIRTPMNGVLGMLHLLTGSPLTPEQRDHLETAQSSARSLLSIINDILDFSKLEAGQMKMESTRFDLYRLMEEMGALLKGAAMDKGLDLRLHIAANVPRHHCGDSNRLRQILTNLMGNAVKFTERGGVEVLVEALPDSRLRFQVADSGIGIDPAAASGLFSEFVQADSSITRRFGGTGLGLSXXXXXXXXXXGEIGFDSVPGQGTTFHVVLPFTPASDDGRAAAIEEQIPDLPPMAVLLAEDNPVNQKLTTVLLNRWGQQVTLARNGAEAIAALARQHFDLVLMDVHMPGIDGLEATRRIRAMSGPVSRIPIIAMTADALDGDAALCLEAGMDDYVAKPVDPALLLAALHRAVRR

SEQ ID NO: 16686 - protein, 478 aa, Magnetospirillum magnetotacticum
  unsure (1)..(478): unsure at all Xaa locations
MARYRALRPVEGERQANRRVPQDRCQPXXXRIQSLKKKGAPELVKQGLLGLDCRYLNHAPQCTGWMDLTSQGGSGSFEISWSGLWKLTTAATIPYYTGPYGKSQRGFGFVTIGANVDDFHAAASREKEHTDQILALRNRDLEAQYNAVMALITSQVESLARELSISTVIMIALVVGIAVWMASFLTRRITAVVGGIHRFSEQETEYRLPVQGHDEMASLAISFNQMADRIGESFVRLDEARKRAEEASRMKSEFLANMSHELRTPLNGIIGFSELIRDEAADDETRENADIIEKSSRHLLELVNSILDIAKIEAGAMTLAVQDVKLAPLVAEAASVHHSAAQAKGITLSSQVSDNCPETIRADPLRLRQIIHNLLSNAVKFTEKGEVSLSVELEPGHLIFRVSDTGAGIPEGMLHAIFEKFRQVDSFLTRSHSGTGLGLTLARHLVELMGGTIGVQSTVGKGTVFHFTLPLHQPESSS

SEQ ID NO: 16687 - protein, 460 aa, Magnetospirillum magnetotacticum
MSKETGSRRGWEPPYITPHRHDNSKFGRRAARDNCWEQIDGVDVEYLMSRYGSPLFIASERRLRENVRRVRGAFERHYRPVVHGWSYKTNYTSAICRILHQEGSWAEVVSAFEYEKARSLGVPGNRIIFNGPNKPRAILERAIAEGARLHVDHLDELELIERIAREKGEVVPVTLRLNFNTGYTDPWSRFGFNLESGQAHSAASRIKRSAHLRLTGLHSHIGTFILETRAYAEQVRLMCNFMKTVEADGECVIDAIDIGGGLPSRNALQGIYLPPEQAVPAVEEYGAAVCSALEECLADRVGPHPTLFIESGRAVVDDAVSLASTVVGTKRLPDGRAAAVLDAGINSMLTALWYHHPVKLTKPKAGDSADTVLYGPMCMNIDVMRHTVQLPPLSVGDCLVFNPVGAYNNTQWLQFIEYRPAVVLIHSDGEHSVIREAETIEDMNRHDRLPTHLQSPVDLP

SEQ ID NO: 16688 - protein, 337 aa, Magnetospirillum magnetotacticum
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 16689 - protein, 1193 aa, Magnetospirillum magnetotacticum
MPGVSADDRITSQEDGPGGRWRFGIRAKLVVAVGTVAGMIMVASLLTWFSYSEIERLLAAVTRTNLPSLSNALKLSEATARLAAAAPALDGSQSQFQRQSNFVALQQQTERLLVLVDHLAGSIADTGRVEELRSMIAAFADNVVDRNILVDKRLQLAERSRAQAEIISNLDVEVHRAMGGLIGDPALATVVLASNYLREAVVAGNLEKVGDLRSAYEEQVRYLAELVDAAGSRPPRTRELTRRVLALGTGPENVFELRTLQMLTIARLAAANDEGRDLVARTSSSVGRLVSAAEAEAAENERRTEAAVSSGRTTMLVVAMLTFFGPLLFIWLYLGRSVVARLAGLASSMHAIAEGDFQAPIPGQGNDEITDMAAELAVFRDAMAKLQESSEALIESERRLRRILDTSPLALAISRVSDSAILLVNPRWSELYRVPKARALGMTVASCYSDPANRLRLVELVKKRGFVGGFECRMRASDGHEFWAMLSAAEIEMDGEPAVIVSSTDITRHKEEEAALAEAKKVAEEASQAKSLFLATMSHEIRTPMNGVLTMAQLLEDMPLPAEQREMARVIRDSATSLLTIINDILDFSKIEADKLQLELVELSLSELVEGVADLLTIRAQEKGISLITFIDPALTDMVIGDPIRLRQIITNLAGNAIKFTDKGYVRISVRALDPRERPLRLEFNITDTGIGLDSEQQARLFEPFMQADVTISRRYGGTGLGLSICRRLVAMMDGEIGVRSNMGQGSTFWFQVPLEPADVAPEETPDLSGIAVLVLAEGPVAAECLRQYLGHLGAQVAVVVGAEGAVAAVRAAALAGWTYDVALLDDGQDFRMRLGVAGALMTAAGPDLELKVALLVAKEAFAAVASEIKAAGLYAALPKPIRRRQLWRNVAVAVGRAMPEAESADGVGAEEGWRPPTTEEAAAAGALILVAEDNPTNKVVIRHLMERLGYAIEVVGNGAEAWERMQIRDYGLLLTDCHMPEMDGYELTQRIREWEVETGHLLPIVALTADALAGTARRCLDCGMNAFLAKPIDLIQLDATIRRLLPVAVGLRRRRSGGEEAVAPPLAAVGVPLLGPVAADPSLPPVLDLTPMRQIFGDIGNEVRELLALFVDTTRPLVVDLGIALEAADALAAREAAHSAKGAGNSAGAFRFAKLCAQAEAACAASDLATVSALYPALEVAFDEAAAAIAAI

SEQ ID NO: 16690 - protein, 617 aa, Magnetospirillum magnetotacticum
MTARDEVLAAFDAGATDVIHKPFDPRELVSRVSVHTANALMSRAMRLDNTRMVNELAEAALLMTSVLPRTETLKAIRTAAGIAFDWFSRPCSAVGGDLWQAWLLGGGKVALFFGDVSGHGIGAALRAFSTHSVLSPLPSFADDPLKMAALLDCRLVSVDRDHHHFVAGVYGVFDRVEGCFSYVAAGLRNAVLLRADGRREALKLSGLPFGLTEDAGRQLGRVAIGKGDRLLIYSDALVEQAAEGSMTETALAGWIEEQVARAGETGEAEVARHLGKTFLASNPDCADDLLLVSATFPDYPVLVNGRPLHPFTGPAELLPGHGASLLVVDDMPMNRKLLDTMLKAEGYAIAEAEDGLVALERLQAEPERFDAILLDRQMPRMDGMTLLRHLKSDIRLAQIPVIMQTAFGSSEDIAEGIQAGVFYYLVKPLQLQILSSVVKAAVADHRRAQKLRTDLRRQSGTLALLEQGEFAFRTLAEADWLAVALASLCPWAPDVVTGLSELMVNAIEHGNLEISYQEKTEFLTSGRLIEEIEARLARPDLGDRRASIAVSREPQGLRFTVRDQGPGFDWRPYMDISPERAFHSHGRGIAIARRLSFDTLAYHEPGNVVEVAVAMPS

SEQ ID NO: 16691 - protein, 425 aa, Magnetospirillum magnetotacticum
MNTDLEKRVLRRISWRIVPFIMLLYFIAYIDRVNIGFASLTMNKELGFSSSVFGFGAGIFFFGYFLFEVPSNLILNKVGARLWITRVMITWGLISGAMAFVQSSTSFYVMRFLLGAAEAGFFPGIILYLSYWFPARHRAGVTAFFMAAAPISTALGSPISAALLEMNGVMGLAGWQWMFIIEAIPALILGVVVFFFMTDRPEKAAWLADDEREWLVNAMNEEAAAKSGHAKHSVWRGLADPRVLALALIYFGTSAGLYTLGIWAPQIIKQLGVSSMTVGLLNMIPPTVSVVAMVLWARHSDRTGERTWHVVGACLVASAGLVFAGNADGVVTVILALTLVNIGISAAKPPLWSMPTMFLSGSAAAAGIATINSIGNLGGFAGPAMIGWIKDLTGSFMGGLYFVAGLLAVSAVTTLLLARSQRNIG

SEQ ID NO: 16692 - protein, 657 aa, Magnetospirillum magnetotacticum
MMGDSQNGAPSGHDIQMTMMQGVLDHLDQGISVFSADLRLVLWNRRFADLHEFPDGFLTHDLAFEDIIRFNAQRGEYGGHYDVEDMVRHRVDSAREFRPHRFERTRPNGTILEIIGNPLPGGGFVTTYSDVTVNRQIAENLRGSNDRLDQMVERRTRALQDSEERHRAYGEFLEATVQHMPQGVCLFDNALNLVVANKIFFDLTQIPDSFNVKGINFYEFMLYNAQRGEYGPGDPEELARQRQEIAARMEPHAFDRTRPDGTVIEVRGNPIPGRGFISTFTDITERAKAEEALREAATMARAMLEAPGLLVLLIRMDGTIVDLNEEAAVGLGSHKDAMIGTNIFNAMPTKVAERRFALAQQAILEARAIYFEDERDGRWFETTMTPYPMDQDGIPRVMVIAHDVTHRHHAEQRLREATAMAQAANRTKTDFLAAMSHELRTPLNAILGFSEIISREMFGPVGERYRTYGQDINAAGQHLLAMINDILDISRIEIGAFTLCIEPVDPHELAYSCLRLVGSRAEAGNVDLSEDMPESLPHLMIDSRRTKQILINLLGNAVKFTPPGGKVTLRGETRDSGGIAFHVIDTGIGMSEADMAVALSPFGQVDTGLDRRFEGAGLGLPLAKSLAELHGGSLEITSIPGKGTTVSVYFPASCVAG

SEQ ID NO: 16693 - protein, 496 aa, Magnetospirillum magnetotacticum
MPLTPELDPFKLAKALSGKHLIGGKFVPAKGGKTFPVDNPATGEEIGTAAFGTKADVDAAVANAKAAQKEWAKQSARARGKLVAECGRVLSAHVEELGRLVALETGKALRTESRVEAGVLADMFVFFGGLGSELKGETIPFNPDMLTVTVREPVGVVGCIIPWNVPLLLMAMKAAAALVAGNAVVVKSAEEAPLTVLRVAEIMNTVLPPGLFNMLSGFGPECGAPLVEHPDVKKVTFTGSVETGRIVYKAAAEKLIPVTLELGGKSPMIVCADADMDQAVAGALAGMRFTRQGQSCTASSRLFVHESIHDEFVARVKAKVDAMVMGDPLDEKTDIGTIVSDGQLERVKSYIKLGEETKGATKHVCSAMPTDPKLAKGRFVQPVIFTGMKNSDRLCQEEIFGPVCAVIKWTDYEDVLAQANDSEYGLAASIWTRDFKVAMDATRRLEAGFVQVNQNLVVQPMLSYGGVKTSGIGKEASLESMLEHFTHKKTIIFNMK

SEQ ID NO: 16694 - protein, 607 aa, Magnetospirillum magnetotacticum
MRPWWTHGRGRHIWTPVRVPPVLAAVVHDILGSANWSRPARPGTPISIYLPVRKLRRHPGAPRPCQSIEIASLIDPDLPTWLRGDPGRLRQILMNLAGNAIKFTTKGGIAIEVGGEDGPSGRKLVRFDVRDTGIGIPEDAIGRLFSMFMQVDASTARRYGGTGLGLAISKRLTEMMGGTIGVESTPGVGSLFTFSLPFEVVEGAPASRPCLEGRRVLVVDDSPINRDVLERQLRGFGIHAVSCPDATSALEEIRRAAATQEPWEAAILDARMPGISGMDLAGLIRNEPALGGLKLVIASSQGLAAGDSPASADAFIHKPLRRQTILGILARVLGIAHDAALPDSAESEPAAPQQTGVRLRILVAEDNPVNQQVAVGLLRKLGHSVDVAADGAEAVEAVRARPYDLVLMDVQMPEMDGLQATNAIRALSGPPSRIPIVAMTANAMRGDDKMCLDAGMDSYISKPIDRQKLMDVLAHYSGTLPAASSAPSETPTQPAVDIAVLDLLTEDLGVETVVEILAKFFEDATSRKANCLAALTQDDRDVVRREAHAVKGAASSLGLSAVRQAAETVEAAVRAQAPLAEPVAALAAVIERIPALLAGSAYALPTD

SEQ ID NO: 16695 - protein, 767 aa, Magnetospirillum magnetotacticum
MNQQTPVEPKRMTPVLRMAVLSGVKASVQLHLRLGGAVDAVDDKGRTPLILAASRGHAEICRLLLDAGADLARIDMEGKDALQAATAKGHHAVAELIRASAASLSAPTPVPVAVVDDPDARDAGGGVRAGPPTSEPVPEEAETEPVVDVIEAVEPDPVPEAAPVGAVAEPSTAAPEGVAGELVPADVSSFSHSRHDAEEFDLSGWEEEKDSPPPPADPTCADRADELQRRLSLHVPIDLDAGWDDVDIDLPDILVSVRRRAKLDGDEEAALRELVLVAVADGRIRGEFLALVAPRDQDDPDVPDPDCLANLRVMLGDMGVVVDDDPFSPDRPSETGASDDEDDRFQDEVAEGLAFLRNLNSNRADPLTHYIGGLPRDRLTRDDEASLAMEIERGTKAALAAVAMSPAAVSELLTAVEAVIRGETPPQDVLESDDEEREDDDDAVLDEDGGPGVDGDDMLTGHPLQPELMFRLEAIRDLCRRLSQGQDGGFAERLGDRLAALGLSHAFVARLRRAVETDPSGGEARRRMEAGLETARRARERFALANLKLVVWGAKKFGGLTWPDRIQEGNLGLLKAVERFDHRRGAKFSTYATWWIKQAVTRAVADKGRTIRIPVHAQEAMRKLRRAQNEVFALTGREALPEEVGELTEIPLARVRRFLAVAEEPASLDVEEVGLHAAEMASREPDPEERLAVAEIKAMVRGQLELLPPREATVIRLRFGIGCEREYTLEEIGQQFGVTRERIRQIEAKALRKLSHPGRIKALQGCR

SEQ ID NO: 16696 - protein, 489 aa, Magnetospirillum magnetotacticum
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 16697 - protein, 1008 aa, Magnetospirillum magnetotacticum
MVWRLPPFPRPPSACTMGRGDQGWDPPVMAYARFVGWIRVLPIAWRIPLVVALNVCVALAVGGLGWHAASVMDSDLDELRTVQHRTSALAEIDIRASRLQGMIRQYLANPTDDLLKDAMRRSEELFVAMGDATAHEKPLSEDASAMHQAARRFVSGFQTLKAINADILRLYESDVLQSTSEMSGLYAILNSTARSRGNDPLSPALVKSHENFVEALISINAFYFNGVGAGAINAHASLQRVTDTVPALTQLASSDLQRDALAVIGTRARTLSAAIDAIARGFDERSRILTDEVDASQAVMSAAIDRLTIQGRDREEKLQRRSRHQLLRLAVAGAGAALVLLLVGAWVSWMIGQSIRSPLQRLRETMEAGAGGDWSREVEGRELQDELAAMARTVEVFKRNSMEKQRLEAERAEAGRRAEEANRSTLQDLLAQMEAHEHSSSFAQPVAAAPETEAAEIAAAFNRVLAKFHEANRGRDSAIQALTIAKESAEAANVAKSAFLAAMSHEIRTPMNGVIGMIELLDHTELDSDQRDLVSTTRDSGLALLRILDDVLDFSKIEAGRLELEQEPVRLDRMVDSVVQTISPAAAAKSLSISTFVDPGLPPLVLADPVRLRQILFNLAGNAVKFTAQGLVAIHVGRCGTDEQGRVMVSIRVVDTGIGIEDALRDRLFQPFTQAESSTTRRFGGTGLGLSITRRLVDLMDGTAGFESEPNVGSSFWCRLPLPTAEDAAPDNLAEQTEAAFMGLRILIVDPDTEERTLAALVTEQGGAAVVRVPGPREAEAASAKATATQAPFDLALIAADSLSPGQLAPMGTTPLLFIGGRDGAERFQLERLPNCLGFLGRPLSRAQIVAAVTRVVGPSAQPRPASPPQPPPAPRPTSWTGAPILVAEDHPVNQQVIRRQLHLLGFAAEVFPDGSAALAAWRARPYSLVLTDCHMPIMDGFQLTAAIRAEEEGKGRHTPILALTANALAGEAERCLEAGMDSYLSKPVELPQLQEALTNLLSDYAKG

SEQ ID NO: 16698 - protein, 289 aa, Magnetospirillum magnetotacticum
MTQPTPGRLTLIINQDRESADFADGLWAELRHEAEEALARTPVLRRLFIDSILEQPSFESAVFHRISQRLKNEVVTLPLLTETFARSVTADRSIAQALRADIAAVLDRDPATQRFIEPFLYFKGFHAVQTHRLAHWLWNRGERDFALYLQSRSSDVFQTDIHPAARFGQGVFLDHATGLVVGETAVVEDDVSLLQNVTLGGTGKESGDRHPKVRQGAIIGAGAKILGNIEIGAHSRIAAGSVAVMAVEPHSTVAGIPARIIRTTNDPETLRTKEEILKALSYESFDYSI

SEQ ID NO: 16699 - protein, 1179 aa, Magnetospirillum magnetotacticum
MRSTQIRIVVRLIAGFSAMLLLTVVMAVMAGRSMLIMADLANELYIHPFAVTNALIQVESQINAIRAASLTMIYGRSPSDVQRMLSLIAIHENEMAASMAVVKGRHLGDPDDVNRLSNELAQWKQIRDLNSLYCQTGEFDKAAENFLHNSAPQIALLRRHTAALYAFAQDKAAEFNHSIGDRRDQVIRDILLTLFGLLLLGALLARLITRSIVVPLGELREAMHRLANGDLDAHIPNRSRVTEVSRMAAAVEVFKQAALRLESERWVKDNVARLSPALQQTETIAEFAATALDFLVPLSGAGVAVFHARPGGATRFIRVAAWGLAPGSDGSPGLTSFAPGEGIAGEAARSGNSIHIAAPPESWLRVASATGMGAPAAVLAVPVMSRGAALAVMEFASFTPFTDDQRAVIEAALPMLALNIEILERNLRTRDLLEESQAQAEELKASEEELRAQGEALQAANEELRVSEEELKVQQEALQSANEELRLNAEALEARGLALEEARTEADRRAIEIEQASRYKSEFLANMSHELRTPLNSVLILARDLADNETGTLSDDQVESARIIHESGAHLLALINDVLDLSKVEAGKMSLDPVTIATADLAQVIRGRFGPVAADKGLEFTVESAPDLPRTMKADRGKIEQIANNLVSNAIKFTPEGGVAVRLALDHDGQALALSVADTGIGILPEDRQRVFAAFEQADSSTSRQFGGTGLGLTISRRLARLMGGDITLESNGDRGSVFTLLMPLGGPVPQPAPPPCAPEPPPESIAAPQAAEEAQAEEPQAEGRLLLVIEDDPIFRRVVCDMAKAKGFTTVTAEDGKSGLDLARLRRPCGIVLDIGLPGMSGWEVIETLRRQPETRDIPVHVISAGDERAKAAGMGTVGHLTKPVSREQINSAFEVLLRAGNTLDRRRLLLVDGDGASRASVRETLLGLNLDITVEETGEQALKRLAEGPFDCMVLDLALPDMPGGEFLERAERTPSGLPPVIVYSRQELSQDETVRIQEFTDSIVIKGARSSERLLDEVGLFLHAVEARKSGKSKSPTPTEPVDGILAGRTVLLVDDDMRNAFALSKVLRTKGLKVLIAQDGTKALSQLRSRSDVDLILLDIMMPGMDGYQTMGEIRKDPRYAHLPIIALTAKAMAGDRDRCLASGADDYLTKPVDVELLRKAMAGLMTRGHHAEPE

SEQ ID NO: 16700 - protein, 363 aa, Magnetospirillum magnetotacticum
MASSVSQPGMQAARMIGSLRACQTWARVAPIRCSPSKSNGFLLIDAGKSGSWHAWHGKVCAPILVGPDMRAVILLALLVLVWGCNWPIMKIGLAHIQPLWFCAFRLGLGALSMFVILVPLGRLRLPPRGDWPVLASLGLLNMAAYLVLSNLALLVVPAGRSAILAYTTPLWVAPGAALFLGEKLTRGRLAGVLLGLGGILVLFNPLSFDWSNGELVIANLMLLAAALVWAAAILHVRGHRWCSSPLDLAPWQMLVGLVPVTAAAAIFEGAPRPDGSFELAWTLAYNGTLATAFAFWAAVTVNRLLPALTVSLSFLCIPAAGLVFSSLLLGEGLTLTNIAGLLLIAGGVGLVALVGARERRAPS

SEQ ID NO: 16701 - protein, 292 aa, Magnetospirillum magnetotacticum
MSVANLPVVAGDDGLAKYLRDIKEFPVLAPEEEFMLAKRWVDYEDTEAAHKLVTSHLRLVAKIALGYRHYGLPVADLISEGNIGLMRAVKKFEPDRGFRLATYAMWWIKASLNEFVLNSWSMVKIGTLAAQKKLFFNLRRIKSRLRLLESGDLAPEHVTTIARELDVDERDVVAMNRRMAGRDSSLNTPVGEGGAEIQDLMADEADNQETSLAKREELSKGRTLIARALDSLTEREREVFVERRLRDDPLTLEELGGRYGVSRERIRQIEVKAFEKVRDLVQAGFLPAPARA

SEQ ID NO: 16702 - protein, 466 aa, Magnetospirillum magnetotacticum
MTAFTDYKVADISLAAWGRKELDIAESEMPGLMATREEFGPTQPLKGARIAGSLHMTIQTGVLIETLKALGADIRWASCNIFSTQDHAAAAIAAAGIPVFAIKGENLEEYWDYTHRIFEWADGGCPNMILDDGGDATLLIHLGMRAEKDLSVLNNPTCEEEDVLFASIKKKLATDKTFYTRNGTAIKGVTEETTTGVHRLYEMEKKGTLLWPAINVNDSVTKSKFDNKYGCRESLVDGIRRATDVMLAGKVAVVAGFGDVGKGSAESLASQGCRVIVTEIDPICALQACMEGYEVATMEEAAPRGDIFVTTTGNVDVITVDHMRAMKDRAIVCNIGHFDSEIQVAGLKNFQWTNIKPQVDEIKFPGGNRILLLAEGRLVNLGCATGHPSFVMSASFTNQVMAQIEIFTNPGKYEKKVYVLPKTLDEKVAKLHLAKLGATLTQLNKKQSDYIGVAVEGPFKPETYRY

SEQ ID NO: 16703 - protein, 598 aa, Magnetospirillum magnetotacticum
MTTRGGSKIVGRSKAVPHTGPELVRDGLGVSRGIAIGTVYLHDAGTITVPELRIPAARLDAECARFNEAAANAGHQVEQLQDKAGRLGGSAGEELGYLLDAYRQMLHGSRLVRGVEARIRNDRINAEAAVQQEINEIVRGFEAMDDSYLAARVADIKDIGRRLLRALTNTAYRPFTALPKNAVIVAEEMTPADTALLDPALVAGLATVVGGSEGHTAIMARSLGLPSVLGMAELLVGVKGGEQIIVDGTSGLVVINPRPETLAFYRKERAAFLKARRILGRLKDVPAVTRDAARITLQANMELPGEVGAVLESGAEGIGLLRSEFLYMNRDDVPSEDEQYLILKDVVERMGGRPVTVRTFDAGGDKLAPALGCTIGPNPSLGLRAIRLGLARQDLLEAQLAAILRASAHGPVRILIPMIATVGELRATREVMNRVIRRLRKSGVALPDPLPKLGAMIEIPGAALSADSIAWHADFFAIGTNDLVQYTLAIDRSDEAVAHLYNPLHPAVLRLIQFTAQAAHRANIPVSVCGEMAGDPRYAPLLLGLGLRDLSMTTSNLPVVKSRIRALELAAAEGLARTIMEQTDSGRIGQLLDAFLAR

SEQ ID NO: 16704 - protein, 1043 aa, Magnetospirillum magnetotacticum
MEEELRAANQESRRQAKAHLQAILNTVGEGIVIADQTGTVVSVNPALLSIFGYERDEVIGNNIDMLIPLAALKAAGSSGMERIFDLGRESMALRRGGTSFPIELAAGDLTPTGSAQFVVIMRDISERKRIEREMAESEERFRDFAQSTSDWFWEMGPDLRFTGFSGQFTEHTRALPSHYVGHTRDEMISDDTPMEARLQNLADMEARRPFRDFVYHTKNMDGPGRFLRVNGKPVFDPSGEFKGYRGTASDITEEIEAADRLKASQAEIERLAERNNSILESVDDGIVGIDLNGRATFVNRAAAKLLDFEPAELVGSDILPLMALDMETAESLYQILLRLADSIRDDTASFKRRDGSPLPVEYIASPVMDKGNQVGVVLGFRDITQRRLVERQLREAKEAAEAGNRTKSEFLATMSHEIRTPMNGVIGMTGLLLDTKLTEEQRHFAETIRDSGESLLTVINDILDFSKMEAGKLDLDYTEFELVPLVESVVDILAPRAHAKGIEIASLIDPRLRMLVRSDPGRLRQVLMNLGGNAVKFTEKGGVSIEVTLLERPGAQPMVHFDVRDTGIGIPPEAQGRLFSMFMQVDASTARRYGGTGLGLAICRRLAELMGGEVGLESQPGKGSRFWMSVPMELLAPQSAAPPDLTGHRVLVVDDNPVNCDVIERQLRAFGVEVHACLDAGSGMGELTRAAAMGTPWEVAVIDSQMPVVTGSEMVRMMRAIPMLGGSRIIVTSSQGMPAEQQDGQPAIDAFLHKPLRQSTLLDTIGRVLGLSGPEEQPAAPAEEHNAPDSTAKRLRILVAEDNPVNQQVALGLLRKLGHTVDVVGDGAEALEAVRLLPYDVVLMDVQMPEMDGLEATRAIRSLASAAARIPIVAMTANAMRGDDQMCFDAGMDGYISKPIDRHKLAEALAKYSGAPEPKPAEPTSAQDSKAVDLDVLDALAADIEADTVVEILVKFMEDARTRHANAAVAAPEGDLEKVRREAHTIKGAAASLGLMAVRDACLALEQAARAGEGVAPLVVQLHDRIEALPGQLSTTAYALPPS

SEQ ID NO: 16705 - protein, 397 aa, Magnetospirillum magnetotacticum
MSPPATGFLLRCADNGRVHSILHDGMGLDAAIVGLPFTAVVHSAGVPKALDFFSGVMRDGAQYLWEIPVTPAAATMVFLGARTEEGVLIAACATQDDVGRFVSDLERINAEQASIIRDLYATRKTAATPTAVGLDDFIRLNNDLTNAQRDLASKNAELARSVEWRNLILGMAAHDLRNPLNTIGGFAELLQERIGETLPVMEARALDHIRQASGYMLRIIEDFLDFSRIETGHFTLESEPVDILSLAIEVAERITSFADEHAVSVQVKAPAPIPIVPADRNRLAQVLSNLIGNAVKFAPNGSIVTVSIVFHEPSDTVSVRVQDQGPGIPALERDKLFRPFSRTSAQSVTGEPGTGLGLAICKSVIDAHGGKIGLDGTVTDGAAFVFELPASRRPKLA

SEQ ID NO: 16706 - protein, 425 aa, Magnetospirillum magnetotacticum
MTAIIDIHGREILDSRGNPTVEVDVVLETGVIGRAAVPSGASTGVHEACELRDGDKKRYLGKGVQKACDSVNGEIYDALSGMDVEDQILIDKTMIDLDGTPNKSRLGANAILGVSLAAAKAAAEESGLPLYRYVGGAFASILPVPMMNIINGGAHADNPIDIQEFMIMPVGASSCSEAIRMGAEVFHALKKTLKDAGHNTNVGDEGGFAPNLKSAEMALDFIMKSIETAGYKPGDDIMLALDCASSEFFKEGKYVMAGAKKTYDQKGLVKFYAKLVGSYPIISIEDGCAEDDLVGWELLTDALGAKVQLVGDDLFVTNPERLSMGIDKGLANSILVKVNQIGTLSETLEAVDMAHKAGYTAVMSHRSGETEDSTIADLAVATNCGQIKTGSLSRSDRIAKYNQLIRIEELLGSAARYAGQTIMKR

SEQ ID NO: 16707 - protein, 485 aa, Magnetospirillum magnetotacticum
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 16708 - protein, 585 aa, Magnetospirillum magnetotacticum
MDGGQGRRGRSHESRHIHLCERGQGPVRQHPRHGVRGARPDRIPVLLHDPFARRPDPDRHARRHRRRQARRRGGDRGRGRRTPDQFHRRRRNLFPAELNAMIKHLINGKHVESASTIANLNPATNEVICQIAAGGEAEVARAVAAAKEAFPKWAGLAPAQRAKLLRKVGDLINQHVDEIAKLESLDTGQSYWRTKKMLVPRAADNFYFFADTCQHVDGETYPTNDHLNYTIYQPVGVVGLISPWNVPFMTATWKTAPCLAFGNTAVLKMSELSPLSADRLGQLILEAGIPAGVFNIVHGYGSAVGEALVKHPDVRGVSFTGSTATGNRIIQSGGLKKYSMELGGKSPNIVFDDCDFERAVDAAIVAVYGNNGESCTNGTRILVQDGIYDRFVAALAERTKKVVVGDPLDEATNVGPMITRDHWKKVTGYIELGIKEGARVVAGGLGEPEGLPAHLKNGNFVKPTVLADVDNSWRVAQEEIFGPVACVIRFKDEAEALKIANATTYGLASYVWTENGAKAIRMAEGIEAGLVFVNSQNVRDLRQPFGGIKGSGTGREGGHYSYEAFLEVKNVCVSKGNHHIPRWGV

SEQ ID NO: 16709 - protein, 315 aa, Magnetospirillum magnetotacticum
MSAVTSNLPQRDAFWTRVYEIARQDRDVIIISADMGAPALDKIRLDLPNQFINAGIAEQNAIVVGSGLAMAGKKVFAYAIAPFITLRCLEQVRVNNCMMKIPLTLVGVGAGFGYQDSGPTHHMLEDIAVMRAFPTIEIDSVSDSVMAADVAERSIKERRINYVRLDRQTLPDLYKAGHDFRPGLEVLRPGKDIMLVGTGIMTHAALETAEVLAKKGIDAGVVDLYRLPVNAQALLAAVKGAKKVATLEEHFLPGGMGSAVAEVLADAGATVPLKRLGLPVEKGYCYTYGGRDALHNWYGIGAQQIIDSLVGFAKG

SEQ ID NO: 16710 - protein, 401 aa, Magnetospirillum magnetotacticum
MLDGRRVLLIISGGIAAYKSLELIRRLKDRGCSVRSILTKGGANFVTPLSVAALSGDKVYQETFSLTDEAEMGHIRLSREADLVVVAPATANLLAKMAAGIADDLASTALLATDKPVLVAPAMNTMMWEHPATRANMATLEARGVTRIGPGAGDLACGEVGAGRMAEPAEILAAIESQLSDGPLKGVKAIVTSGPTREAIDPVRFIANRSSGKQGHAIASALAALGAEVTLVSGPVSIPDPTGLAVVKVESAVQMLNAVRSRLPAHVVVCAAAVADWTVANRATEKRKKKVGDPPPTIELTPNPDILMTVSKAEGPLRPTLVVGFAAETEKLMEHAADKLARKGCDWIVANDVSEGTGTFGGDANTVHVLDSDGVESWPAMGKEEVARKLAERIAKALGKA

SEQ ID NO: 16711 - protein, 296 aa, Magnetospirillum magnetotacticum
MTAIASSLSLAPEGNLTRYLQDIRKFPMLPPEEEYLLAKRFREHGDLPAANRLVTSHLRLVAKIAMGYRGYGLPLGELISEGNVGMMQAVRRFDPERGFRLATYAMWWIRAAIQEYILHSWSLVKMGTTAAQKKLFFNLRKLKGQMQAIEEGDMSAENVAKIATKLEVTEDEVITMNRRLSSPDHSLNAPVRTEGEGEWQDWLVDDHEDQETELGEREEMGQRRGMLTSALAALNDRERAILIQRRLTEDPATLEDLSQRYGISRERVRQIEVRAFEKLQKSVKTASAQAEAQNRA

SEQ ID NO: 16712 - protein, 330 aa, Magnetospirillum magnetotacticum
MSIHTATLPVLDRNLALEVVRVTEASALAAARQTGRGDERAADEAACSAMRHALNGLSMDGVIVNGEGDDSTQPLHTGEKVGNGKGPKVDIVLTALEGRSICARGAHNALSVVAMTEEGSFLKVPQHSYMEKIVVGAGMPSSIIDLDSTPEENLSRIAKAKGVTLSELTVSVLDRPRHGELIERLYAAGVRVMLFDDGDVSGALAAGLPDSGVDVYMGSGGAAQGVLAAAGLKCLGAQMQCRLLCRSDQDHAAARRVGIADTRRKWNIEDMVRGEVMFAATGITDGHVLKGARLAPNNRAESHSLVMRSVTGTIRYLSVQHDLSRSHLPA

SEQ ID NO: 16713 - protein, 756 aa, Magnetospirillum magnetotacticum
MQSAGMTSVSRRLLGRLRDVMAGSGSAQDRLDKVVKLIAADMVAEVCSCYVMRAGEVLELFSTEGLKKESVHQTRLRVGEGLVGDIAAHARPLALADAQIHPNFVFRPETGEEIFHSLMGVPIIRGSRVVGVLVVQNRTMRHYTDEEIETLETVAMVLAELLVSGELVNRAELVPVDGNALLPLRMEGVKLNGGVGVGVAVLHRPRITIQRLVAEDPDAELERLKKALTGIKLALEELFSRPEMRDGEHRDVLETYRMFAEDKGWLNRISEAIRTGLTAEAAVQKVHDDTRARMNQITDPYLRERMHDFEDLANRLLQHLAGGDDQRPGAADLPEGAILIGRNLGPMELFDYDPKRLRGLVLEEGSATSHVAIVARALDIPVVGRVKDVLDKIEPLDPVICDGDNGQVFIRPPDDIRETYIDAISQRQMRLAVYARLREMPAVTRQGVRIGIHMNAGLLLDLQHLHDSGADGIGLYRTELPFMARSSLPDVAAQTLLYKKILDQAEGKPVVFRTLDVGGDKVLPYWNPYEEDNPALGWRSIRITLDRPAVMRSQLRALLRAAQGRELSVMFPMIAEVSEFVQARHILDKELEHERQIGNPLPSKLKVGTMLEVPALALQLDALLPMVDFVSIGSNDLTQFLFAVDRGNPRIAERYDSLAPAMIRFMRYVSVKCAQYKVSLSVCGEMAGRPLEAMALIGAGIRHLSLSAPNIGPVKTMVRSLDIAALEAYLNSLLKSPDHSLRNKLKTFALDHGVVL

SEQ ID NO: 16714 - protein, 391 aa, Magnetospirillum magnetotacticum
MPVSGAPTSLSPLRPRPVSTHCSTTSMPISPARPPRPETSTPPAWTSWRAGGSGRGPMPRNPVWWTVWAAGPRPWPSCGRSPGSRPTSRSPWWSSPARASRGKFWPKAWAAAGWPSGASCPASSPAECAVPRARRPVARPRSEGATMSDVKTVVVTGASRGIGHAIARRFLAEGWRVITCARADVPKECMIDRNWACHIVADLAEPASAQDFVAKANAWLGSEPLHALVNNAGVSPKTPYKERLGVLNGSIDGWKDVFELNFFAPLRLARGFASALHRGKGAIVNITSIAGHYVHPFAGSAYSTSKAALSGLTREMAAEMAQLGVRVNAVAPGEIRTEMISAEYEALVPRIPLERMGTTEDVAGTVFRLCGPDFAYVTGTEVFVTGGQHLY

SEQ ID NO: 16715 - protein, 424 aa, Magnetospirillum magnetotacticum
MNHFHYSNGTLFAEDVAIARIAREVGTPFYCYSTATLERHYTVFAEALKSAGLDATICFAAKANPNMAVIRTFAQLGAGADVVSEGELRQALAAGVPAARIVFSGVGKTRHELEFAVAKGIFQINVESEPELEMLSEVAAARGLVMPIAIRVNPDVDAGTHAKITTGKKENKFGIEWTRAREVYARAKALPGVEPVSIACHIGSQLTELDPFREAFLRVRDLVAMLRADGIDIRRLDLGGGLGVPYDDETPPEPKAYAEVIKASLGDLGCRFIFEPGRLLVGNAGILVSSIIRVKEGSTRTFLIVDAAMNDLARPSLYDAYHSIFPVAEPKAGAPLAEVDVVGPVCETGDTFARQRRLPPMRAGDLLALGTAGAYGAAMSSTYNTRPLIPEVLVKGADYAVIRARPSYEDMRSLESLPGWLSDD

SEQ ID NO: 16716 - protein, 506 aa, Magnetospirillum magnetotacticum
MLYASPNTSGAKVQYKAKYDNFIGGKWVAPVKGEYFDVITPINGKAYTKAARSGAEDIELALDAAHAAADAWGKTPPAERANILLKIADRLEANLELLAYAETVDNGKPIRETLAADIPLSVDHFRYFAGCLRAQEGGMSDIDENTVAYHFHEPLGVVGQIIPWNFPILMAAWKLAPALGAGNCVVLKPAESTPISILILAELIADLLPPGVLNIVNGYGREAGMPLASSKRIAKIAFTGSTSTGRVIAQAAANNLIPATLELGGKSPNIFFPDVAQADDGFFDKAIEGLVLFAFNQGEVCTCPSRALIHESIYDKFMDRVLGRVAAIKQGSPLDTDTMIGAQASKEQMTKIMSYLDLGKQEGAQLLIGGERAYLGGELNDGYYIQPTLFKGHNKMRIFQEEIFGPVLAVTTFKDEAHALELANDTLYGLGAGVWSRNGNVAYRMGRAIKAGRVWTNCYHAYPAHAAFGGYKESGIGRETHKVMLDHYQQTKNLLVSYSESKLGFF

SEQ ID NO: 16717 - protein, 183 aa, Magnetospirillum magnetotacticum
MARPNTLGKRHFPLISDEGLISACRLNGKGQRNIRKKACDRSTVIRLSARLRYRRTPHRDDGSLELHGDPKMKLIMAIIKPFKLDEVREALTPLGVQGLTVSEVKGFGRQKGQTEIYRGAEYVVNFLPKVKIEVAVNDDLVDRVVEAIQTAARTGKIGDGKVFVTEIQQAYRIRTGESNAEAL

SEQ ID NO: 16718 - protein, 442 aa, Magnetospirillum magnetotacticum
MTRRRVMTWDGGVWRGLGISRGISQRSGPPISYARRPDDTSGRNLRPLDGRKRGRAPYGTGAKGARARPAIEGAIMSLPVRLLYLVSHPIQYQAPLLARLAAEPGIALRVVFGRTDTEGGYFDSGFGVRLAWDVPLRQGYDSVALAETDLRTEILKADVVWLHGWGSSMLLRALALAKVEGRPVLMRGENQDQAMPDGKGLRGWAKRRFLNWVFARTAAFLAIGSANRDYYLRRGVAPEQVFHVPYAVDNAAFAAGAAAADLAGLRRELGIPEDSQVVLFAGKFQRRKRPDLLLDAWERMAAPRPVLLMVGDGEMRAELEARRATGIVFAGFRNQSELPALYAMADAFVLPSESEPWGLAVNEAMACGTAIVVSDQVGAARDLVDAGCGAVFPAGDAQALAQALSRVLAHSQEMGRAAASRIATWDFEADLAGLREALAHVR

SEQ ID NO: 16719 - protein, 1676 aa, Magnetospirillum magnetotacticum
MRVSTVVTLGMGLVVLANVVLIGRVISPQLDMQARVQSGIAGQQLMGLGLEAASRISAERGPSNGALGSELPLPPERTEALKAARTATDAALRQVVESLDKSPSLRHGAAVRNSLFAAGSQLETARRQIDALIARPRPERADQEVAAAVGGMVKVLPLMAPGLNVIETNLAQADPALINYVTISRLSTEMRDFAGQIGSIFTAPYVARRPLTVDELAQVERSLGTIAALDTQLRLAIDKTGSPPDLLAALATIDAEFFGGGLPLIRRIRDVGRSSGEYGMNAAEFAKIYVPQMNSILGLRAAALAAIADRMIHLEHETDATLRFNLLLTVIVVMSVLACFLLIRLRMSRPLSQVHRALGQLARGEDHMDLPVARRHDEIGEVVEALTQLAAVVRDRAHESYVSGLVARITADLQAAEDFESLARGLFSNMAPVIDLGFAVYFRCDGETGELVECGGYARHGDAPARSPSDGLVAECAAERREILISNPPEGYLKIRTGLLSAAPGAILLLPVVGGDECLGVIEMATMKPIEGRDRDVLDAVLPVLAMRMEILARSERTRQLLLATQRQAGELTAQQERIQALLSEQDAIFDNAPMGIMYTASGRIQRANPAMAELLGYTVESMKGLEASRLFATADSYREFGGLVAPKLGAGEGIHQEWDLIRGDGQLFSAMISAKGVRLEGLERASIWIVEDITERKRLEREMRESGERLRRILENSPAGVSINTEDGHSLFSNQRMAEMLATTPEELSHRSATEFWFDPTDRQEFIATLRRDGYVRDYQSRFVRADGTPITVLLASALTEFADGRYLVSWAYDITERQKAEDAVRFAGAEQQAIFEAATVGIAFLKNRVIVRGNPQLDRLFGYEPGELVGQSTRIWFPDDESFADVGDAYEALSRGEVHQREQCYVRKDGTRFWCRISGSAIDPSDLSRGAVWMLEDVTDARAAAEALAKARDVAEDAAKTKSDFLANMSHEIRTPMNAIIGMSHLALKTELNPRQRDYVKKIQQSGQHLLGIINDILDFSKIEAGKLEVEVTEVHLDKVLENVGNLISDKASAKGLELLFDLGAGVPLDLMGDSLRLGQVLINYANNAVKFTEEGEIVVAVRLLEDLGAEVMLRFEVRDTGIGLTEEQKARLFQSFQQADTSTTRKFGGTGLGLAISKKLAELMGGEVGVDSVPGEGSTFWFTARMGKGKPRAPLLPEPELVGRRMLVVDDNENARAVLVDMLSSMSFEVDSVEGGAAAIDAIREAMLDQPYEVVFLDWQMPGMDGLEVAERIHDIRLPFPPHLIMVTAYGREEIIKGAQAADIGEVLVKPVNPAALFDSIMRVFASDDRRSEEDEGTEGGTVDVSGLKGVRVLLVEDNELNQEVASEILGDAGLVVDIAANGQIAVDKAKTGHYDLILMDMQMPVMDGVTATREIRAMGFQDLPIIAMTANAMQADREKCLEAGMNDHIAKPIDPDSMFATMMKWLGRQPVAVAAPAASPDEAVAVIARLRALLADSDPEAEELVEAHGDLLRGLLGKKADRFAALVSGYDFDKALKLLPAEAKEDGRRNLPEIDPDIFDFEVMGSIYKWDLERLRPILAGFLDDAAAKVAKIEAAQPEDTALREIAHGLKGAANTAGAIRLGRLAADMESSAKADNTAALAMLAPLMAPTLDELKGALAPFLSSVTEKASS

SEQ ID NO: 16720 - protein, 788 aa, Magnetospirillum magnetotacticum
MDGKIVWVHAAGKLVRDEANGAIRFMYGAYQDITAVKAAEDAIRAAKEIAEEATKAKSDFLANMSHEIRTPMNAIIGMSHLALQTKLDKKQRNYIEKVHRSGENLLGIINDILDFSKIEAGKMTMESIDFRLEDVMDNLANLVGLKAEDRGLELLFNVAPDIPSALIGDPLRLGQILINLGNNAVKFTEKGEIIVGAELVERSEDQAELHFWVRDSGIGMTPEQCGKMFKSFSQADTSTTRKYGGTGLGLAISKTLVELMDGRIWVESEAGKGSTFHFHVRVGVQSHPPLRRVFSPDELLGLRVLVVDDNAAAREILSAMAKGFGLEVDSAWDGTQALEMVAAAERKDLPYDLILMDWKMPIMDGVETVQKLQHGDHARIPAVIMVTAYGREEAATNAEERGVVMKTVLTKPVTAASLLEAIGETLGKGVVAEHQGQDKAESYKETMKALEGCRVLLVEDNEMNQELATELLSQAGMEVVVAVHGQDALDILARDNRFDGILMDCQMPVMDGYTATRAIRANPALSAIPVIAMTANAMAGDREKVMEAGMLDHIAKPLNLETMFSTMAKWIKVAKAPAKTAPAPREKPKTAEVSGGLPDLPGIDIKAGMATMANKESLYLRMLAKFRDSQGHFADLFAAARQDPDPQAATRAAHTLKGTAGNIGAKGVQSAAAALEQACKEGRPEGEIRQALVSALAELDPVIAALGRMDAPETTKAPAIPEAEVTAALARLAALLEDSDAEAGDLLDELLPKLEGTALAGALKPVADAIEDCDLDLALAKLRGLDVK

SEQ ID NO: 16721 - protein, 444 aa, Magnetospirillum magnetotacticum
MGSGSPLADRPPHHRPGTLHHRRHPGDHVPALSPHLPGRRSPPHHGGLLRQRGTARGRRPHGRRLLRDERLGQPLSGGQYPGIGRGGHGPFGRGRGDRHFRHPHHPSGTGRRPGHQGPQTVWEQDDHPGGRLSLQHRPGSVAKAGSRRLRPKCRRGRHDRRARRMSLNTKGSGQHLQPESDDDMYESIGALNSELVNTQRQLAKANARLTAANDLKNKLFGVLAHDLRTPLSVISGYSQILELLLPTATTGQEMEFVGRIQQSVGYMLALIEDILSLSAIETGHLTINRQPADMTLLAQRIVSMASILADQKSITLSATSSRPLWVLMDRVKIEQVLTNLIGNAIKFSHPGSTITIALSAEQDEEGQPWARMEVTDTGIGIAPQKLESLFHPFAEGSQGTAGESSIGLGLYICARVIEAHGGSIHVASAQGEGTTVSVVLPAEG

SEQ ID NO: 16722 - protein, 300 aa, Magnetospirillum magnetotacticum
MRRSPARLTPLEWASATLVVTLWGLNFVAVKTALGTLPPFLLTALRFACTAAILAPFFRPTRGQLPGIALLALLLGIGHFGLMFFGVAGMDAATAAIVIELSIPFSAILAWAFFGEVLGIWRSLGLAVSFLGVALLAGEPHLPHLTPFLAVVASGFAWALANVVIKRIGPINPLALNGWMALLAAPMLLVLSLITEDGQSEALAATGVKGWSGVAYTIIGSTLIAYTLWYRLIARHPMNRVVPFTLLGPVVGLAGGVLLLGEPLTWHKLVGGALTVLGVAAVELLPGRAIHRAEEPEPGT

SEQ ID NO: 16723 - protein, 240 aa, Magnetospirillum magnetotacticum
MGRLAIVTGGTRGIGREISVTLKKAGYKVVANYGGNDEAAAKFTADTGIPSMKWDVGSYPACEAAIAKITAEHGPVEIIVNNAGITRDATLHRMSYQMWEEVIHTNLTSCFNMARLAIDSMRERGFGRIVNIGSINGQAGQYGQVNYAAAKSGIHGFTKALAQEGAAKNITVNAIAPGYVDTDMVRAVPPAVLEKIIAKIPVGRLGRAEDIARCVMFLIADEADFITGSTLSVNGGQHMY

SEQ ID NO: 16724 - protein, 306 aa, Magnetospirillum magnetotacticum
MISLSQWRSIMGQTGIYALAVLSALFWAANFNLAGPVLADMAPMTAAAGRFGLAALVMAALVAGRGELGALMGAARKSGGRLALLGVVGIAGFNLLFFDAMRTTSAVNGALIMATNPLLTAVLAAMFLGEQLPGRQIAALPVALAGVSMVILGGVKGDVVFGMGDVEMMGANLSWAIYNVMARRLMPAGSALVNATIPMAAGALVLALAAGLSGAEFAIPGPKAGAALLAMVVFGSVLAYLFWNAAIARMGAGRTALFLNLVPVFAAAIATLGGTPPSPAQLGGGAVVIAAVIISMLPRRPQPCLA

SEQ ID NO: 16725 - protein, 338 aa, Magnetospirillum magnetotacticum
MADKTIHVAGIGNAIVDVLVHADDLLLHRLGLTKGVMTLIDAEQAESIYAQLPPGIECSGGSAANTIAGIAALGGRAAYVGKVKSDQLGQVFRHDIRNMGVHFETEADDGGPSTARCFVLVTPDAQRTMLTYLGACVELGPDDVDIGLITGAEITYLEGYLYDPPEAKRAFLKAATVAHGAGRLVSLSLSDPFCVDRHRDAFLDLVAGHVDILFANESELCSLYKTESFDEAVRAVRGHCRVAAVTRGDKGSVVVTEDETQVVAADEIEQLVDTTGAGDLYAAGFLFGFTQGRDLATCAMLGGIAAGEVISHYGARPERSLKDLVRAKLGPHILENLR

SEQ ID NO: 16726 - protein, 145 aa, Magnetospirillum magnetotacticum
MSAFMAQALAEAEAAGARGEVPVGAVVVQDGRIIARAGNRVEELGDPTAHAEMLAIRAATVLGDKRLEDCDLYVTLEPCPMCAAAISLARIRRLYFGAYDPKSGGVEHGSKVFDHATCHHRPEVYGGLEERRSAELLRVFFAERR

SEQ ID NO: 16727 - protein, 559 aa, Magnetospirillum magnetotacticum
MPTYRRIRLLMGGLIVVFLAALVGSTLFSVISSRSEELRDADNELRHTSHLLAEVAASTFLSIDKVLMGTAEIAARQDDPSRLLQFLRRQLAQAPTARALLVIGPDGMSRLATNLPDPHRAIDLSDRPYFLHHRNGGPSTLYVSGVIQSRNDDHWIMVLSRRIETPDGAFAGVVAATINLEQLASILDAAAPDSSDSALLVSPDGTILARSPDHVRYVGKSLAGQPAFETARTAPEGSGEILSPLDGRKRLYAFHKASSHPVIAVASHDQEAQLREWRLHSMTLVASALLVGLIIGALALFLARQLERMDRTLSELARSRREADAANRAKSAFLANMSHELRTPLNAIIGFSDALLVGIPGHTCQSRCQDYLGHVQTSSRHLLSLINDILDLSKIEAGSTEIALAPTPLALLITECLEIVRAKAESKNISVALAGPDQDLMVTTDSRRLRQIVLNLLSNAVKFTPEGGRIILEAECDSGQLALTVNDTGIGMTQEEIAVALTPFGQNDSDLARREAGTGLGLPLSKRLTELLGGTLSVTSIPGRGTTVTISLPLSRPLP

SEQ ID NO: 16728 - protein, 734 aa, Magnetospirillum magnetotacticum
MADGGKRTLTWLGGARGHLFQVVVLGLVPAIFLGTLAIITQLVETLTLQAAGAQVEALARMAAAIHNRGLESSREALAALATDPEDDECGSHYRHFLLAVEGHEGFLRTDASGKVGCSISQGTDITWLAKGPHIGGSLESGGFATAPYVLLKEGRAALPMAYPILDWMGSPRGVIATARSLDHLARAVAPPVLPEGARLLVLKSDGTVLARVPPLPEPGPTVTPVPELREAAARGTAGSFTATSITGETSVFGIAPLGRMAPETIVAVTVPVDMLGGPERQFLRMAIMAFGIAGSGVVLLLWYSSRRLLFLPLGRLADAMRRVRAGDMSAQAGGGIGEVGEMGDTFDTMVGALNEREARLADSEDRFRATFDQAAVGMSHSTPDRRFIRMNRRFASMLGYEPEELIGRSTLSITHPEDRILATDEIAAMIRGDIQSFATEKRYIRKDGSIAWVNLTLSALRRDGRVEYLIGVTEDIERRKQAEVQLLAAKEQAESASRAKSDFLAGMSHELRTPLNAIIGFAETMYSQVLGPIPERYREYAGDIAASGRHLLGIITDILDLAKIEAGRMELDENPVEIAPVVEAAIRLLRDRGTAARLDLHSDIPASLPRILADERRIRQVVINLLANAVKFTPHGGSVSVSANLTTDGGLALHVSDTGIGMTDEEMSQAVEPFVQVDARIARRHEGTGLGLPMVAAIMEMHRGTIAIASRPNQGTTVTVTFPRDRVLSADPAG

SEQ ID NO: 16729 - protein, 156 aa, Magnetospirillum magnetotacticum
MKHHFPEIPWVFALFPVAELAQCVLNESRVLTRVLNANAKDGGFMKKIEAIIKPFKLDEVKEALHEVGLQGLTVTEAKGFGRQKGHTELYRGAEYVVDFLPKVKIELVIEDNLVERAVEAIQQAAHTGRIGDGKIFISTVEEAIRIRTGERGSDAI

SEQ ID NO: 16730 - protein, 486 aa, Magnetospirillum magnetotacticum
MIIKEALTFDDVLLVPAESNVLPAQADTRTRLTRSIELGIPLLSAAMDTVTESRLAIALAQDGGIGVIHKNLDMDAQAAEVRKVKKFESGMVVNPLTIHPDQTLADALRLMSDYKISGIPVVERGSGKLVGILTNRDVRFANDAAQPVYELMTKDKLVTVREGVDKEEAKRLLHQHRIEKLLVVDSDYRCIGLVTVKDMEKAQAHPTAAKDEKGRLRVAAATSVGADGFARAMKLIEAEVDVVVVDTAHGHSRGVIDTIAEIRKASPHIQLVGGNIATPEAALALIKAGADAVKVGIGPGTICTTRMVAGVGVPQLSAIMEVAEVAHKHGVSVIADGGIKYSGDIAKAIAAGADCVMIGSLFAGTEESPGEVFLFQGRSYKSYRGMGSLGAMARGSADRYFQAEVSDKLKLVPEGVEGRVPYKGPVSTVIHQMIGGLRAGMGYTGNATIKDMQTRCTFRRITSAGLRESHVHDVSITKEAPNYKTD

SEQ ID NO: 16731 - protein, 306 aa, Magnetospirillum magnetotacticum
MRNTSLNKVHELAQKDSRVVFIGSDLGVGTLKAMKAEMPERFFMEGVAEQNVIGMAAGMAMDGLIPYVNTIAPFITRRCYEQVAVDVCVHNLPVRLIANGGGVVYAPLGPTHLAIEDFAIMRALPNMAVVAVSDAEEMKRLMDASLDWKGPIYIRLAKGGDPVISQPTDDFKIGKAILRREPGRVLMVSTGATTERCLKAADILAEAGITAGVLHMHTVKPLDCEALKALVPGRDLLVTVEEHLLAGGLGSAILECLVDCGVTLPKVKRLGLPDSFTKEYGSQDSMFETYGLKAEQIATTVRTALA

SEQ ID NO: 16732 - protein, 359 aa, Thermobifida fusca
MKAAVLHEFRKDLVIEDVTVSEPAPDEVLIRVAASGVCHTDRTMQQGANDLPLPLILGHEVAGIVERVGSAVTAVEPGDHVVTCASAFCGTCRWCMRGELQHCAHKRRSRDPGQPPRLSQGDTPVEPFVGLGGFAEQVLVYEGAVVKLPEEMPLDRAALLGCSVITGMGAVRNAAQVQSGQTVAVIGCGGVGLNVIQGARLCGAAQIIAIDRLADKLDLARQFGATHTIDASTTDPVEAVRELTGGGVDHAIEVVGIAATMEQAFRMLDTKGTATVVGVAHPEVQVSIRATDLLLEKRLQGSKMGSARPRIDIPFYCQLYLDGRLKLDELLTARVPLSEVNSALAALDNPLGARTVLTF

SEQ ID NO: 16733 - protein, 271 aa, Thermobifida fusca
MTPHDTRPDTAAPPTSAAAGTSVDVDLTGRTALVTGAASGIGRACATRLAAAGATVRLVDLNREALDELAQRGIGEPHHVDLTDLDAVDTVARGVDIVVNNAGVQTVCPVHEFPPERFSMMVKLMLEAPFRIVRAALPHMYARNWGRIINISSVHGLRASAYKSAYVAAKHGLEGFSKVVALEGAPHGVTSNCINPGYVRTPLVEQQIADQARAHGIPASDVVETVLLARSPIKRLIEPAEVAEMVAYLCCPEASFINGASLTIDGAWSAS

SEQ ID NO: 16734 - protein, 425 aa, Thermobifida fusca
MPLDRPLRIALLSYRSKPHCGGQGVYVRHLSRELAALGHHVRVLSGQPYPVLDDGVTLDPVPSLDLYNDEHPFQAPPMREWRDWIDALEVATMWTAGFPEPLTFSLRAFRELRARRHEFDVVHDNQTLGYGLLGIQAILPTVTTIHHPITVDRRIELESATGWQRWSKRRWYSFVTMQGRVARRLRSILVPSQSSADDVAREFRVRPSVINVVPLGVDTRVFHPRPDITRVPGRIVCVASADSPLKGVAVLLRAVAKLATERDIELTVVSKPQPGGPTEQLVDELSLHDRVTFVSGIDETELACLLSSAQIAVIPSLYEGFSLPAVEAMATATPLVASRAGALPEVVGDDGAGRLVPPGDAEALAAAIAELLDNDAARARMSEAAWRRVQEKFTWRTVAENTARHYAAALDAAQRGRADRSAAAS

SEQ ID NO: 16735 - protein, 470 aa, Thermobifida fusca
MNCQSSASNLANHINAVYELRRAYARLSADKPVRLAKTTSNLFRFRSRDDAARLDVSAFTSVISIDTEARVAEVGGMTTYEDLVAATLRHGLMPPVVPQLRTITLGGAVTGLGIESSSFRNGLPHESVEEMEILTGSGQVVVARRDNEHRDLFYGFPNSYGTLGYALRLRIQLEPVRPYVHLRHLRFTDAAAAMAALEQICADRTHDGETVDFVDGVVFARNELYLTLGTFTDRAPWTSDYTGTDIYYRSIPRYAGPGPGDYLTTHDYLWRWDTDWFWCSRAFGLQHPVVRRLWPRSLKRSDVYRKLVAWDRRTDASRLLDYYRGRPPKEPVIQDIEVEVGRAAEFLDFFHTEIGMSPVWLCPLRLREDTADDTEPVWPLYPLKPRRLYVNFGFWGLVPIRPGGGRTYHNRLIEKEVTRLGGHKSLYSDAFYDEDEFWELYNGEIYRKLKAAYDPDGRLLDLYTKCVGGG

SEQ ID NO: 16736 - protein, 252 aa, Thermobifida fusca
MDLMAGELNGKVALVTGASRGIGAAIARGYAERGALVVGAARSTDQLRELEATNPERISTATVDLRDAESLNSLVDLVVERHGRIDILVNNAGVAPAADFATEPIEQWRTTFEVNVIAPMTLAQAAGRYFIPQRSGKIINIASTTGIRGKPGLVGYSASKGAVARFTEALAAEWARHNIQVNCIAPGAFATDAQSAVLESPDLLHRRVRRIPAKRMGDVSELVPLACLLAAPGSDFITGSIFVIDGGESGKL

SEQ ID NO: 16737 - protein, 514 aa, Thermobifida fusca
MPPGRSHAQEASQRRRQQGRGLMSISSERIAALRDYVPEVRELTIDGKPVKPAGETWDVYNPATEEVIATVSGATKEQVDEAIRAARTAFDTWSKMSGEERSAAMHSLADRLEARWEELLASIVNEVGTPVSTAEFLQVKMGLGHLRWFADAAKKDRTVHLGPYDVPVPTMSDVDHYPVGVVAAITGYNYPLNLAGFKYGAALAAGCTVVLLPSPRTPLTTLLLGEIIRESDLPDGVINVVLGGADIGQYLSSHPGVDKVSFTGSDAVGAKIMEQAAANLNDVVLELGGKSANIVLPGCDVESFAVDMHMRWSRNSGQGCAALARLLVHEDLFDRFMKAGAEAFPKMKVGDPWDPETHIGPLIRPDHRDRVNGFITEALEQGGKALLQVETPLPEKGWYVNPILLGNLPHSARAVQQEIFGPVAVVLTYKDVDEAIRLANDTAYGLAANVWAPTLEEGRRVAEQLRAGTVWINGGGAMRPDAPFGGSGRSGIGRELGEWGIQEFLEPRHIQWAL

SEQ ID NO: 16738 - protein, 277 aa, Thermobifida fusca
MCRGGGAHTDDDTTPLRKDATMRRFEGRIAAIVGGGSGMGRAISHRLASEGATVYVADLSEESAKKVAEEITAQGGKAVPVQVDATNNDSLRALFDRIRSDHGVLHVLHAQVGMPGPGGIETSDEEWQKNIDVNIKSAYYTCTLGYDLLKSANGKGSITMTSSTSALVGSPFSPIYSLTKGSLVPFARALALKGAPDGIRVNVICPGTVQTPMLAQFFGREPGADVSELTKDFIKNIPLGRGAQPEEIASVIAFLASDDASYVTGVTIPVDGGLTAK

SEQ ID NO: 16739 - protein, 161 aa, Thermobifida fusca
MSVGRSGVDAAVRRALEEAEKTSSSGDVPVGAVVLDPDGVVIGAGHNEREATGDPTAHAEVLALRAAARRLGSWRLSGCTLAVTLEPCTMCAGAIVLARIERLIYGARDERAGAVGSLWDVVRDRRLNHRPEVIPPDLVDPELSAACSRLLTDFFARHRTR

SEQ ID NO: 16740 - protein, 757 aa, Thermobifida fusca
MGTIVAVSAVTARRELIEPLQPGDPGRIGPYRLVSRLGAGGMGQVFLARSPGGRPVVVKVILPEYANDDEYRIRFAREVEAARRVGGFHTAQVIDADPTADPPWMATAYIPGPSLRKAVTERGPLYGNNLRTLAAGLVEGLAAIHACGLVHRDFKPSNIVLAADGPRVIDFGVARPLDSSVMTQSGAVIGTLAYMSPEQTDGSQVGPASDVFSLGTVLAFAATGRSPFMADSIGEIIARISGPPPELPELPDDLRELVYACWEQNPDLRPTTAELLAQLSTDHTGDDWPPPHLSDLIGSMLPLGATTSPNPSLAIEPPPPSHGPPRPSEPLPDPGDDADEPSAEKPSRTLPEPEPPELEEKPIQVIHEPERPAPTPPRPREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 16741 - protein, 508 aa, Thermobifida fusca
MINIIIIITIVCVGSHLRVRRGEEQVSLTERPQLFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 16742 - protein, 277 aa, Thermobifida fusca
MCCRRFQEAPMAISGRLTDKIALITGAGSGFGRASALRFAAEGASVVCVDRNADAAHSAADDIAAAGGTALALTADVSSAADAERMTTTTLEHFGRIDIVFANAGIPGSGDAHTTTEEEWDRVIAINLKGVWLTSKYALPHMVERRSGVITNQASVGGLIGIPGIFPYAAAKGGVISMTRQMAAAYAPHNIRVNAICPGGVYTPLVELSRQKRGLTASSVEEANAIAARNYPLGRLGTVEEIASLALFLASDEAAWITGGIYPVDGGRGAVGTIPTD

SEQ ID NO: 16743 - protein, 616 aa, Thermobifida fusca
MCRNAREGTAAQYYGGPPASGGIGTEPGAGHRPPDSPDRRVQQSRHTSVREVFVSPASSTRSKQQPEALQEPVIQQLIERGRSQGYLEPEDVRRAFEEAEIPMSQAQAVLRTLTKEGVTLIVNAAESAPPRRKSTRRKTTSASRAAAQTSTTRAKRTAAAQEKPEAATAVKKSTEDAEETTTASKKRTTKAASTKSKTTAKRSTAKKTTTKSTTKKTAKTATKKKTAATAATPAVEEELGLEATDLLEDNFEETGADLELVDDTDDEVVELEETTPAKRSRDLPEKADADDDDSFVLYDDDDDAPAAQVVAAGATADPVKDYLKQIGKVPLLNAEQEVELAKRIEAGLFAEEKLSKKGHELTPEEREELEWIAEDGKRAKKHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVVEVQKYGREPISLHTPLGEDGDSEFGDLIEDSEAIQPGEAVSFTLLQEQLHSVLDTLSEREAGVVSMRFGLTDGQPKTLDEIGKVYGVTRERIRQIESKTMSKLRHPSRSQVLRDYLD

SEQ ID NO: 16744 - protein, 366 aa, Thermobifida fusca
MLEAERIQRALRTVRAEELIRKGLAMTTANAPVPIPHDAPDRNLALELVRVTEAAALAAARWVGRGDKNGADDAAVRGMRHLISTVSMKGTVVIGEGEKDNAPMLYNGEQVGDGNGAECDVAVDPIDGTRLTAMGMPNAISVIAVSPRGSMFDPSAVFYMEKLVTGPDAANVVDINAPVADNIRAVAKAKGGDPRDITVVILDRPRHERLVHEVRETGARIKFISDGDVAGAIMAARAGTGVDLLLGIGGTPEGIIAACAIKCLGGVIQGKLWPRDDEERRKAEAAGHDLSRVLTTDDLVSSEDVFFAATGITGGELLSGVKYVDGGAFTDSLVMRGRSGTIRRISSEHRLRKLSSYRGVDVSGAR

SEQ ID NO: 16745 - protein, 390 aa, Thermobifida fusca
MGHLGFRTIDDMSTTPTTEQVNAALATVKDPEIHRPITELDMVKSVEIHDDGTVSVGIYLTVAGCPMRGRIEKDVADAVSKVPGVTGVKVTLDVMSDEQRKALQAKLRGGHAEKEIPFAKPNSLTKVFAVASGKGGVGKSSITVNLAAAMAAQGHKVGVVDADIYGHSVPRMLGVSDRPTKVEDMILPPTAHGIKVISIGMFTQGNQAVVWRGPMLHRALQQFLADVYWGDLDVLLMDLPPGTGDVAISVAQLLPNAEILVVTTPQQAAAEVAERAGSISAQTHQRVAGVIENMSYYQAPGSDERVYIFGEGGGQAVCDGLSRTLGTKVPLLGQVPLDVALREGGDRGVPLVLDAPDSEAGKVLRSIAEELLGKPRGLAGMMLGLSPTRR

SEQ ID NO: 16746 - protein, 261 aa, Thermobifida fusca
MTSTPRTAIVTGATSGIGLAVARELANRGHRVFICARNGERVAETAKQLSDNGNLPVDGQACDVRSLDDIRAMVRAAVERFGTIGILVNNAGRGGGGVTADIPDDLWDDVLATNLTSVFRVTREVLTTGGMREASWGRIINIASTAGKQGVVLGAPYSASKHGVVGFTKALGNELAPTGITVNAVCPGYVETPMAEAVRQRYAQAWQISEDEVLAKFQAKIPLGRYSTPEEVAGLVGYLTTETAASITSQALNVCGGLGNF

SEQ ID NO: 16747 - protein, 812 aa, Thermobifida fusca
MLEGDPSGKPWTAERAPGRGPARLEEDGLTGLNLAADSGAELALLGMDLTLVIVVLAVALLALAVAGTLVREVLAASQGTERMQNIARAVQEGAAAYLKRQFRTLAVFVIIIPLLLLLLPADTEAVRWGRSIFFAIGALFSAMTGFLGMWLAVRGNLRVAAAARAGEARAAMRIAFRTGGVAGMFTVGLGLLGAALVVLIYRADAPIVLEGFGFGAALLAMFMRVGGGIFTKAADVGADLVGKVEHHIPEDDPRNAATIADNVGDNVGDCAGMAADLFESYAVVLVASLVLGRVAFGTEGLVFPLLVPMIGVITAIIGIFVVSPRARDANAMAAINRGFFISAVISAVLVVGAALLYLPDTFAELEGVPADIAALDGNPQLIAIGAVLIGLLLAAAIQLLTGYFTETNRPPVREIGESSRSGPATVVLAGVSVGLESAVYSALLIAGAVYAAFLLGGGNITVSLFAVALAGTGLLTTVGVIVAMDTFGPVADNAQGIAEMSGDVEGSGAEVLNSLDAVGNTTKAITKGIAIATAVLAATALFGAFRTAVEAELGATEFSLSVDQPDVLVGVIIGAAVVFLFSGLAIMAVGRAAGRVVHEVREQFRTRPGIMDGTEKPEYGRVVDICTRDSLRELITPGLLAVLTPIALGFALGYAPLGAFLGGGIAAGALMAVFLANSGGAWDNAKKLVEDGHYGGKGSEAHEATVIGDTIGDPFKDTAGPAINPLLKVMNLVALLIAPSVVIYADNLALRLGITVASVALLVGVIVWSKRRSTDGSFAAEATKTQPEAPAADQGAAKEEPVSQGGGASSQE

SEQ ID NO: 16748 - protein, 616 aa, Thermobifida fusca
MKPPAAETERCTLVVHRACRGGGATPRQDVVVRPTHGSSDTTTNSADNQDLLWEPPPVLEAERPPRTDWAVFLTAAAFTLAFVAWGAISDETLAQVAENLLAGLMRYGGWAFVLVAGVFVVFALWLAFSKYGQIPLGREGEEPQYTTVSWVAMMFATGMGIGLVFYGVAEPLAHYVTPPPGTDAASESQRTLTAIATTLFHWTLYPWGIYAVVGLAIAYTTFRRGHSQLISAAFIPLFGERAAKGPLGKAVDVIAILATLFGSACSLGLGALQIAGGFQTLGWTSQTTFGLLFLIIAAIMACYLVSAVSGIARGIKWLSNTNMVMAVLLLVFVLVTGPTVYILDLVPGAVATFFQDFFEMAGRTQAVGGNTAEWLSTWTVFYWAWWISWTPFVGLFIAKISRGRTIREFVAGVIVVPSVVSLIWFVIFGCTAIHFQQSGVDLAASNQIEAQFYGMLQNLPWSGVVNVVLAVLVAIFFITGADSASIVMGTLTQGGVDKPRLAMTVLWGMLIAAVAAIMLLVGEGGSTAIDGLQNITILGAAPWAIVMLLLCVALLKGLRRDPLAVRERKARELMDEAVITGARTYGESGFQFPVAPARREEAPPPPRKGDGDASET

SEQ ID NO: 16749 - protein, 422 aa, Thermobifida fusca
MQRQEGTVPPMAAQRAPRVVLGVGGGIAAYKVCELLRRLTESGHHVRVVPTRDALRFVGEPTWAALSGQPVATEVWQDVHEVPHVRLGQQADLVFVAPATADLLARAAHGMADDLLTNTLLTARCPVVFAPAMHTEMWEHPATQQNVATLRARGAIVLEPATGRLTGADTGKGRLPEPAELFDVARRVLARGTLAADLTGRHVVVSAGGTREALDPVRFLGNRSSGRQGYALAATAVARGARVTLVSANVALPAPAGADVIPVTSAVEMREAVLAAAADADAVVMAAAVADFRPDTKAAGKIKKTGGPPPTITLVENPDILAELSRNRPRKDQVIVGFAAETENAVAYGRNKLQRKGCDLIVVNQVGEGIAFGTPDNEAVVLDRDGRAVEIPRGPKENLADRVWDLVVERLGSVSKTPDTGR

SEQ ID NO: 16750 - protein, 258 aa, Thermobifida fusca
MAVPTVTLNNGVTMPQLGFGTWQVGYDAVAAALAAGYRCFDTAEMYRNETAVAAALADSGLDRSDVFITTKLWNNHHGFQPALDAFHASRRRLGLDVIDLYLIHWPNASDAVNVETWRALEQLYAEGVVRAIGVSNFSPAQLAVLLEACDVVPAVNQIELNPSRPRLEERVYHARHGIATQAWAPLAKGGALLTHPVITEIAEAHQKTPAQVVLRWHLQHGILVIPRSATPERIRSNFAVTDFSLAPQEMAAVDALGA

SEQ ID NO: 16751 - protein, 258 aa, Thermobifida fusca
MARSCAVKRFEGKVAVVTGASRGIGFAVARRIVDEGGRVVVTARGAEALAEAVTQLGGPEHALGIAGRAHDQAHRAEVVQRTLDTFGRVDVLVNNTGINPVFDSILKVDEAAMAKIFEVNVIAAVGWVREVYNAWMGEHGGAIVNVASLAGQHPSPGIGIYGASKAALINLTQQLAYELAHRRIRVNAVAPAVVKTRFAEALYAENEEKVAAGYPLGRLGEPDDIAAAVAYLASSDASWVTGQVITLDGGKTLRAGVE

SEQ ID NO: 16752 - protein, 472 aa, Thermobifida fusca
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 16753 - protein, 308 aa, Thermobifida fusca
MPHREDSGTGPLTGAAVGAVLLNQARDEEVDMTTNSTTARRRSPAHRRGGVVRPPAPQSRPTGQAERLLAALADHQDDEETSARIRDELVRLYMPLVRREARRYRNRGEPMDDLYQVGMLGLMKAIKGFDPSYGKPFVAYLLPMVTGELKRHFRDTTWAVRVPRVHQERRSELNRVIAEFTQKHGRTPTTREIADALEMDLESAIELIDASSAYSALSLDTPFGDTEDESALGDTLGVADGDLETVVDKTSLKDALDRLPERERRVILLRFFGNKTQSEIAADVGLSQMHVSRLLSQTLRQLRRELLS

SEQ ID NO: 16754 - protein, 438 aa, Thermobifida fusca
MSRTAQAASPVTAEIEAASATLDELIARGRARGHVSLSELRTAFSEAGITPAEGRSLLRELSDTGVRIANNEDTPVDPGDDDTLEAVLETTSKGSGRRRSAKKRSRKKQPAQAGAETTDAPEADLDDHSPALGDSVHTYLKAIGRRELLTAEQEVELAKRIEAGLYAEYKLGWLEESPGPQEMSETEREELEWIAEDGRRAKAHMLEANLRLVVSVAKKYSDRGMPLLDVVQEGNLGLIRAVEKFDYAKGYKFSTYAMWWIRQAIQRGFADSARTIRLPVHVLELLSKLSRLERDMHQTLGREPTPDELAQELGKTPAQIEELLRITRQPISLDSTIGEDGETRIGDLIEDVDASEASEVVDRQLMADQLRRALDDLEPREATIMSLRFGLFDGRPRTLDEIGKHLGLTRERIRQLEKQSLSKLRHPSRARQLLDFAS

SEQ ID NO: 16755 - protein, 525 aa, Thermobifida fusca
METVTHPTATRSLPLDDALVQRLTRHVVSSTGRTVVTTAPFTGEPLATLPQSSASDVTEAFRRARAAQREWAQRSPRQRIAPFLRFSDLLLDRQTEILDILQWETGKARKNAFEEVCDAALGTLHYARHAPRLLRRRRAPGAIPLATRTRVNYQPKGVVSVITPWNYPLTLPVADAVPALLAGNAVVAKPDTQTALSALWAIDLLVEAGLPRDLWLVVLGEPAEIGDPLVDEADYVAFTGSSATGARIAQRAASRLIGCSAELGGKNPMIVCADADLDRTVHGAVAACFSNSGQLCISMERLYVHDSIYDAFVEKFVAETKNLRLGADLDYSADLGSLTSQRQFDRVVAHVEDARSKGATVLAGGRPRPDVGPLFYEPTVLTGVDESMTLCAEETFGPVVSLYRFTTEDEAIERANHTPYGLNASVWTRDVARGRRIAERLKAGTVNINEGYGAAFASYGAPMGGMKRSGLGRRHGVEGILRYTEAQTVSSQHVVGLSGPPGMSAETLSRVMTTGIRLMRALRIR

SEQ ID NO: 16756 - protein, 347 aa, Thermobifida fusca
MPARRTRDPEEVSLSWQIDAYRFDTPLMVSPMDSVVSPKTAIAIGELGGLAVLDLEGLWTRYEDPEPLLAEIRELDDATATRRLQEIYAEPIKEELIGRRIEEIRRAGVVTAARLSPQRTAQYHKAVIEAGVDIFVIRGTTVSAEHVSGRTEPLNLKQFIYDLDVPVVVGGCATYTAALHLMRTGAAGVLVGFGGGSGHTTRSVLGVAVPMATAIGDVAAARRDYLDESGGRYVHVIADGGMTRSGDIAKALACGADAVMVGSPLARAVEAPGGGYHWGSEAHHHQLPRGQRLKVGTIGTLEEIVRGPASTSDGSMNLMGALRRTMATAGYTDVKEFQRVEVVVAPN

SEQ ID NO: 16757 - protein, 531 aa, Thermobifida fusca
MRVLTPSTGHSEWFMSPRMRQGKLPLGLEGVMSLKPTGDQEEFQKVLPPGLTYDDVLLVPAYSDLQPGEANTTTRLTRNITLSIPLVSAAMDTVTEARMAVAIARQGGAGVLHRNLSIEDQAAQVDLVKRSEAGMITHPVTCHPDDTLADVERLSAHYRISGAPVVDDDGRLVGIVTNRDMRFEEDRSRPVREVMTPMPLVTAPVGVSREEAFRLLRANKVEKLPLVDDEGRLRGLITVKDFTKSEQYPNATKDAEGRLVVGAAVGVGPEAEERAKALVDAGVDFLVVDTAHGHSAGVLEMVAKLKANTRVDVVGGNIATRAAAQALIDAGADAVKVGVGPGSICTTRVIAGVGAPQITAILEAAKAAGPADVPLIADGGLQYSGDIAKAVAAGASTVMIGSLLAGVEESPGELLFINGKQYKSYRGMGSLGAMRGRSYSKDRYSQAGVVTDDQLIPEGIEGRVPYRGPLSAVAHQLIGGLRQSMWYAGVRTLDELRERGQLMQITSAGLKESHPHDVQMVVEAPNYQARN

SEQ ID NO: 16758 - protein, 265 aa, Thermobifida fusca
MMLPSPRGLRVLAVDDVPLALTELCRLLRAAPEVGEVVAADDPISALRNIQADRFDAVFLDISMPGLDGVELANLLSKLSDPPVIVFVTAHEEHAVTAYGIGAVDYLLKPVRAERLAMALTKVVRMLSAGTAPVTPHRVRRPDAMAVLPVETAGRTRYVRRSDVRFVEANGDYVRLHTPEGVHLVRMPISRLEEYWADSGFLRVHRGYLVALSAIRELRSDSSGGLLAHTDLGDVPVSRRHARELREQLLHAAQTGMFDDPTRGA

SEQ ID NO: 16759 - protein, 595 aa, Thermobifida fusca
MPHHGGGLRCRGPRGLRGAHGGAQRMTEDRMEPDRGCSPAAGEQTLTGVAASPGKATGPVAVLAAPPTLPPRRPAVTDPDAEIARATAALHQVADQFRRQAATVDGEAREILEAQALMASDPQLAAGIAERVRNGLAAEWALDEAVASYQELLRGAGEYVAGRAADLGDIRNRALAVLLDVPMPRPPVPGHPFVLVADDLAPADVARLDADTVLAIVTRVGGATDHTAILARSLGIPAVVGCAEAHQLCEGTPVTVDGDQGTVVVHSSAQQCTTQRHSRPQAARGLATGPGRTKDGQRVELLLNLGGEDPERAARHDCEGVGLLRTEFLFMDRVAEPTGAEQSAAYARVFRAFGGRVVTVRTLDVGADKPLAFLAQENEPNPALGVRGFRMVRTSPEVLRRQLAAVARAAQETRTRVRVMAPLVATPQEAADFVALAREAGIAEVGVMVEVPSAALLADRVVREVDFVSIGTNDLAQYTLAADRTRPALSDLLDPWQPAVLHLVGRVGAAGREAGRPVGVCGEAAADPLLALVFVGLGVTSLSMAAAALPVVRGALARHTVADCRKLAALAMDAAGPCEARETVRAAVDPAVLDA

SEQ ID NO: 16760 - protein, 891 aa, Thermobifida fusca
MPKYVYDFTEGNKDLKDLLGGKGANLAEMTNLGLPVPPGFTITTEACRHYLEHGTMPPGLDAQIEEKLAALEATMGKRLGQPDNPLLVSVRSGAKFSMPGMMETVLNIGLNDESVKGLAAQSGNERFAWDSYRRLIQMFGKTVLGIDGDLFEDAIDDLKARKGVTSDLDLDAADLAGLVDTFKTIVREATDAEFPTDPREQMRLAIEAVFKSWNAPRAVLYRRQERIPSDLGTAVNICSMVFGNLGMDSGTGVAFTRDPATGQQGVYGDYLQNAQGEDVVAGIRNTIPLTELERIDPKSYAELLEIMEKLERHYRDLCDIEFTIERGKLWMLQTRVGKRTAAAAFRIANQLVDQGLITLEEAVNRVSGEQLAQLMFPRFDEKAERDLLGRGMNASPGAAVGRAVFDSATAVAWSRNGEKVILCRRETNPDDLEGMLAAQGILTSRGGKTSHAAVVARGMGKTCVCGAEELDIDTKNRQLTAPDGRVIKEGDVISIDGTTGEVFLGEVPVVASPIVRYFEGELDPSSAEADDLVRAVDRIMRYADAKRRMAVRANADTPEDAARARRMGAQGIGLCRTEHMFLGDRRALVERLILADTDQERDEALAALLPLQREDFTGIFEAMDDLPVTVRLLDPPLHEFLPDITELSVRVAVAEARGEKNEGDLRLLQAVHRLHEQNPMLGLRGVRLGLVVPGLFTMQVRAIAEAAAARIKQGGRPRPEIMIPLVGTVQELEIIREESVQVIREVAAEHGVELDIPIGTMIELPRAALTAGQIAESAEFFSFGTNDLTQTTWGFSRDDVEASFFSTYLEKGVFGVSPFESLDVDGVGRLVRIAAEEGRATRPGLKLGVCGEHGGDPASVHFFHEVGLDYVSCSPFRVPVARLEAGRAALR

SEQ ID NO: 16761 - protein, 388 aa, Thermobifida fusca
MTKFNPSTPGKRRHTIRVVFPVSPKRASSMRDTAAEIVERRTPAGPAAAVERSGGPPVEAVGGEPEYVDRDDFAEHPETRTSSGDIVHAYLREIGRVPLLTAEEEVELAKAIEIGLYAEQKLRAARTGPVPAQYSPEWFEDLNELVREGKLAKRRLIESNLRLVVSVAKRYLGRGLALLDLIQEGNLGLIRAVEKFDYTRGYKFSTYATWWIRQAITRAIADQARTIRVPVHMVESINRLARTRRRLHQELGREPTLHELSRELNVDHDRVVEIHRVSQEPISLHTPIGEEDSAFGDFIEDTDAVPPVEAAAFVMLQDQLAQVLGGLSEREQRVITLRFGLEDGKPHTLEEVGRKFGVTRERIRQIESKTLAKLRQPSRARILRDYLG

SEQ ID NO: 16762 - protein, 436 aa, Thermobifida fusca
MRGTAARSAQPRTHPVPRRREPAVPGGDTVRIAMVSASASPLAVLGGADVGGPHVYIAELSAALARLGHEVVVYTRRTAEGMSGDVVLGPGVRVRPLAAGPAVALSDEDLLPHLPEFAQELRAAWARELPEVVHAYGWTSGMAAVEAARGSGTAVVQTFHGLGTAYRRFRGAADPLAAGRIALERSVAAQATLLIATSTAEQRELRSWGVAAARIRVVPCGVDVARFTPEGPRAPRGERPRILTLGQLRPRKGVETAIRALPAVPDAELVVVGGPEASAVRTDPEAVRLHRLARRLGVADRVCFLGRVPHGEVPALLRSADVVVNVPWDEPCGMSTVEAMACGIPVVASDAGSHRDTVVHEITGVLVPPRDPRALGVRLRSLLHDVVAAESYGIAGADRAAARFSWETVAREVDACCAAALDAAGRSPCLATEALP

SEQ ID NO: 16763 - protein, 542 aa, Thermobifida fusca
MVGVPQCPARTRGHGRHPHHNRGSPARPLCSRRRCPTRGTPPHRCVRAHKAVDARQPRRDQYGPARDHISAPSTTQPRVLSMSRYAHPAGPRHADVLPEEHPPSPPADLLELHPRVWPSTATRVDGEITIGGVGVTELARKFGTPLYVIDEADFRARARDYRLAFEDADVYYAGKALLTKAVARWVAEEGLKLDVCTGGELAVALAAGFPPERIGMHGNNKSAAELARAVEVGVGRIIIDSFDEIDRLERIAAERGRVPEVLIRVTTGVEAHTHEFVATAHDDQKFGLSLSNGAAAEAVRRLLTSPHLRLVGLHSHIGSQIFDTAGFEVAARRLSTFLTQIYAEHGISLPELDLGGGLGIAYLPDDDPLDPKSIADSLRSIVEHECAAQNLPVPRIAVEPGRAIAGPAGITLYEVGTVKDVEGIRTYVSVDGGMSDNIRTALYGAEYTCVLASRHSDAEPMLSRLVGKHCESGDIVVRDLYLPADLRPGDLVAVAATGAYCYSMASNYNHVPRPAVVAVREKNARVLVRRETEEDLLRLDVG

SEQ ID NO: 16764 - protein, 498 aa, Thermobifida fusca
MGTGSRLSPRPPNIEIEVDVRFLNDQVPTHDLTYGDVFMVPQRSSVGSRMNVDLTSHDGTGTTIPIVVANMTAVAGRRMAETVARRGGLVVLPQDIPTDVVADVIQWTKTRDLVHDTPITLAPTETVGHALNLLPKRAHNAVIVVDEERRPIGVVTEADCVGVDRFTQLHEVMSTELLTLAAGTDPQEAFAILHDSRHRLAPVVDSNGALVGVLTRTGALRATLYRPAVDAQGRLRVAAAVGINGDVAGRAAKLLEAGVDTLVVDTAHGHQEKMLEVLRQVRALDPQVPVVAGNVVTAEGVRDLVEAGADIVKVGVGPGAMCTTRMMTGVGRPQFSAVVECAAAARELGKWVWADGGIRHPRDVALALAAGASNVMIGSWFAGTYESPGDVLRDSEGRLYKESFGMASARAVRLRTADDSPFERARKALFEEGISSGRMYLDPERPSVEDLIDMIVAGVRSAMTYAGAANLAEFHERAVIGVQSVAGYNEGKPVLHGW

SEQ ID NO: 16765 - protein, 478 aa, Thermobifida fusca
MAFDFKVADLSLAEFGRKEIRLAEHEMPGLMATRAEFGPKKPLRGAKITGSLHMTVQTAVLIETLVELGAEVRWASCNIFSTQDHAAAAVVVGPDGTPDNPRGVPVFAWKGETLEEYWWCTEQALTWPDGEGPNMILDDGGDATMLVHKGVQYEKAGAVPDPDTADSEEFRIVLELLRRTLAENPRKWTEIASRIKGVTEETTTGVHRLYEMQRSGTLLFPAINVNDSVTKSKFDNKYGCRHSLIDGINRATDVLIGGKVAVVAGYGDVGKGCAESLRGQGARVIVTEIDPICALQAAMDGYQVTTLDEVVETADIFITATGNRDVITAEHMARMKHQAIVGNIGHFDNEIDMAGLAAIPGIEKIEIKPQVHEWRFPDGHSIIVLSEGRLLNLGNATGHPSFVMSTSFTNQVIAQIELFTKTDQYPTGVYVLPKHLDEKVARLHLDALGVKLTRLTKEQAEYIGVDIDGPYKSDHYRY

SEQ ID NO: 16766 - protein, 252 aa, Thermobifida fusca
MPQTPRVAIVTGAARGIGAATAQRLAAEGHAVAVLDLTKESAQATVDAITEAGGKAIALGADVSDTQQVEAAVKETAERLGPPTILVNNAGVIRDNLLFKMTDDDWDTVMRVHLRGAFLMSRAAQAYMTEQGWGRIINLSSSSALGNRGQANYSAAKAGLQGFTKTLAIELGKFGVTANAVAPGFIVTDMTRATAQRIGVDFEEFKAARAAQIPVRRVGVPEDIAATVAFLASEEAGYISGQVIYVAGGPLD

SEQ ID NO: 16767 - protein, 434 aa, Thermobifida fusca
MASQTPGTEAQSQTVQPGRIAAISLHTSPLDQPGTGDAGGMNVYIVEVAKRLAERGIAVDIFTRATSFEQPPEVELAPGVTVRNIAAGPYGTLDKTALINYLCPFVHGMLRAEAEHLGGSYDLVHTHYWLSGQAGWPVAREWGVPLVHSMHTMARVKNMSLAEGDTPEPEERVRGEDALVALADRLIANTDDEAAQLINYYGASPSRVSTVFPGVDLTTFTPGSRAESLRRLGLPEDTILLLFVGRVQRLKAPDVLLRAAARLLELNPSLRDRLVVAVVGGQSGTGYREPWLLSDLADSLGIADLVRLEPPCPRAELVHYYRAATVTVVPSHSESFGLVAVESQACGTPVVAARVGGLPTAVRDGVSGVLIDGHDPHDYANVLHRMITEPRWRERMGAAGIHHASGLSWESTVDGLLAAYRDALHQCRLTVPCR

SEQ ID NO: 16768 - protein, 489 aa, Thermobifida fusca
MTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 16769 - protein, 331 aa, Thermobifida fusca
MPVITYRQALRDTLRAEMHRDENVFLMGEEIGVFEGSYKITEGLLKEFGERRVRDTPIAEEGFVGAAVGAAMLGLRPVVEIMTINFSLLALDQIVNHAAKIYGMFGGQNSVPMVIRTPGGGGQQLGATHSQNVELYYAFVPGLKVVAPSTPADAAALLRAAIRDDDPVLFLENLGLYNTKGEVPDEEVVGEIGRAAVVREGTDITLVGYSRMAMIATQVADRLAEEGISVEVVDLRSLRPLDRETIVNSVKKTGCAVVAEDDWLTYGIGAEIAASIQEGAFDYLDAPVRRVAMAEVPLPYAKPLENAALPSAESVTTVIYETLRAVGRRVG

SEQ ID NO: 16770 - protein, 459 aa, Thermobifida fusca
MGKATGLRVSWLHRYRALEAADPGQTKRTLRHNGGVTTAVPPQEVFDPTPAPAARMPRRVVILGSTGSIGTQAIEVVRQEPHRFDVVGLAAGGGRLDLLADQACALDVQAVAVADAVKAAELRDKLSARGSAAKVLAGPEGVAELAAWDCDVVLNGITGALGLESTLAALRAGRLLALANKESLIIGGPLVRELAVPGQIVPVDSEHYAIAQCFPRLPADQLTSLAQGNLAARRDHVRRLVITASGGPFRGRSSAELADVTPEQALAHPTWRMGPVITINSATLVNKGLEVIEAHLLFDIPFEQIEVVVHPQSVIHSMVEYVDGSTIAQASPPSMRIPIAYGIAWPDRVPEAAPAIDWTRAHQWTFEPLDHEAFPAVRLACEVGSVGGTAPAVYNAANEEAVAAFLAGRLAFPAILDTVARVVSEHRGESRGTVPRLEDVYEADDWARQRAKELISRQG

SEQ ID NO: 16771 - protein, 484 aa, Thermobifida fusca
MTSHSDGLRRLRNFINGEYVDSVDGRTAPVVNPATGEAYAEAPVSTAEDVDRAFRAAADAFENGWRDSTPAERQIILNKIADAVEERADELVAAEVENCGKPVKATREEEIWQVTDALRFFAGAARVLEGKAAGEYMADHTSWIRREPIGVVGQITPWNYPMAMAAWKIGPALAAGNTIVLKPSDTTPVSTLLLAEIAAEFLPPGVFNVVTGDRDTGRALVDHPIPRLVSLTGSTRAGYEVAQSASRDLKRLHLELGGKAPVIVFDDADVEKAAEGIAGAGYFNAGQDCTAATRVLAAPGIHDDLAAALAEQAKKTKTAGPDETDAYYGPLNNPNQLDRVSGFFERLPDHAEVLTGGSAVDRPGYFFSPTVVSNLRQGDEMVSEEIFGPVITVQRFDDEDTAVAWANSVKYGLASSVWTKDHARALRVSRRLDFGCVWINTHIPIIAEMPHGGFKHSGYGKDLSLYSLEEYTRIKHVMSYIGRD

SEQ ID NO: 16772 - protein, 1426 aa, Thermobifida fusca
MTPHAWTHAANASAAGGGDLMPRLMPRMKNRTLTESELDALLDALYRMRDGDFTVRLSPRGATRFSEVARVLNEVFDQCEQLSNEVQWVSETVSTDGRLSERVSISPARGSWGQSVRALNQMLDEVSEPVTAVARILDSVANGDLSQRVDLASRHGELHGDLLRLATSVNRMADQMSEFAGEVTRVAREVGTEGKLGGRANVKGVSGIWKDLTDNVNSMADNLTNQVRDISQVTTAVARGDLTKKVTVDVQGEMLQLKDTVNTMVDQLSTFADEVTRVAREVGTEGKLGGRANVKGVSGIWKDLTDNVNSMADNLTNQVRDISQVTTAVARGDLTKKVTVDVQGEMLQLKDTVNTMVDQLSTFADEVTRVAREVGTEGKLGGRANVKGVSGIWKDLTDNVNSMADSLTHQVRNISQVTSAVAAGDLTKKITVDAQGEILELKDTVNTMVDQLSAFADEVTRVAREVGTEGKLGGQAHVSGVSGVWKDLTDNVNSMANNLTHQVRQISVVTTAVARGDLTKKVTVNAKGEILELKDTINTMVDQLSTFADEVTRVTREVGTEGKLGGRANVKGVSGIWKDLTDNVNSMSHNLTTQVRNISQVTTAVARGDLTKRITVDAQGEMLELKDTINTMVDQLSTFALEVTRVGHEVGIEGKLGVQAKVAGVSGVWKDLTDSVNELAKNLTTQVRAIASVASAVARGDLTQSIQVSARGELATLKDNVNLMVSNLRETTAAQRDEDWLKSNLARLSGLLQGRRDLNELARLIMTEVTPLVDAQHGACYLPEDENDTETFRLYAGYGYQPSEERRRITAGQGLAGEAIAQRKELIVHNVPGDYVRIESGLGEAPPLSLAIFPIVSEDRVLGVIELGSYGTFREIHLNFLRQLVSLLSATITTILANSKTEYLLAQSQQLTTALQERSNELQRQQEELRRKNAELHSKAGQLASQNRAIELQNRQIERARRSLEDRAHQLQVSSKYKSEFLANMSHELRTPLNSLLILARLLADNSEKNLTPKQVEFAQTIYKAGSDLLQLINEILDLSKVEAGRMELNPSHVSISQLVDYVEASFRPLASEKGLAFAVEVSPDVPDQLWTDEQRLQQVLRNLLSNAVKFTSSGEVRLVIEPAWAVEDIDVDTFTDPDEVIAFSVIDTGIGIPEDKLQLIFEAFHQGDGGTSRRFGGTGLGLSISRNMAELLGGEIRVSSTVGEGSTFTLLLPVRLPEGTSERMYRSLSDADVVTSFDRPTDTVVLPTETPGPKAADTDPLASSEDEPYVPVLTAESVPQAAGGPQQDDVLAGKRVLIVDDDIRNVFALASALEAHGLEVLYADNGREGIAKLEANEDIDLVLMDIMMPELDGDATTRMIREMPQFADLPIISLTAKAMRGDRENSLAAGASDYVSKPVDLDHLLNVMRRWLDRGKSDNSTSREQ

SEQ ID NO: 16773 - protein, 413 aa, Thermobifida fusca
MKIALIATHATPIPAHKGDPTDSESLYLCHLARNLAALGHRVTIHTRCTDPQTSERTRMGRSVVVAPIVAGPRRPLREQEYIEHTGTFARRLTEQLRADPPDIIHAFGWSSGLAALAAVRDLERDIPVVQTFHSLNVSEQRVGLPANPQRVRLEAALAHHAKAVLVNSADQRFELARMGVPRSRVCIVPFGVDTDQFTVEGAAHGPWQRRRSAAGRPLRIIAVTRLDPLGGVDTLIRTMARLPDGELLIVGDPAPEHLAIDPNAQRLERHAKEAGVNDQVTLTGAVTRRDLARMLRSADVFVSTAFYDPYGSAVLEAMACGLPVVARAVGGITGAMLDGTTGVLLRSAHPSTLAHVLRQLAADTTQRTAYGIAGADRAASRFTWARVAAETERIYQKLLPTTPELPLASGNGA

SEQ ID NO: 16774 - protein, 426 aa, Thermobifida fusca
MGGQWGSRIPLFNMHPGCKLTGVSAPQPFGGCMLSTQSADIVRATLPVVGAHLDEITSRFYSTMFSERPELLDGLFNRGNQANGEQRRALAGSIAGFASALLANPDERPDALLARIAHKHAAVAVTDDQYVIVHKYLFGAIADVLGDAATPEVIAAWDEVYWLMGGALIALEARLYAEKNADNGRTWREWTIVDRREETPDVFSLVLRPSDGGPLPEARPGQYVSVLHRMPDGIRQIRQYSISGGDEHTRRITIKRVRGTEHTPEGEMSALLYATAKAGDTLTVSAPFGDVVLTDSDRPLVFATAGIGCTPIVGMLNYLAATGATRRILALHADRSRAEHALWQETSTLIARLPHAQYVVWYEEGDGGLPGQMDLTGLEIPADAEVYLCGPLPFMREIRTQFLAAGVPAKDIHYEVFGPDLWLPAD

SEQ ID NO: 16775 - protein, 365 aa, Thermobifida fusca
MEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRFARQG

SEQ ID NO: 16776 - protein, 640 aa, Thermobifida fusca
MTRVTLLDSVHNPDDLKKLPDSQLPQLAAEIREFLISQVARTGGHLGPNLGVVELTIALHRVFDSPRDPILFDTGHQAYVHKILTGRKDFSKLRKEGGLSGYPSRAESEHDFIENSHASTALSYADGLARAYELQGITDRTVVALVGDGALTGGMAWEALNNIAEGKNRRIVIVVNDNGRSYSPTIGGLAEHFANLRMTRGYEQMLATAKNAINRAPVVGPPLYDALHAFKKGLKDAIQPQMMFEDLGLKYVGPIDGHDVAAVERALRRARDFGAPVIVHVLTQKGKGYAPAENHDEDQFHALGAFDVATGRPQSTPGLKWTSVFSDEMVRIGAEREDVVAITAAMLHPTGLAAFAEAYPDRVFDVGIAEQHAATCAAGLAMGGLHPVVAVYATFLNRCFDQVLMDVALHRQPVTFALDRAGITGDDGASHNGMWDLSILQVVPNLSIAVPRDAVRLRELLREAISIDDGPTVVRYPKGVVPPAIPAVDQIGGMDVLRRPASGTEAPDLLLVAVGPMAQTCCEVADRLADQGIGVTVVDPRWVKPLDPALVSEAARHSVVAVVEDNGRVGAVGDAVARALRDADLDIPVRTFGIEQRFLEHAKRDRILAQMGLDAQGLARKLTEIVAQRAEQSLEDEPAS

SEQ ID NO: 16777 - protein, 257 aa, Thermobifida fusca
MDTLLCVPHTSVVSAWQGFGGAVMSRSVLVTGGSRGIGLAIARELKEAGDDVAVTYRTGQPPEGLFGVQCDITDSAQVDAAFKQVEEAHGPVEVLVANAGINKDQLLALMSEEDFNAVLDTNLTGAFRVAKRAVRGMMRKRSGRIILISSVVGLAGSPGQANYAASKAGLVGFARSLARELGSRNITVNVVAPGYIETDMTAALPEKRQEEIKKNVPLGRYGTTADVAKAVRFLASEDAGYITGAVIPVDGGLGMGH

SEQ ID NO: 16778 - protein, 250 aa, Thermobifida fusca
MELGLRGAAVLVTGASRGIGRAIAQVFAEEGANLAICARTRAPLEVAARQLRETGAIVMAREVDVADAPALRAFVDEAAAELGGLDVVVSNVSGGGAVGWEGALRTDILPFTVLTDQAQEHLASSQRGGAVILISSTSALHVTAPSGPKPYGAVKAALNHHATALARALAPRGVRVNIVSPGPIEFEGGSWARRRDTDPDYYASVRARIPFGRLGRPEEVARAVAFLASPAASFITGANLVVDGGFLDRL

SEQ ID NO: 16779 - protein, 1158 aa, Thermobifida fusca
MSARLSFREVLGSRVLVADGAMGTMLQTYDLSMDDFEGHEGCNEVLNITRPDVVREIHEAYLQAGVDCVETNTFGANFGNLGEYGIAERTYELAEAGARLAREAADAYTTADHVRYVLGSVGPGTKLPTLGHAPYAVLRDHYEQCARGLIDGGVDAIVIETCQDLLQAKAAIVGARRARKAAGTDTPIIVQVTIETTGTMLVGSEIGAALTSLEPLGVDMIGLNCATGPAEMSEHLRYLSHHSRIPLSCMPNAGLPELGADGAVYPLQPHELTEAHDTFIREFGLALVGGCCGTTPEHLAQVVERVQGRGVPDRKPHVEPAAASIYQSVPFRQDTSYLAIGERTNANGSKAFREAMLAERYDDCVEIARQQIRDGAHMLDLCVDYVGRDGVRDMRELASRLATASTLPLVLDSTEVAVLEAGLEMLGGRAVLNSVNYEDGDGPDSRFAKVAALAVEHGAALMALTIDEQGQARTAERKVEVAERLIRQLTTEYGIRKHDIIVDCLTFTIATGQEESRRDALETIEAIRELKRRHPDVQTTLGVSNVSFGLNPAARIVLNSVFLHECVQAGLDSAIVHASKILPINRIPEEQRQVALDMIYDRRTDDYDPLQRFLQLFEGVDAQAMRASREEELAALPLWERLERRIVDGEAAGMEADLDEALTQRSALDIINTTLLAGMKTVGDLFGSGQMQLPFVLKSAEVMKAAVAYLEPHMEKVDGDLGKGRIVLATVKGDVHDIGKNLVDIILSNNGYEVINLGIKQPISAILEAAERHRADVIGMSGLLVKSTVVMRENLEEMNARGVADRYPVLLGGAALTRSYVEQDLAEIFKGEVRYARDAFEGLKLMDAIMAVKRGVKGAKLPPLRTRRVKRGAQLTVTEPEKMPTRSDVATDNPVPTPPFWGDRICKGIPLADYAAFLDERATFMGQWGLRGSRGDGPTYEELVETEGRPRLRMWLDRIQTEGWLEPAVVYGYYRCYSEGNDLVVLGEDENELTRFTFPRQRRDRHLCLADFFRPKESGELDTVAFQVVTVGSTISKATAELFEKNAYRDYLELHGLSVQLTEALAEYWHTRVRAELGFAGEDPDPADLDAYFKLGYRGARFSLGYGACPNLEDRAKIVALLRPERVGVTLSEEFQLVPEQSTDAIVVHHPEAKYFNV

SEQ ID NO: 16780 - protein, 222 aa, Thermobifida fusca
MTVEQQLPQAVLFDMDGTLIDTEPLWIATEAEVAAELGCTTWTVEDQRRCLGSSAAMVASYIAERSGTSVPQSEIVTMLYTSVARRMADSPPVQPGAKELLSELDALGVPMALVTSTYRSLLGTALRGLGEHYFAATVAGDEVSQAKPHPEPYLTAARLLGVDPRRCVAVEDSPAGVAAAQAAGCVVVAVPHVAPIEEAERRYVVSSLTEISVDWLRQVVNS

SEQ ID NO: 16781 - protein, 472 aa, Thermobifida fusca
MITTDRIYIDGQWIAPQTSDRMAVENPYTCQDIATIPLCGTEEVDHAVHAARRAFPAWSTTDLEERLAHLDALRRELAVRATEMSALITSEMGAPKVIADRIQVGLPLTVLGDTVATARDFAWTEKIGNSLILREPIGVVGAITPWNYPLHQIVAKIAPALAAGCTVVLKPSEIAPLSALLLAEIIDSVGFPPGVFNLVTGTGPVVGEALAAHPDVDMISFTGSTRAGSRVSEVASATVKKVALELGGKSAGVVLDDADLPTAVKAVVSDCLLNSGQTCTALTRLLVPHDRYEEAVALAVDAARSKPMGDPADPATRIGPLASADAHRRVLGHLEQARKDGAVFATGGPDADVPEQGYFVAPTVLAGLDRDAAAAREEIFGPVLTVLGYRDVDDAVELANATDYGLSGAVWSADTDRALAVARRMRTGQVAINGGRFNPSAPFGGYRKSGNGRELGRFGLEEFCEVKAVQLP

SEQ ID NO: 16782 - protein, 374 aa, Thermobifida fusca
MTSPTTNPTPRRTMPTTLAAVVRAPGEPVRIEEVALPELGPGLVRVRMAAAGVCHSDLSLASGKLAHPMPAVLGHEGVGHVVDVGAGVSDLSVGDTVLLNWNPPCRSCWHCTHGEPYLCANAADASRRVWGTLADGTDVHPCLGVAAFAQETVVPASACVAIPADIPPTEAALLGCAVLTGVGAVRNAAQVRPGQSVAVIGLGGVGLAAVQGARLAGAAMVIAVDPVEEKEELARSLGATHFLTPSDDLSRRIRALADGRGVDHAIECVGRAATIRAAWSCTRRGGTATVVGFGAATDTLTLNALEIPHFARTLQGCLYGSSDPATDVPELLKLYRDGELDLSSLVSRTIGLDDVPDALAELHAGRGARSLVEF

SEQ ID NO: 16783 - protein, 250 aa, Clostridium thermocellum ATCC 27405
MGMNMDELHEKETLELIAAAKAGDKDAQSLLVEKNVGLVWSIVRRFQNRGYEAEDIFQIGCIGLIKAINKFDCSYDVKFSTYAVPMIIGEIKRFIRDDGMIKVSRSLKELANKARITKEIMSKELGREPTVGEISEQLGIPVEEVVMAMEASCTPESLYSTLGEGDNSSTLLIDKIANESENQEVDIVDRIDLRKVLDTLKPREKQIIVLRYFKEKTQVQIAKMLGISQVQVSRIEKKILEEIRKKIKYN

SEQ ID NO: 16784 - protein, 811 aa, Clostridium thermocellum ATCC 27405
MWKGLVVMNKKDFLDFLNQNILILDGATGTELQKRGMPGGVCPEMWVIENPDVIMDIQKDYINAGSNAVYTCTFGGNRIKLSEFGLGDKVVEINKKLAQLSRKAAGEKGLVAGDLAPTGRFVRPFGDMPFEEAVDVYKEQVKGLLEGGVDFFVIETMMDIQEARAALLAVKESCDLPVCVSMTFDESGRTLTGTDSVSALIILQSLGADVVGCNCSTGPQDMIKIIREMKPYAKVPLLAKPNAGLPKLIDGKTRFDMEPEEFGSYIKEFVEAGVNLLGGCCGTSPVYIEQIRKNIEGLKPIPPQPKEICAVASARKTVFVDANEPVVVVGERINPTGKKKLQEELRQGMTSLVRQFAVEQVEKGADILDVNVGMPGIDEKETMVKVVELLSSITDAPLCLDSSSPEVLEAALRIYPGRALINSISAEKVKIEKLLPIAAKYGAAFILLPLGDAGVPKSAGERCKIVEEVFNEASKWGYTKKDVIVDGLVMTVSADQEAAVETLKVIEWCTQSFGCGTIVGLSNVSFGMPERAWINSAFLAMAIGYGLTMAILNPSSDTLMSIKMASDVLKVKDRNSKKYIEHFAALKSDKPQVVEKKDTASPVEKVYDAVVKGDRENIRKYIDDALKDGTEPSIIVDKYLIPAITHVGDLYDRKEYFLPQLIQSAETMKEAFGILEPLLKKEPVDEKGNKVKVILATVKGDIHDIGKNIVGLMLRNYGFEVYDLGKDVSAEEIVKKAKETNAPIIGLSALMTTTMLEMREVVSLVRQEGLNAKIMIGGAVVNADYAKEIGADGYSEDAYGAVKLASKLAGI

SEQ ID NO: 16785 - protein, 287 aa, Clostridium thermocellum ATCC 27405
MKFCSLFSSIKMTSVAIMILTLNYCREVFSMLVNKVEICGVNTSKLPVLTNEQKKELFERMHKGDTSAREEFIKGNLRLVLSVIQRFNNRGEYVDDLFQVGCIGLIKAIDNFDVTQNVKFSTYAVPMIIGEIRRYLRDNNAIRVSRSLRDIAYKALQAKEKLTNQNSKEPTIEEIAKELGLPKEEVVFALDAIQDPISLFESVYHDGGDAIYVMDQVKDEKNNDENWLEGIALSEAMRKLNDREKLILNLRFFDGRTQMEVAEEIGISQAQVSRLEKTALMHMRKYI

SEQ ID NO: 16786 - protein, 888 aa, Clostridium thermocellum ATCC 27405
MGGFFMAKYVYLFSEGNASMRDLLGGKGANLAEMTSLGLPVPRGFTITTEACTRYYQDGKVIAKEIEDEIYRTMEKLEEIVGKKFGDPSNPFLVSVRSGARVSMPGMMDTILNLGLNDEVVVGLAKLTNNERFAYDSYRRFIQMFSDVVMEVEKSKFEAILDAVKEENNCENDCDLSAENLKEVVRRYKELFKKEKGFDFPQDPKTQLMEAVKAVFRSWENPRAIVYRRLNDIPGDWGTAVNVQEMVYGNMGNDSGTGVAFTRNPATGEKKLYGEFLMNAQGEDVVAGIRTPQSIDQLKEVMPDVYNQFVEIAEKLERHYRDMQDMEFTIERGKLFMLQTRNGKRTAAAALKIAVDLVNEGMVTKEEAILKVDPKQLDTLLHPNFEPSALKNAKPIAKGLPASPGAATGKIYFRAEDAVEATKNGEKDIILVRLETSPEDIEGMHVSKGILTGRGGMTSHAAVVARGMGTCCVAGCSEIRINEEEKYFVDKNGKKYVEGDWISLDGSTGNVYGEKLPTVEPEMTGDFATLMQWADEIRTLKIRTNADTPADAIQARKFGAEGIGLCRTEHMFFDSDRIPAMREMIVARTEEQRRKALDKLLPMQRKDFEELFTAMEGYPVTIRFLDPPLHEFLPQEDEDIEALAKEMGITFDELKAIVTGLHEFNPMMGHRGCRLAVTYPEIAEMQTRAVIEAAINVSRKNIKVVPEIMIPLVGDVKELKYVKDVVVRTANELIEKSGVKIEYKVGTMIEIPRAAITADEIAKEAEFFSFGTNDLTQMTFGFSRDDAGKFLEEYYNKKIYEFDPFAKLDQDGVGKLVEMAAKLGRQTRPDIKLGICGEHGGDPSSIEFCHQIGLNYVSCSPFRVPIARLAAAQARVNEIKGTKDLGQK

SEQ ID NO: 16787 - protein, 413 aa, Clostridium thermocellum ATCC 27405
MEESFMRILMLSWEYPPRIVGGISRVVHGLAQKLGARGCDVHVITCWEMGTREFERDKYVKVHRLHSYDVTPNNFVDWVLHLNFAIVEHATRLINETGKFDIIHAHDWLVAFAARVLKHAYSTPLVATIHATEHGRNWGIHNDTQRYINNVEWWLAFEAWRLIVNSEYMKNEVMSIFKIPNDKIDVIPNGVDLDKFKGYEKDMEFRRRFAQDNEKIVFFVGRLVNEKGVHVLIDALPKVCHYYNDVKFVIAGKGPQFDHLKWKAESMGMAHKVYFTGYISDEELLKLYKCVDVAVFPSLYEPFGIVALEGMVANVPVVVSDTGGLGEIVEHGVDGMKSYTGNPNSLADSILEILHNPDKAERMKKKALEKVRSIYNWDVVAEKTLNVYKTILEENKHIYWGSPIMKEETERLN

SEQ ID NO: 16788 - protein, 932 aa, Clostridium thermocellum ATCC 27405
MPSDELDFCAFFDIEEHLYWQGDAMKSKRMIKQSTLSAIILAIFFFIAVMLIWSILYMNSCIRAEQNAERRRTEFKQLGIDLADASDYLTDEARKFAVTRKIVHLERYWEEINVTRTRDKVISRLQELDSPKEELELLAKAKKYSDALVETERRSMRLVLEALGVDESDMVPEVASFKLSEGDQRLSREDKLLKAIEIMYDARYDSDKKNIMDPIAKFQRIMNQRLESELEAARRGTAGATVLQIILAFVIILAIAVLIRILFTQVTYPIRDYILKLKDFSFDDEEFRLVPKGTVELNMLAENFNELYRSFHNELVRRKKAEETMKAARDEADKANRAKSEFLASMSHEIRTPINSIIGYQYLLKNSVLSPKQREYVENIGLAAKNLLAIINQILDFSKIEAGRMVLEEVDFNIDDVLNELMIIVGMEAKRKGIELRIKVDEDVPRFLKGDITRLKQVVMNLVSNGIKFTHEGYISIRVELVEKNEENACIKFSVTDTGIGISDEQKKLLFQAFTQGDASTSRKYGGTGLGLAICKRLVELMKGEINVESEVGKGSTFSFSLRLKIASCNENRNGKSKSVDTEEQYKNVKILLVEDSSVNLQMTKEILENMGIDTDTAQSGEEAVKKAESNEYELILMDIRMPGMDGYEATRRIRKLERGSMPIVALTADAVEGVAQKAKEAGMNGYLTKPLEPEKLLEVIRSMTNGGGKFKEEKSKSCAKAAEAENPYYEHKYETLDFDGAVNRLGGKRDKYIGILKSFVELHKDDGVKIRELAASGKRDELRRFLHSLKGSAANIGALRLKDLLARLEESCIPQNCEKNAKWMNDLEKEFERLIEEIMQYIRAFDSYKGSSPENHENNNVREDLEMLCKLLLTGDSEAKSFFEEKLAYLGNVLRPEDYHDLKKKISCYEFQKALAIVDKLKQDFSGKLTK

SEQ ID NO: 16789 - protein, 424 aa, Clostridium thermocellum ATCC 27405
MQEPVYTILIVDDNENNLFSLRTLIEEHINADVKEANSGEKALKILFKERVDLIILDIQMEGMDGFELASIIKKRKKTSSIPIVFLTASYIGDEFQRRGFEIGAVDYLTKPIDEYQLINRINVYLKMIEKERTMNILLEKRVREQTEELRAAKEAAEAANEAKSIFLANISHELRTPINILYSTTQIINSYLNEDKVLDREKIRSKIAMQQQNCYRLLRLVNNLIDITKIDSGYFELKFSRCNIVEVVENITLLVVEYAKNKGVSLIFDTDVEEKIISCDQNAMERIILNLLSNAIKFTPRGGSIKVEVKDCGKTVAISVKDTGIGIQEDKLEMIFERFKQVDNLLTRKNEGSGIGLSLVKSLVELHGGKISVKSEYNRGSEFTVELPADLENGENPSMDAADRKEENENKQHNVHIEFSDIYY

SEQ ID NO: 16790 - protein, 1160 aa, Clostridium thermocellum ATCC 27405
MKLLKNVRIQHRMWALFAVWLILYVIFAVAAYRNVSEIGQVSEDIYTQSLKTSNAAREARVAIMKIQRGIKEILLSDNPDNVYYELEKIRELDNQVLENFEIIKSNSGGNEEIEKLVNESTEIFDEWRKTRGEIAALIQQNKHLQDTTALTVKNNEFVEKLEKCLDSLDKIEEDEAQNLIDRSAKIQKYHKNSIFYWTGIIVFTSVVLFTIVIRSIMWPVSYLQHIMRTSANTREIIEAELPGKNELVNMANYYNKLVRNLKEQFWIKDNCSALNEELAGKFDLKEITDKAVTFLARILDAGNGVLYLYNDEDKKLYLNSSYAFTERDRLSNQYELGEGIIGQVALERKPILLKNVKRQEALITTGTVTEAPLNVYAVPLLYQGHLYGVLELSSFEPFVELKQELMNEAAKIVSTYLYTAVQNNRIVNLLKITEAAKQEAGRKASELEEANRVLEEQQILLQKQTEELQQTNIQLEYQQQKLQQQSEELQQTNSQLEEQQQLLEEQARLLNIKNEDLERTTRELRLRTEELEKVNKYRSEFLANMSHELRTPLNSIILLSKMLARKKINEFDEKDMEKIEVINKAGQELLRLINDVLDLSKVESGKMNLNIFTFHSSELMEDLRQMFESSAKEKNISFFVEDSINSMLVGDRDKISQILRNFLSNAFKFTSEGSVILKAEMDKDRENDLIFSVTDTGIGIPEEHISDIFQEFRQVDGTISRKYGGTGLGLSISKKLADLMKGEIEVRSKIGEGSTFFLKLPGLVCKKEDGREKVTVKKDMDRKISTDRKNDKVILVIEDNENFAKYLKEINDGMGFDTIIAGSGKEGLETAKNTRVDGILLDIMLPDMSGIEVLRELKSIVELGKIPVHVISDLEEDDVSQIIAYLLNYSARHPERIMIVGGDAIWQSTIKKPFEERNITTKTVSTEEEVKFEFKKEMYDAVILNMELDDKDVAGICEYIAEQNVDIPLIVYAEKSLSQERQKEIKKYADKIIIKTADSKERFQDELTAFLKGIKENMDNGCYLFSKVKKEYALNLDGKTIMIVDDDHRNVFVLAAALEDYGANIIAAENGKMALELLRTNKVDLILMDIMMPVMDGYETIRAIKGDKELKGIPVIAVTAKSLKSDKEKCIEAGADDYISKPVDYDVLIRLIKAWTAKEN

SEQ ID NO: 16791 - protein, 584 aa, Clostridium thermocellum ATCC 27405
MNTTMIVDTLWVVFAALLVFFMNLGFAAVESGFARSKNTVNILSKNFIVFAVSSLGFMLLGWGLMFGGDNPIIGTKELFILGGSDLGFYKDTLTSTVPFWGKFFFQLVFCGTAATIVSGAVAERIKYISFIVFSFILTLFIYPVVGHWIWGGGWLANLGFMDFAGDTVVHSVGGWAALTGAIILGPRHGKYDKDGKPKAIPGHSLALAVIGLFVLWLGWFGFNPGSTMSFQNPEDVVHIIVTTNTAAIAAILTATATSWIFIGKPDLGMTINGCLAGLVGITGSCAYVSVGSSLIIGAIAGIIVVFSVIFFDRIKVDDPVGATSVHLVCGVFGTLCVGLFAQEGVTSLSTVNGLFFGGGFSLLGAEIIGIIAVGAFVVASSALVWFILKKTIGIRVSLEEEIQGLDIGEHGNSAYPDFAIVAPITASGNGNGDSIVAISQVETIKPSSVKVTPEAAIPVVNRSHPGAKMTKVTVITNQDKYTQLQNALDKIGITGLTVTNVLGYGMQKGHTEYFRGLPVKTRLLPKVQVDIVVCKIPVETVVDTVKKALYTGNMGDGKIFIYDVENVIKIRTGEEGYDALQDEE

SEQ ID NO: 16792 - protein, 902 aa, Clostridium thermocellum ATCC 27405
MDCRVKNEVRDDLNVNLEVMVAGNDEEFAASLKNALLDVGCKHSVKSAATFNEFKNYLRKNNFHIVFFDCSSDISFADVMESFENLKKEMPVVAVLEEDGSRHGFEMIKLGACEYLEKKDSSRLRSIIFKRCRELERERERIRFEKRLKEENERLLTTLESIGDGVIVTDKAGCVIMMNKAAQELTGYLSCNSIGKPLSEVFVIINGVNREPEPDPYERVLSERKTVGLRKNTMLVSKDGTLRYVSASTAPIKSSDREIMGVVVVFRDITRIRKAEEKLQKLSQAVEQSPGIIVMADTRGNIEYVNPRFTEVTGYSFDEVKGKSLFFMELEENGEEKCKDMIQAVFSGKEWRSEIRHKSKNNVVFWEYAYYSPIINSEGVVTNYLKVSEDITERKLMSENLFKAKEAAEAANRAKSEFLANMSHEIRTPLNGIIGMTNLTLQTELTDEQRENLNIVNSCAELLLRVINDILDYSKIEAGKMTLENVKFDFFNLLEKTYKAHIVQANEKGLRLSYTVQKGIPRILVGDPGRLQQVLNNLISNAVKFTDIGEVRIDVDIIEKRDDSVKLKFTVSDTGIGIDGDKMNMLFKSFSQVDSSITRKYGGTGLGLAISKQLVEMMGGEIWVESQKGKGSTFYFTAGFKRKAKSSVKAECTSNADERVLGRKLNILLAEDDKVNQQVIAGMLKKEQCSLTIAENGFEAIKLFEENEFDLILMDVQMPEMDGIEATKRIRKMEEGTFRHIPIIAVTAFAFENDREKILEAGMDDYISKPFSFDDIYAAINRVLYKDEQSSDDMQKEKEDEKGSLDPDEKVNETLSESGTVNETGPDYSLKDIMERLDLSILNGNFTAIDKSALAVKEFAQNRGFDKVKNLAFKIQLSARKNQLEDVKKLYEVLKQEISKFN

SEQ ID NO: 16793 - protein, 631 aa, Clostridium thermocellum ATCC 27405
MESVLDSINFPDDIKKLNLEQLKQLAGEIRSFLIEKVSKTGGHLASNLGVVELTLALHRVFNTPEDKIIWDVGHQCYVHKIITGRKDRFDTIRKLGGLSGFPKSAESEYDAFNTGHSSTSISAALGIAKARDLRKEKYSVVAVIGDGALTGGMAFEALNDAGRSPNNLIVVLNDNEMSISKNVGGLSVYLSKIRTEPFYFKVKEDIDIILNKIPAIGKSAVKALGRVKGTIKYMIMPGIVFEELGFKYLGPIDGHNIAELENVLTRAKNTKGPVLVHVCTQKGRGYTYAEKNPAVFHGISPFEVETGEVIANKVPGYSDVFGSEIVRIAEKEERVVALTAAMPHGTGLIKFSKRFPERFFDVGIAEQHAVTFGAGLAKNGMIPVIALYSSFLQRAYDQVVHDVALQNLHVVFAIDRAGIVGEDGETHQGIYDISFLRHIPNMTILAPCDYNELAKMLEYAVLEHSGPIAIRYPRGAGPEKLFDTPDIKLGQSLLISEGNDVTIAAVGNKVEVAMKVAEKLKETGLSADVIYCRFIKPLDSNTIINSVLKTKRLVTIEDNTVEGGFGSRVLETINQKGINVTTRMFGYPDAFIPHGSIKELVHMYRLDPDSIFNDVLKLINKSKVKEFRAIR

SEQ ID NO: 16794 - protein, 193 aa, Clostridium thermocellum ATCC 27405
MAMKKYKISLVIFDMDGLMFDTERIGVLGWHEAAKSFGIEIKQEFLRDMTGLNVKSIEKVFKKYYGNDLPFYDIRDLRVKYVLDYIEKNGMPVKPGLFELLDYLDHRGIMKAVATSTERKRTEKYLTLAGIRERFDAIVCGDEVERGKPEPDIFLEAARRTGKRPEECIVLEDSANGIKAASRAKCFRCLFLT

SEQ ID NO: 16795 - protein, 260 aa, Clostridium thermocellum ATCC 27405
MFNMQKRDLFSLKGRVAVVTGASSGLGVQMAKALAAQGADIVILARRKEKLEKVAEEIRQFGVRCLPIECDVTKIEMVRKAAELAEKEFGKVDILINNAGSGGIAPAEETSDEMWSNTINVDLSGVFMVAREFGKIMIKNKYGRIINISSIYGMVGNMAHPSAAYHAAKGGVINLTRALAAEWAKYGITVNAICPGYFVTELTEDVLNTEYFTNYMKSTVPMGRYGKEGELDSTAVYLASDASSYVTGAVIPVDGGYTCV

SEQ ID NO: 16796 - protein, 445 aa, Clostridium thermocellum ATCC 27405
MLMRKVENMFVSKALKVNSKNHLEIGGCDCVDLVNNFGTPLYVMDESLIRENCRIYKNALDKYYNGNGLVLYASKAFCTMAMCKIVQQEGLGLDVVSGGELYTAIKAGFPMEKVYFHGNNKTIDELELAIDNNVRRIVVDNRQELLHVNRIAAEKGKTVNISFRIKPGIDAHTHDFIRTGQIDSKFGVALENGEAMEIIGEAVKLSNVKVVGLHCHIGSQIFELAPFEEAARVMLTFIAKIKEELGIEIEELNLGGGFGIKYTQDDDPIEYDRYIKSVSEVVKSVCEDKGIKLPFIVIEPGRSIVASAGITLYRIGTIKDIKGVRKYIAVDGGMTDNPRYALYQSKYEGVIANKADAAKTEKVTIAGKCCESGDLLGKDVLLPEAEEGDILAILATGAYNYSMSSNYNRIPRPAVVLVKDGKARVIVKREDYNDIIRNDIIPEDL

SEQ ID NO: 16797 - protein, 230 aa, Clostridium thermocellum ATCC 27405
MRAAEQVKVDVAYSHNNVKIIGISGGISYGALGATHHSLQDIALMRAIPGLIVEVPSDANQMRALVGKFLSIDDPVYVRIGRGPVPVIYNENCDVEIGKAITWFDGTDAAIIACGQMVWRALEAAKELEKEGIHVTVVDMHTIKPLDEETILSVAEKCGCVLTLEEHSIYGGLGGAVAEVLKTQTKASLMIVGIPDEDVPNGTDEEVFSYYGMDVPGIVLKVKELIEKKK

SEQ ID NO: 16798 - protein, 584 aa, Clostridium thermocellum ATCC 27405
MERKCFEGEPVSAGTKMGKIFIVKESDIKINEGLIDESEVEDQITNLEVAICRTFIEIYDLNDGFKGILSEEENRIFEFYKEILDDQTFFEEIKSLIKNERYSAEKAIYTCINKYIDEISKSNNEYIKQRIFDLNDIAKRLVRNISVSVADENGLKINEINSEQIMVLKELTPIIAASLAKKEVKGVVAEEGAGYFTHASIILRSTGIPAVNGIRMDEIEKFDGSPAIIDGSKGVVVANPSEAEIQDLKSGLSEKKQALKNGRNGAAACERKPVETADGYRIRLLANISSVKEFLVAKKLGVDGIGLVRTESLFINYKRIPDEKRQYLIYSKIAKDLDGKPVVIRTADIGGDKVPQALAINDQSLSRSARGIRRSLEHKTELVTQIRAIMRAGKFGKVFISFPMVDSIEQIMEVKRIIKDISDELAEKKGEPVNRIGIGTMVETAEAVKIIDEILNEVDFISIGTNDMLHQICEQSRKCSTLEMRSYLEPVFLQTLKHCLDKAAEKNKPACVCGEMATDPMAIVVLLGMGAKDLSMSPSYIENTCRFIRTIKLDEAKEAAQKALESQNLQEVKNMLSELTKNRM

SEQ ID NO: 16799 - protein, 130 aa, Clostridium thermocellum ATCC 27405
  unsure (1)..(130): unsure at all Xaa locations
MGIIRXXXXXXXXXXXXXXXXXKVMPMMEAAKIGDLFITATGCSRVIHREHFKVMKDGAILCNAGHFDVEVSVKDLEEMAVRKEEQRKNIMGYMMEDGRWINLLAEGRLVNLAAGDGHPAEIMDMSFALQ

SEQ ID NO: 16800 - protein, 414 aa, Clostridium thermocellum ATCC 27405
MGSVIRDISLAKSGRQKINWVRKNMPLLRSLEEEFAKTKPFDGIRITVSVHLEAKTAYLAKLFAIGGGQVSVTGSNPLSTQDDVAAALAEDGLNVYAWYNATEKEYKEHLNLALDGRPNIVIDDGGDLVHLLHTERTELLSDVMGGCEETTTGVIRLKAMEKEGALKFPMVAVNNAYCKYLFDNRYGTGQSVWDGINRTTNLIVAGKNVVVVGYGWCGKGIAMRAKGLGASVIVCEVDPIKAAEAVMDGYKVMPMMEAAKIGDLFITATGCSRVIHREHFKVMKDGAILCNAGHFDVEVSVKDLEEMAVRKEEQRKNIMGYMMEDGRWINLLAEGRLVNLAAGDGHPAEIMDMSFALQALSAKYVLENHSRLGKKVIDVPEEIDRRVALMKLESWGITIDELTEEQKKYLDSWC

SEQ ID NO: 16801 - protein, 213 aa, Clostridium thermocellum ATCC 27405
MDGLMIDTERLYFEVERIMARKFGKEVKDETLWKMMGRKPLEAITVFAEDLELDISPKKLLEIRDELFVKKLVNEVEPMPGLFDILNILKGKVKMAIATGSPQKFLKIVLDKLKIESYFDVFVTSDEVEKGKPDPEVYNTAVKRLKVAPFECVVLEDSSNGALAAVRAGCYTIAVPTVYTNKQDFSFVNYVAKDLKDAAEKINEFLCSQEIEF

SEQ ID NO: 16802 - protein, 154 aa, Clostridium thermocellum ATCC 27405
MDDFMKEAVKEAVSGMRQNHGGPFGAVIVKDNEIIARAHNEVIKNNDPTDHAEMIAIRKAAKKLSRFDLGDCELYSSCEPCPMCFAAIHWAKIKKVYYGCTREDAAKIGFDDNYIYEVIKGETDEKRVSLVQTDRDACLEAFKEWERKQDKVQY

SEQ ID NO: 16803 - protein, 250 aa, Clostridium thermocellum ATCC 27405
MNSMQLKGKTAIVTGSSRGLGKAIAWKLGNMGANIVLNGSPASTSLDATAEEFKAAGINVVVAKGDVKNPEDVENMVKTAMDAFGRIDILVNNAGITRDTLMLKMSEKDWDDVLNTNLKSAYLCTKAVSKIMLKQKSGKIINITSIAGIIGNAGQANYAASKAGLIGFTKSIAKEFAAKGIYCNAVAPGIIKTDMTDVLPDKVKEMYLNNIPLKRFGTPEEVANVVGFLASDDSNYITGQVINIDGGLVM

SEQ ID NO: 16804 - protein, 475 aa, Clostridium thermocellum ATCC 27405
  unsure (1)..(475): unsure at all Xaa locations
MVFKRLRLRFNQNRNLDLIFLSFLQDSVFKDIIXXXXXXXXXXXXXXXXXXXXXXXXXXXXXXXXXXXXXXXXXGGILLKGKTVVVGVCGGIAAYKAVELVSRLKKLDADVHVIMTANAVKFVAPLTFRSICHNPVITDMFEEPKIWDIQHVSLAQKADLIVVAPATANIIGKVAGGIADDMLSTTIMAANSPVLFVPAMNDKMYENPIVQENIKKLASLGYLFMEPDTGHMACGTSGKGRFPSPERIVDFVKGILNKSNDYEGLKVLVTAGPTREPIDPVRYISNHSSGKMGYAVAKAALERGACVKLVTGPVNIAPPPGAEVVCVTTAVEMHNEVMKSYGDFDIIVMVAAVADYRCASVAERKIKKSGEKLTLELVKNPDIAAELGKVKGSRILVGFSAETDNLLENAALKLASKNMDMIVANDVTMEGAGFGVDTNIVKLIKRDGSRIDLPVMSKEGVAHRILDEVLSIKNG

SEQ ID NO: 16805 - protein, 358 aa, Clostridium thermocellum ATCC 27405
MKPNSDKKAILLELIEKGKQKGMLTYQEIMDAFEEVDIDPEQIEKIYETLENMGIDVVGDIEAEMEDIQLTEDNLDLSIPEGISIDDPVRMYLKEIGKVPLLTAEEEIELAHRIEQGDAEAKRRLAEANLRLVVSIAKRYVGRGMLFLDLIQEGNLGLIKAVEKFDYRKGFKFSTYATWWIRQAITRAIADQARTIRIPVHMVETINKLIRVSRQLLQELGREPHPEEIAKEMNMPVEKVREIMKISQEPVSLETPIGEEEDSHLGDFIPDDDAPAPSEAAAFTLLKEQLVDVLDTLTPREEKVLRLRFGLDDGRARTLEEVGKEFNVTRERIRQIEAKALRKLRHPSRSKKLKDYLD

SEQ ID NO: 16806 - protein, 206 aa, Clostridium thermocellum ATCC 27405
PFRGRKKEELRNVTLREALNHPNWSMGSKITIDSATMMNKGLEVIEAHWLFEIPQDDIEVLVHPQSIIHSMVEYKDGSIIAQLGSPDMRLPIQFALTYPDRKQNNFSKLDIVKIGSLTFEAPDLEAFPCLGLAFEALRAGGTMPAVLNAANEKAVGLFLQEKIRFLDIPEIIEKVMGRHSVKPDPDIDDIIDVDLWARKIVEEIVK

SEQ ID NO: 16807 - protein, 140 aa, Clostridium thermocellum ATCC 27405
MPAGIFLTRKKYIQKILENSDVSYVGTKDTTISGCRNGLSALLLWYQINRKGVEGFKQDVRQCMEVTAYAKARLDSIGWNNFVNPWSNTIVIDKPNDAICNYWSLACEGDKAHIIIMQHVTKEHIDLFIEHLLNSKYTIN

SEQ ID NO: 16808 - protein, 254 aa, Clostridium thermocellum ATCC 27405
MSTQQNLFINSIFDTSVTADLKSNSESLLEEIDKIYEDLYEKHQHYLGYPFNLNLEYAEFGKFLNLQPNNLGDAFYSSTVNIDTKKQEREVLKFFADVYKLPWEEAWGYIGHGGTEGNLCGMLVARERYPDGIFYFSEASHYSIKKNAWILGKPGEVIPSQPNGEFDYNALIERILKNGNKPVLLVATLGTTMTGAIDNVQIIVDLFKKHNIKEYHIHYDGALFGGMIPFMENGPELNFETCPSILSQSVVINL

SEQ ID NO: 16809 - protein, 412 aa, Clostridium thermocellum ATCC 27405
MIQITTQTIQIVAILISLLSLGVAAWLYSWVKSQPSSNARIAEIGGYIRQGANTFLRREYLILARFTAIAAVLILIFLPHPIWSGNITQNIWMAVSYIFGTVLSALAGKIGIQIATIANIKSAEAAQKGVKPAFMTGFRGGAVMGMAVVGTSLLGVTLVLLIVGDASAVLGFSFGASSLALFAKAGGGIFTKTADISADLVGKVELGLEEDDPRNPAVIADNVGDNVGDVAGMGADLFDSNVASMAAALVMATALGGPDSKNVAMVFAYAAIGLLSSVIGVATARIGKNGDPGKALNSSTYVTTAIFAVLTALSTYIFNFEWRIWGATAIGLIVGTIIGLTSDYFTNDAKPPVRAVANASKSGPAFTILSGFSYGLLSALPSLIGIAVTALISYYICEPLGSGYGMFGISMS

SEQ ID NO: 16810 - protein, 232 aa, Clostridium thermocellum ATCC 27405
TRLIRPTGAKSEFLASMSHEIRTPINSIIGYQYLLKNSVLSPKQREYVENIGLAAKNLLAIINQILDFSKIEAGRMVLEKVDFNIDDVLNELMIIVGMEAKRKGIELRIKVDEDVPRFLKGDITRLKQVVMNLVSNGIKFTHEGYISIRVELVEKNEENACIKFSVTDTGIGISDEQKKLLFQAFTQGDASTSRKYGGTGLGLAICKRLCGAYEGGNKCRKRSRQRFYLQFF

SEQ ID NO: 16811 - protein, 110 aa, Clostridium thermocellum ATCC 27405
MEKSKFEAILDAVKEENNCENDCDLSAENLKEVVRRYKELFKKEKGFDFPQDPKTQLMEAVKAVFRSWENPRAIVYRRLNDIPGDWGTAVNVQEMVYGNMGNDSGTGVAF

SEQ ID NO: 16812 - protein, 467 aa, Leuconostoc mesenteroides subsp. mesenteroides ATCC 8293
MIRANQLCFKKILEEVIMVDKKKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAGLWFGAITILFMDLSSNVAMQPFKMVVGDMVNEDQKSYAYSIQSFLSNTGSVLATIFPFLLTAIGVANTAPKGQVPASVIISFYVGALVLVVFSLIAVFNVKEYDDATYELYHGYALNTPNDGEGGFLTLLKRAPKTFWMVTLTQFFCWMAFQYLWTYGTGAVADNIFHATDPTTAGYQNGGNWFGIMSAVYAIAAVVWSLVLSKIPANKNKTGYALSLFLGAIGFTSVFFIHSQYLLIGSFILIGISWAGMMAYPFIMVTNALPGDHMGTYLGLFNGSICLPQIVASVASFALFPALGSHFPSMILVSGILMLIGAVSVGFINEIHSNPVDAQ

SEQ ID NO: 16813 - protein, 302 aa, Leuconostoc mesenteroides subsp. mesenteroides ATCC 8293
MYSLVKKEIIMDYKTLASGIEMPLLGFGVFQVQEKGAAKQAVLDAIKTGYRLIDTAASYGNEREVGEAILEAINQGIVKREELFVTSKMWVQDVSAQQATAAIQSSLQRLNLDYLDLYLIHQPYNDVFGAWRAMESAYRSGQLKAIGVSNFDIAQLTNLAEFSDIKPMLNQIEVNPFQQNKKDITYFSQYGVQVEAWAPFAEGKNDLFSNILLRKIADKHHKSIAQIVLRWLTQRNIIVVAKSVKPERMAQNLDIFDFKLTHQELAEIETLDTNSSQFFNHADPDMIKWMANREISYDVTFN

SEQ ID NO: 16814 - protein, 698 aa, Leuconostoc mesenteroides subsp. mesenteroides ATCC 8293
MAILELIVILIVAVTISNIVSHFIPEIPISLFQIAIGLFLALVCGIYVEVDSEWFMLLFIAPLLFNDAWRFPKHELWELRGPILGNSIILVILTTLVGGFLMHLLMPQLPKSVALALAAVISPTDPVAVQAIARRVKLPENVMHIVSGESLINDASGLVSFNTAIKATIAGTFLIGEAIGNFFWMTIVGLAVGLILGSFVSWLRDSFDRVGLNDVVFHTVVTLLMPFVIYWVAEDIFHSSGVIAVVAGGVLSKILSDQHMNARSPEINVVTVRTWEVFVYLLNGTIFILLGIELPAAMKDIVRSTQVHTGMAIFYGVAVWFIIFTIRTFWAYGTQITYHLKHKERAISFRMAIISGLTGVRGAVTMAAVLTVPSTIADGSAFPQRNLLVFVAAVVVIISLLVATIMLPIVTKQRTTHDFTQPEVGEVETSSTHESKVDLTEAQARIFSIRIGIQVLREQQNDHNRIIVYELIGRKQQIIDQIYRQLNKSNDHKVNIEDDRELRRVALEAQRNCLRQLLADEKISILTYSSQNRRLDRLENMIDSDKHYHLSTQWIIILWRRTLRSIRIWISDESTDQFREESSMATKEMAKEAIQSLSEYMEKYTGDTVSHRMERQAAYNLIIFYRNQIEKERHPDTPEQRELDDRYRMELEIKALNVERETIQQLYEQGRISRQAGVNIRQFINYAETAALAGRDEE

SEQ ID NO: 16815 - protein, 292 aa, Leuconostoc mesenteroides subsp. mesenteroides ATCC 8293
MEYKTLASDIKMPVLGFGVFQVQEKGAAKQAVIDAIKTGYRLIDTAASYGNEREVGEGIAEAIETGLVTREELFVTSKMWVQDVSADKAAAAIQASLDRLKLDYLDLYLLHQPYNDVFGAWRAMEAAYKAGQLKAIGVSNFDIAQLTNLAEFSEIKPMLNQIEANPFQQNKKDAAYFAEYGVQVEAWAPFAEGKNGLFSNELLQGIADKYNKSIAQVVLRWLTQRDIIVVAKSVKPERMAQNLDVLDFKLTDEEMQEIATLDTNISQFFDHADPDMIKWMAGREISYDVTAD

SEQ ID NO: 16816 - protein, 288 aa, Leuconostoc mesenteroides subsp. mesenteroides ATCC 8293
MNFKTLNNGAQMPQLGFGVFQIPAEETKQAVVDAINAGYRSIDTARVYGNEAETGQGVNEAIANAVVAREELFLTTKLWLSEFSYEAAKGAIDDSLKKLGTDYADLILLHQPYGDVYGAYKALAEAQADGKVKSIGISNFYPAKFVEFIKVIKTMNLPVPQIDQIEFHPYYQEKVARQLHDKYGVQIEAWGPLGRTANKYDTFHQPELVEIAAKHDKSVGQVVLRWIMQSNIITVAKSVNPSRMAENIDIFNFELDDDDMKKIETLDKNEPIFNHLDISTVERMYGWV

SEQ ID NO: 16817 - protein, 326 aa, Leuconostoc mesenteroides subsp. mesenteroides ATCC 8293
MAVKSYIDAIREAMDLALEKDDDVIIFGEDVGKNGGVFRATDGLQAKYGEDRVFNTPLAESGIGGMAIGLTTQDYRPIMEIQFFGFVFEVMDSIAGQMARNRFRFNGTRNMPIVVRSPYGGGTKTPEMHADNLEGMVAQIPGIRVVMPANPADAKGLLLSSIASNDPVVFLENLHLYRSLKGEVPEGYYTTPLDKAAIAREGDDVSIISYGGGVPVALKAAEELSKNGISAEVLDLRTVSPLDIQSIGETVAKTGRVVVVQEAQRMAGIGAAIMSEISERFILSLKAPIGRVAAPDSVYPFGQAENDWMIKSDDVVAKVVEVVNYD

SEQ ID NO: 16818 - protein, 485 aa, Leuconostoc mesenteroides subsp. mesenteroides ATCC 8293
MMLPLTSGKRFQIFIYCFILFNVNGYKNNILEAEIMDDKHKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAALWFGAITILFMDLSSNVAMQPFKMVVGDMVNEDQKSYAYSIQSFLSNTGSVLATIFPFLLTAIGVANTADKGQVPASVIISFYVGAVVLVVFSLVAVFNVKEYDDATYELYHGYALNTPNDNDGGFLTLLKRAPKTFWMVTVTQFFCWMAFQYLWTYGTGAVADNVFHATDPTTAGYQNGGNWFGILSAVYAIAAVLWSLVLSKIPAEKNKFGYALSLLLGSTGFISVFFIHSQYLLIASFILIGISWAGMMAYPFIMVTNALNGDHMGTYLGLFNGSICLPQIVASVASFVVFPALGSHFPSMILVSGVLMLLGAVSVGFIKEIHSNPVNAH

SEQ ID NO: 16819 - protein, 228 aa, Leuconostoc mesenteroides subsp. mesenteroides ATCC 8293
MQKFKDIKGFAFDLDGVIADTARFHGQAWHQTADEVGTTWTPQLAESLKGISRMESLQMILDAGNHADDFSQADREALAEKKNHFYQRLIATLTEDDILPGMKSFIHSAKVAGYKMSIASASKNAPMILDHLGLANDFVGIVDPATLTKGKPDPEIFVRAAEVLELAPNQVIGLEDSAAGIESINSAGQISLAIGDAVVLSAANLIFSSTVDVTLQSIQSKMDKIKSN

SEQ ID NO: 16820 - protein, 457 aa, Leuconostoc mesenteroides subsp. mesenteroides ATCC 8293
MNIMSSNEHKKGQLPMLTSMQLFLMTFGYAGVQVAFSVQTGNMGRIFQTLGSDPTKLGFFFILPPLAGMITQPLIGLFSDKTWLPKLGRRMPYLIGGCLVSLIVLLLLPNTGSFGFGYGSMTALWFGAVTVLFMDLSANVSMQPFKMIIPDMVNEKQTDKAWSLQNIWGSLGGVIAFVFPFILTSFGVANTAARGVVPDSVKISFYVAAAILLLSTIFTIINVKEYDPETLAYYHGFRSDDKTHESFIDILKHAPKVFWTLGIVEFFVWFGIPYMWTYSTGALSENIWHVSDPASAGYQAAGNWFGILQAVYSVVAIVVGILFQRLNDKTRKMTYFLSLIAGGLGFIIVAYGHTHVSSLIGFVLIGIGWIALISIPFTILTNALDGKHDGVYLGLFNCFICIPQIVASVASFAIFPAVGKSMAHMLAIAGVFLMIGGCLIWIVKEEKTQVDMTQKGE

SEQ ID NO: 16821 - protein, 431 aa, Leuconostoc mesenteroides subsp. mesenteroides ATCC 8293
MMTYPINEKQHLTVDGVDTIELAKTYGTPLAVYDVTLIRKTMRAFKRIFEQENVPYVVSYAGKAFATKAIYQVAAQENIHADVVSGGELYTAIKADFPTQHLSFNGNNKSYDELVMAVENGVGTIIVDNFLELQLLSEITAEKNVIQDILLRISPGISAHTHEFISTGQQDSKFGFDLQTGQAKQAYDIAIKDNHLHLRGLHAHIGSQIFDVTGFEKNAALLADTAYSWGWQPEVINTGGGFGIRYTDEDQPLPENEFADAIIRVLKEKATQYDWAMPEIWIEPGRSIVGPAGQTLYTVGSRKDIPGIRNYLAVDGGMGDNIRPALYQANYEAVLANQPNAKSEEIVRIAGKYCESGDVLVWQEELPATKPGDILSVLATGAYGYAMASNYNRNPRPAVVFVENGQHQVVVERETFEHMISLDQDYTLGDK

SEQ ID NO: 16822 - protein, 233 aa, Leuconostoc mesenteroides subsp. mesenteroides ATCC 8293
MAENEAQKLINFIANAKKITPVKVTYKGTLATEVPDTVQQFGDESFGQLIGDWSEIELLIKNLPSEDVFIENDSRNSAVPLLDKKEINARIEPGAIIRDQVEIGDNAVIMLGAVINIGAEIGANTMIDMGAVLGGRAIVGENSHIGAGAVLAGVIEPASAQPVRIGNNVLVGANAVVIEGVQVGDGAVVAAGAIVTKDVPANTVVAGVPAKVIKEIDSKTQQKTALIDALRGL

SEQ ID NO: 16823 - protein, 280 aa, Leuconostoc mesenteroides subsp. mesenteroides ATCC 8293
MSLNELYELNDGHQLPKIGLGTFQIRGYQGVDQILNAIQIGYRLLDTSTNYDSEGAVGEAIRRSGIPRSQFYVTTKLPGKYHHFDDALKIIEESLLRLGLDYLDLYLIHWPLPKRDNYVEAWQALIEAQRRGLVRSIGVSNFEKEHLDKIISATGVTPAVNQNEIHPYWPQESLVATNQEYGIVTEAWSPLGRGSSELTEPLILKLAEKYDKNAGQIILRWHIQRGILPVAKSTTPQHQRRNLDIFDFTLTETEVSQISDLERKDGRVDDQDPKEYEEFV

SEQ ID NO: 16824 - protein, 386 aa, Leuconostoc mesenteroides subsp. mesenteroides ATCC 8293
AAGKASKPKSAKKSGPLKNPEYDKATKALIAEYKAAKQITYAALSKRLAEPFNLDEENIERLMEKVEDAGIAIVDDNGDPAPEVLKAKQNKPTDQELAEAEETPAGIKINDPVRMYLKEIGRVNLLKGNEEIDIAKRIENGDVEAKQELAEANLRLVVSIAKRYVGRGMQFLDLIQEGNMGLMKAVDKFDYTKGFKFSTYATWWIRQAITRAIADQARTIRIPVHMVETINKLIRIQRQLLQDLGREPLPEEIGAEMDLTADKVREILKIAQEPVSLETPIGEEDDSHLGDFIEDNEAVSPADSAAYEMLREQLESVLDTLTDREENVLRLRFGLEDGRTRTLEEVGRVFGVTRERIRQIEAKALRKLRHPSRSKQLKDFMDESTN

SEQ ID NO: 16825 - protein, 412 aa, Leuconostoc mesenteroides subsp. mesenteroides ATCC 8293
MFKTFHDIINGMNDFYRNKNILVIVTGSISAYKSATLVREFVKSGAHVRVGMTAAAQKFITVQTLAVLSKHDVLTDLFRDEKAAVTHIEWAKWADMIFVVPATANIIGKIANGIADDAVTATVMASPAAKVIAPAMNDVMFNNDAVVRNLNLLKSDGWFIIDPAIGFLAEGYESQGRLPEPVTIINQAAIRIQARGGELKGKKLVITAGGTREALDPVRYLTNRSSGKMGYALAQVAAELGATVVLITTTKREELYGVREIVVTSTRDMHTAVVQEFSDADVFISSAAVSDYRPASQAENKIKKVGHENLTIELIQNPDILSDIGHMKKAGQIVVGFAAETQNVLASAQKKLSKKNADFLIANDVSNVDSGFDSDNNKVTILSRDKDPEKIELLPKIDIARAILDRVVKTLA

SEQ ID NO: 16826 - protein, 441 aa, Leuconostoc mesenteroides subsp. mesenteroides ATCC 8293 [sequence omitted]

SEQ ID NO: 16827 - protein, 571 aa, Leuconostoc mesenteroides subsp. mesenteroides ATCC 8293
MTKNFKGIAASNGVAIAKAYLLVDPDLSFEKTTVTNVAAEQARVDDALKASSDDVKLIKAKATESLGAAEAEVFEAHLMVLADPEMSGAIKQKIEDDKVNAEQAVKEVTDMYISMFDAMTDNEYMQERAADIRDVTKRILSHLLNISLPNPALIDEEVVLVSKDLTPSDTAQLDRQFVKGILTDLGGRTAHASIMARTLEIPAVVGSEKATVEVSSGDLVIVDGLTGDVIVNPDADTLATYQKKAADYFAQRAEWAKLKDEKSVSADGKEFIVGANIGAPKDMQAVLDNGSEGVGLYRTEFLYMESDHLPTEDEQFEAYKSVVEQMGDKPVTVRTMDIGGDKHLDYWKLPEEENPFLGYRAIRISLDQTDIFRTQLRALIRASAFGNLWIMFPMIATLSEFRAAKKIYLEEREKLEKAGVATGEVKLGIMIEIPAAAILADKFAKEVDFFSIGTNDLIAYTMAADRGNDRVAYLYQPYNPSILRLINTVISAAHKEGKFVAMCGEMAGDPVAVPLLVGMGLDEFSMSAPSVLQTRSLMKKLNTADMKVLAEKALDVETNDEVIELVKEATK

SEQ ID NO: 16828 - protein, 408 aa, Leuconostoc mesenteroides subsp. mesenteroides ATCC 8293
MNIGLFTDTYFPQVSGVATSIKTLKEALESQGHEVYIFTSTDPKVPKNKFESHIYRFSSLPYLGFKDRRLAFRGLIQAVEIAKSVQLDIVHTQTEFSLGLMGKFVARQLKIPAVHTYHTMYEDYTHYFAKGMLIGPHGVGRIMKGYMVSMAGVIAPSNLVQDTLRRYGVTVPMRVIPTGVCLPEHGTKQTNLREKYHFSELQPIVLSLGRLAFEKNISVTISVFSEVLQTIPEARLVIAGDGPARKSLEEQVEELALEDKIIFTGMVNHDDIFDYYKMSNVFVSSSDTETQGLTFIEAMAADRPFVAIHSPYLDNLVDNEAIGTLVSDYDELLAGITKYLKRPNTEEDIAYRHKKMKDVDANTFATRVLAFYDDILASYHASDVEDEYPNDEEVGYMKRILRNPFRRN

SEQ ID NO: 16829 - protein, 463 aa, Leuconostoc mesenteroides subsp. mesenteroides ATCC 8293
LFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 16830 - protein, 193 aa, Leuconostoc mesenteroides subsp. mesenteroides ATCC 8293
  unsure (1)..(193): unsure at all Xaa locations
MFILEDLMQKFSSTNKFVPMGLTFEDVKLVDDLQSTVTPESVSVTTSLTPTLKLNIPLLSAAMDTVTEARFATALAKLGGLGVIHKNMTISAQADEVRKVKTATFDSADFPNAAVDVKDICLLLVPLVXXXXXXXXXXXXXXXXXLPRPKSRDYPQMFLTIQKHLWISVSQMLFLCLKMMADPLTIVLTKRPD

SEQ ID NO: 16831 - protein, 387 aa, Leuconostoc mesenteroides subsp. mesenteroides ATCC 8293
MFILEDLMQKFSSTNKFVPMGLTFEDVKLVDDLQSTVTPESVSVTTSLTPTLKLNIPLLSAAMDTVTEARFATALAKLGGLGVIHKNMTISAQADEVRKVKTATFDSADFPNAAVDAKGHLLVAGAVGVTNDTVDRVQAMVEAGADAIVLDSAHGHSEGVLRKVSEVRSTFPNLNIIAGNIATREGAAALYDAGADVVKIGIGPGSICTTRVVAGIGVPQVSAIRDAALEAAARGKKIIADGGVKTSLDIVKAISAGGNAVMLGSMFSGTEETPGEVFEDNGQKYKTYRGMGSIAAMENGSKDRYFQGEVNEAKKMVPEGIEARVTYKGDLTTILNAMLVDIHKKMAQLGETTIDDLVNHEHIARDSEVFDFEAATDKQKPVVAAQF

SEQ ID NO: 16832 - protein, 328 aa, Leuconostoc mesenteroides subsp. mesenteroides ATCC 8293
MPENTEFIGLGYDQVLLVPGASNVLPYSVTLRTQLSENFELNIPLVSEAFGPETDTRVAPTALNGGLGVVAEQEDLSKQVASLQQVKETVVDTDKYPNALVDSQNHLRVAAEVWLVAGAETRVAALVNAGADAIFFYLHETLAKNTRDLIKQIRQAHPDLFIAVGVVEDQSIAAALYEAGADTILAGRSVDSSLPNDITYPFLTVTMNIADVAAAYDNKSVIAVGGIHYSGDIVKAIAAGADATMVSDLLKGSVLESDGSFKEGDMSIDDAIFQTDGGLRAGMGYTGSQTIESLKLNAKIVQITDNGLRESHPHDVEITKQAPNYAKG

SEQ ID NO: 16833 - protein, 306 aa, Leuconostoc mesenteroides subsp. mesenteroides ATCC 8293
MVTGAIKTTPYNKRLTEVNNMSLVDTYKLTNGIEIPIIGFGTWQSANGTEAYQSVRWALEAGYRHIDTAAVYGNEDSVGRAIKDSGIPRDELFVTTKLWNDAHTYERAIQALDTSLSKLGLDYVDLYLIHWPNPAALQKQGKDAWIDANADTWRALEDEYKIGKTTAIGVSNFQIEHLEALAKTQTIAPMVNQNFLNPSDNQQELVDYDKDHGMLNEAYSPLGTGKLVDLPQVVSLSEKYNKSVPQILIRWSLDKGFLPLPKSTHETYIKANADVFDFALTSAEIESLDSLTGVGGFHTDASSADF

SEQ ID NO: 16834 - protein, 167 aa, Leuconostoc mesenteroides subsp. mesenteroides ATCC 8293
MIRNYDPAISSNLQIILTYSGLHAVWFYRISHQLWQLNLKLLAHLCSQWGRLITGVEIHPGAQIGRRLLIDHGSGTVIGETAIIGDDVILYHGVTLGSTHHALGDTSRRHPKIGNHTLIGAHATILGNITIGNHVKIGAATVVLHDVPSHVTIVGNPAHILHKNPNI

SEQ ID NO: 16835 - protein, 168 aa, Leuconostoc mesenteroides subsp. mesenteroides ATCC 8293
MAQIPAFSDEQIDYFMQEALNEAKIAQSEGEVPIGAVIVYENQMIACAHNHREADQLATAHAELLAIESANTKLKSWRLENTALFVTLEPCIMCAGAIINARIPVVYYGANDPKGGATRSLYSLLEDNRLNHMVKVYEGIRGEESGLLLQRFFSNIRAKRKIRKAIAK

SEQ ID NO: 16836 - protein, 277 aa, Leuconostoc mesenteroides subsp. mesenteroides ATCC 8293
MTFHELSDGQHLPEIGFGTYKLNGFAGTQSILSAVDAGYRLFDTAFNYQNEGTVGQAIQQSHVNRDELIITSKLPGKYYSSYQDSIDLIQESLYRSKLDYFDLYLLHWPNPIDDHYLEAWHTLIQAQKFGLVKSIGVCNFLPEHIERLKKETNILPVVNQVELHPYFNQQELREYNNTQNILTQAWSPLGRASAILKDPVLVELAKKYHKNIGQLVLKWEISLGVLPIPKASSYARQKGNLDLFDFEISSSDMQRINDLTKPDGRTNNQDPAVYQEF

SEQ ID NO: 16837 - protein, 243 aa, Leuconostoc mesenteroides subsp. mesenteroides ATCC 8293
MADFTDKTVLVTGSSRGIGLAIAKAFDAAGANVILHARSEISPETLTEFKSEPKTLQFDIADAEAAEDSLKVLYKQENFSGIDILINNAGITKDQLAIAMTPADFAQVVNVNLNGTFNVTQPVFKKMIRQKHGAIINLASVVGLMGNMGQANYSASKAGLVGLTKTLAKEGARRHIRVNAIAPGMIVSDMTGALPEKTQEEILKNIPLSRFGEASEIADVALFLAGNDYITGQTITVDGGLYI

SEQ ID NO: 16838 - protein, 164 aa, Leuconostoc mesenteroides subsp. mesenteroides ATCC 8293
MFFTAKSILKRDPAAKSLMMVILTYPGLHALWFHRVAHWLHIHHRYLLAAIISRWSAKRTDIFIAPGAQIGRGVFIDHGVGVVIGETAIIDDGVTILHGVTLGARHAVTERRHPHIESYSFIGAHAQILGNITIGANSKVGANAVVLNDVPAYSTAVGNPARLV

SEQ ID NO: 16839 - protein, 104 aa, Leuconostoc mesenteroides subsp. mesenteroides ATCC 8293
LHLMYSLVKKEIIMDYKTLASGIEMPLLGFGVFQVQEKGAAKQAVLDAIKTGYRLIDTAASYGNEREVGEAILEAINQGIVKREELFVTSKMWVQDVSAQQATA

SEQ ID NO: 16840 - protein, 485 aa, Microbulbifer degradans 2-40
MSLTLTNSKLQRQGSVIDGAWLQSSDEFVVENPATGQVVATVANAGAAEAEAAVLAAERAGVQWREFSAKKRSTLLKAWYELVVSNANDLAVLLTTEQGKPLAEAKAEILYGASYIEWFAEQAKRIEGAVIPAPASNQRIVTVKQPVGVVAAITPWNFPMAMLARKIAPALAAGCTVVAKPAKETPLSALAMAYLAQEAGIPPGVINLVTGQDSSAIGGVFTQHPSVKKLTFTGSTAVGKTLLEQSAATIKKCSMELGGNAPFIVFDDADIDAAVAGCIAAKFRNAGQTCVCVNRIFVHDKVKAAFTKKLVEAVAKLKVGDGIEEGVAIGPLINAAAFKKVSELVIDACNKGAKAIVAEGHTHLNGALFYPPTVVTEATTQMDVFNEEIFGPVAVVYSFSSEEEAIALANNTPFGLAGYFYSRDIGRVWRVASALEVGMVGVNDTAISNEMAPFGGVKESGFGREGSQMGLDDYLETKYMLMGGL

SEQ ID NO: 16841 - protein, 493 aa, Microbulbifer degradans 2-40
MTVMSSGKLNLLDFTKENIRTLHLTWFAFFLTFVVWFSHAPLKPLIMQAFDMSLAQWKALLILNVALTIPARIVIGILVDKFGPRIVYSALLVTSGFLCVAFASSQSYEQLALLRFAMGFVGAGFVIGIRMVGEWFPARQVGLAEGVYGGWGNFGSAAAAFTLPTLALIFGGDDGWRYAIGITGVIAGFYGIFFYWRARNTPKGSTYFKPKKSGGLEVTSKRDFWFYIAMNVPMYLILAVLAWKLSPSGVNLLTQTAVNVLYVGLVALFIFQFTQIYKVNKDMLKNGAPEHDKYPFKQVAVLDWAYFVTFGSELAVVSMLPAFFLETFTDLSLAQAGMLGAAFAFMNLIARPGGGYISDRFGRRKSLSIFIAGLAVGYFVLSQVGASWPVAAAVLAVMCCSFFVQAGEGAVFAMVPLIKRRMTGQIAGMAGAYGNVGAVTFLTVYSFVDASTFFMIIGASAAVVFGIVQFIEEPQGHTTEVMEDGTVQKIEVS

SEQ ID NO: 16842 - protein, 496 aa, Microbulbifer degradans 2-40
MSTANFNVLHFSDPKVRTLHLAWIAFFITFFMWFCHVPLMPLIKDTFGLSMAEAKALLFLNVALTIPARTIVGSLVDKYGPRVMYSALLAISGCICFMFAWAQDYTQLAAARFLLGFAGAGFVIGIRLVTDWFPAKTAGAAQGIYGGWGNFGAAIANWALPAMSSILIGYVGVAYSWRVAITIAGVVAIGYSFIFYIMVRNTPKGATYFAPKKVGAMEVSNKADFVLYMIMLSPIFLAMGVICWRLSPAQVGLLSEFVTYAIWAGLLLWFCWQAFGAYKLNAEAIHEGVVGIHKYKFKQVALLDLSYAVTFGSEVAVVSMMPLMFSNEDTYAFSLAKASVMAGCFMAMNLIARPGGGWLSDKLGRKKTLMLTVAGSAIGYAGLSMMTPDWSLLAIGAVVVFCSFFVQAGAGATFGVVPTIKRRLTGQIAGMTGAYGNVGAALFLLVNSFYAPNVFFGVITGACIVVLGLLFLFMEEPKGQIAEVLPDGTVEMIDVG

SEQ ID NO: 16843 - protein, 273 aa, Microbulbifer degradans 2-40
MSQVFDFSGRTVVVVGGTSGINRGVAECFARAGAKVAVASRSQEKVDETVAALQQAGAEQAMGFAADVRDVDAIAAGLQGIATVMGSIDVLVSGAAGNFPALAEDLSANGFKSVIDIDLLGTFHVMKAAFPHLTKPGASIVNISAPQAFLPMQAQTHVCAAKAGVDMVTRCLALEWGEHGIRVNSLVPGPIEGTEGMKRLAPTPELMELAKQSVPLQRLGKPEDIGNMCMYLASEQAAYVSGAIIPVDGGWSLAGASGLSQTLVQMLKQLKNM

SEQ ID NO: 16844 - protein, 360 aa, Microbulbifer degradans 2-40
MSDALRQQVSALLESISIPHVAGFSCADVAEMAVEGDKVLVRISLGFPCEGIKQALASNVESTLASNGIQVGGVEVVQDIPAIVPKNTSSSIGGVKNIIAIGSGKGGVGKSTTSVNIALALAHMGAKVGLLDADIYGPSQHQMLGVAGKRPEMYGPNMIEPIKAHGLSLISMGNLVTEDTPMIWRGPMVSGALQQLLQNTHWVDVDYLIIDMPPGTGDIQLTLSQAVPVSGSVIVTTPQDIALLDAVKGIEMFRKVNIPVLGVVENMSVHTCSNCGHQEAIFGEEGGNKLAKQYDVNVLGRLPLQLDIREQTDQGKPPVATNPESDVSLIYREIATQMTVNLWRQGLAAPAAPEISFSDD

SEQ ID NO: 16845 - protein, 1368 aa, Microbulbifer degradans 2-40
  unsure (1)..(1368): unsure at all Xaa locations
MSKQNKNKFTHSIQKTLIQWFLLLSLVPLFLVAFIGYQVARNSLVASAQDHLESDARNTMNFLNNWFEYRLMDSLSGAQDENNIKFLQELHEAAVQTELSIESFHKSIKWAEITASRQGGLVDISRNYDYIYDVFLIDVDGNILFTVAKESDLGTNLVHGKYANTKFGGTVRKTLATGQTLFADFEHYEPSAGIIAGFVVSPLVNSEGQRIGAYAMQFRIDRIINHLKLNSASMYRHYLVGPDGTLRTQRRQSEQLLITQINTAPVKRWLEANETAKHSDKPKLIKYSEADGTVYLGMHQNLTLRNLDWLLVSEVKEADALASSNWLAGVMLLSVWFTAMLLSVLAFFLSIRITNPIKAITIVANKLVKGDFSQRVQVQESNEFGLLANSFNELIQSRKYYELELLAAKNEAESSSRAKSEFLACMSHEIRTPMNGVLGMLGLVLNSSLTPEQERKLLLAQSSGQSLLSVINXXXXXXXXXXXXXXXXXSASMYRHYLVGPDGTLRTQRRQSEQLLITQINTAPVKRWLEANETAKHSDKPKLIKYSEADGTVYLGMHQNLTLRNLDWLLVSEVKEADALASSNWLAGVMLLSVWFTAMLLSVLAFFLSIRITNPIKAITIVANKLVKGDFSQRVQVQESNEFGLLANSFNELIQSRKYYELELLAAKNEAESSSRAKSEFLACMSHEIRTPMNGVLGMLGLVLNSSLTPEQERKLLLAQSSGQSLLSVINDILDYSKVEAGKLELEHLDFDPHRLLSDVVQSFNYSAQEKGIELVLDDIGLGGKVLRGDPSRLRQIINNLLSNALKFTSQGEIIVRAKLDSEINGLNQLRCSVTDTGIGIPSDKISGLFDSFTQVDSSTTRRYGGTGLGLSICKMLTRIMGGDIFVVSEVGKGTRFDFVVHVETGSCLPVDNAESDVTGLNVLLVDDNLTNLDVISGQLISWGIHVTKVAGPEQALVLVAEVQDTVFDLVLMDCHMPNINGIDLAERIQGSPCIKPNSVIILSSSADMASRFHMQEVGVVGCLMKPVSAPYLHQAIQYFIQIKKSNKQQFITPALLESVHATTESTANPNIVWGDNVRILVVEDNLVNQQVIAGILEDFGLAFTLVDDGQQAISALKENTGDLRYHFVFMDCQMPVLDGYNATKQIREGAAGEECKIVPIVALTANAMQGDRDKCLRAGMNDYVAKPVDADEVRLALVSWLPAELRTDEAAIENNPETPDTPDILEKKSPPAEENPVEPQVVKVDLGLLKLPKGLVIHTPAMLQPMFKNKPERYVKILTTLLNAHASFNTSLNEAFANNDTEQVRHLVHAMKGSSGNISMGKVHEYCKQVEAQIDADGAASAEYINKLQQLIEAMFDEANQIVELNS

SEQ ID NO: 16846 - protein, 421 aa, Microbulbifer degradans 2-40
MCWIASMAWWPQYLFSLLPISRPAGAYKSMQQICVLGSTGSIGISTLDVLASHPDKFSVYALTANSSIDLLVEQCLKFSPQYAVIRDEALYLPLKQRIESLNCTTEVLAGEQALCDVASAVQVDSVMAAIVGAAGLAPTLAAVEAGKRVLLANKESLVMSGKLFMQAAKAASALVLPIDSEHNAIFQCLPQPYTSLADAGVQKILLTGSGGPFRDTPLADLSAKTPDQACAHPNWSMGRKISVDSATMMNKGLEFIEACWLFDATPEQIEIVVHPQSIIHSMVQYVDGSVLAQMGNPDMRTPIAHCLDWPRRIDSGVASLDFFALQGLDFCRPDYQRFPALALATSAIKSGGTYPVALNAANEVAVALFLEEKIKFTDIAAIIAAVLEDWETCEPDTIAAVKEADAIARKLAYSVAAKFGY

SEQ ID NO: 16847 - protein, 470 aa, Microbulbifer degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 16848 - protein, 489 aa, Microbulbifer degradans 2-40
MAAGWGDNMKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 16849 - protein, 258 aa, Microbulbifer degradans 2-40
MTSPVLNSFNLEGKVALVTGCKRGIGKAMAVALAQAGVDVIGVSASLESEGSDVAKAVEATGRKFSAYKCDFNSREAIYTFIEQVKAAHPVIDILVNNAGTILRAPAAEHGDSLWDEVINVNLNSQFILSRELGREMVKRGSGKVIFTASLLTFQGGITVPGYAASKGAIGQLTKALANEWAGSGVNVNAIAPGYIATDNTQALRDDPERATSILSRIPQNRWGKPEDFAGPVVFLASEAASYVNGSVMVVDGGWMGR

SEQ ID NO: 16850 - protein, 942 aa, Microbulbifer degradans 2-40
MKSQSVQTELFRLITVPVFAACFILASTFFYLQKSHIEDQFSNNKHLATELLNSVVFSNKASTNPFAEAANALLATGDYRSIVVSSATGQQIASYGLPLRTHSYQTQLGVESQWTHEDSLIYSFPLKKSNLQSSTPLWVIIAIDKRSWAISEYQGTITILLAGSLCLFLTFYFARRFRDALATPLQKIETGLRDFLKGNFEKSITIEPSSVFKDLASNINRLGALQKSANDELQLNIDQSTHELRETLETVEIQNIELDIARKSALQASRVKSEFLANTSHEIRTPLNGILGFSELLRKTELNNQQVDYLTTIEESAKGLLTIINDILDFSRLEIGTLTLEYKPVKIRQLIEDTLKLQTPAANEKNIRMLTIIDHDVPENLLGDPLRLKQVLSNLVSNAIKFTDVGYILLGVSKDQSSENQFTLKFRVTDSGIGLSQDQQERLFDPFTQLDSSESRLHGGTGLGLAIAKGLVDRMNGTIGVESTLGKGATFWFTSTLGRSPSASAKQTYLAGTLRGVHALVFDHSNMGRMEITHYLTGWGAKVCETGEMEDIEPQISFFSNSEPVDIAIIDSMIDIKTFDRLRICEHVTQLNHRFNIPVIILAPSSIQRILEPHLAGTNSLFINRPLFCNKLHQTICEQLEIVATENIESRTYLHQHEPLEQQQVNILAVDDNPANLKLVTELLKGLNINVTPVESGEQAIAQIKDSHFDLILMDIQMPSMDGIETTGHIRELETSGPRTPIIALTAHAVSEQKSRLLLAGMDDCLSKPVSESELRHVIERWTNVTIATKIAPTNPAPVASALIEHSPNADKTGENQPATDSQAAAIVDRALGLSLTNQNPSLAGDMLSMLIETLPDVLHKSRTQYENKQFDELQETVHKLHGGCCYCGVPRLKAISEQIDKNLQKNKYNNLANEIQLLEAEIKNLLQWAEEHDIDVLFSDD

SEQ ID NO: 16851 - protein, 462 aa, Microbulbifer degradans 2-40
MQANTHHALHGQVVSVNPFTEQEVGSYALLAKNSIDRKLDQADVAFKQWRKTALDERIALIKRVATQLAENKQGLATFITIEMGKPINQAKAEIDKCIALCDYYCKNAHQFLRAKPISSNLKNSRVEFQPLGVILGVMPWNFPFWQVFRFAIPTLLAGNTVVVKHASNVFGCAEAIAKTFNQACPENTYIHLPVSSDLIPEVIAHNAVRAVSLTGSEKAGREVAQQAGHHLKKVVLELGGSDPYVVLKDADISKAAERCATSRLINNGQSCIGAKRFIVESAVARQFEELLAEHICKAKMGDPLNKSTELGPLARQDLLENLHCQVLESTSRGAEIVCGGEIPVGKGFFYEATVLTNVAKDSPAYNEELFGPVAAVIPVLDEDEAMQVANETSFGLGSAIFTADSNKAEQFAANVEAGACVINDFVRSTPELPFGGIKNSGFGRELSEFGIHEFVNIKTIAG

SEQ ID NO: 16852 - protein, 627 aa, Microbulbifer degradans 2-40
MNRPFSPLVGSLSRRRFVQGLAVGGVLATTPAALLARESVQTALGSAPVLSGTDINLEIGQSLVNFTGVTRMATTINGSIPAPTLRLREGDDVTIRVTNRLSVPTSIHWHGILLPFEMDGVPGISFKGIAPGETFVYRFKLRQSGTYWYHSHSGFQEMTGMYGALIIEPRSGERHEADQDFVVQLSDWTDEDPMQVFSKLKVQGDTYNFNQPTFFDFTRDVSDKGLKAALSKRQMWNQMRMNPTDLADLSTATLTYLMNGTAPAGNWTGVFKKGERLRLRFINAASNSFYDVRIPGLKLTVVQADGQDVEPVSVDEFRFGPGETYDVLVRPDDEAYTIFAQSMDRTGYARGTLATRQGLSAPVPTLDPVEWLTMQDMMGAMNHEGMGDDASMEGMDHSNMNMEKMDHSKMDHSQMDHSQMHGGMAMDHSMHGMQQGSQNPLAKPSTSVNHARTEYGPSVDARVDTPRTNLDDPGIGLRDLAEKGLRPVSHKVLTLADLQSLDGVLDDHRVPEKELELHLTGNMERYSWSFDGLEFGRSTPVSLKHGQRVRIILQNDTMMTHPMHLHGMWSELETDQGELRVRRHTIPVQPAQRISFLTTPHDLGRWAWHCHLLFHMDAGMFREVVVS

SEQ ID NO: 16853 - protein, 556 aa, Microbulbifer degradans 2-40
MKVSARNNEHGDFVCTIEDTGIGISNKQMERLFKSFTQADASTTRKYGGTGLGLVISQRLCKLMNGDISVRSQLHKGTCFTVSLSLPATQEVQDKLKEKHILQEDAKEYDYIVFDASTQRASAIVKQMQKFQCNAVFAEEDKYEDLNAALAQLVDIETNKPKLFIIDSDKLDTNFASALIDVLEKRKRHGASDGLLLLANVEVDIDSWRNENQQGLMPIIAYPHHILTKPVTPRLLIRAINHAVVNAAQGIIHSPTLEEKALLLENREEQERAIVRVPSENSPKILLVDDNAVNREVILGILEDEDFQIETAVNGQDALAALTRSSLNFDLILMDCQMPVMDGYKATREIRSSEILKHYKHIPIIALTANAMAGDKETCLASGMSDYLSKPIDGEQLLLIISKWIKPKLEAGNTEPLSCELNTTAQSEGSTNTKPVIWDFETVLKRINNKTERLQKLIQLFVSNMPANIDKLKTINITEDWTDAQYIAHSIKGSAANLSALLVTDAAEDLELLCKQADAYIDMEAFKESYLIKVSALSASYNETLVEFDSFSTSKS

SEQ ID NO: 16854 - protein, 376 aa, Microbulbifer degradans 2-40
MTDTFIKSRAAVAWAAGEPLSIEEVDVMMPKAGEVLVKIVATGVCHTDAFTLSGEDPEGIFPAILGHEGGGIVEALGEGVTSVAVGDHVIPLYTPECGECKFCLSGKTNLCQKIRATQGKGLMPDGTTRFYKDGQPIYHYMGTSTFSEYTVLPEISLAKVNQKAPLEEVCLLGCGVTTGMGAVMNTAKVKEGDTVAIFGLGGIGLSAVIGATMAKASRIIAIDINESKFELAKKLGATDCINPKLYDKPIQDVIVELTDGGVDFSFECIGNVNVMRSALECCHKGWGESIIIGVAGAGQEISTRPFQLVTGRVWRGTAFGGVKGRSELPGIVEQYLAGDFKLDDFITHTMGLEDINTAFDLMHHGKSIRSVIHFNK

SEQ ID NO: 16855 - protein, 510 aa, Microbulbifer degradans 2-40
MVTSVAKSPSLPGKKPTKWPHYKANQPITAGSLQTQTAAAHTYLDIIMTTFTDYKVAAKTAEEFKKDAEYGRREIEIAEGEMPALMALRTRYKAEQPLAGAKIMGCIHMTIQTAVLIETLVELGAQVRWSSCNIFSTQDHAAAAIAAAGIPVFAWKGETEEEFLWCIEQTILEDGKPWDANIILDDGGDLTEMVHTKYPAMLDKIHGISEETTTGVHRLAEMIKKGTLKVPAINVNDAVTKSKNDNKYGCRHSLNDAIKRGTDHLLSGKKALVIGYGDVGKGSAASLRQEGMIVKVTEIDPICAMQACMDGYEVVSPYINGENTGKLENVDKDLLGKTDLIVTTTGNANVCDSAMLQALKSGAVVCNIGHFDNEIDTAFMRKNWEWIEVKPQVHKVVRNAATNDHLILLSEGRLVNLGNATGHPSRIMDGSFANQVLAQMYLYEAKFADLPADKKAENIYLKVLPKKLDEEVAKAMVEGFGGVMTKLTPAQAEYIGVEIDGPYKPESYKY

SEQ ID NO: 16856 - protein, 471 aa, Microbulbifer degradans 2-40
MSVAIPHTRANSTTASSTHSSSAANVPADGKLPPHQRLNIALLGYRSHPFVGGQGIYIKYLSRALNALGHKVTVFSGPPYPQLDSEITLVKVPSLDLYEQENHVTALRWHHLKSFSDFYEWFTMLTGGFGEPYTFSRRVRKLITPNQFDIVHDNQSLGRGLLSIQKHTPVIATIHHPIHRDRKLAIDAAPNWQHRLLRKRWYSFLTMQEKVCKKLDNLVTVSKVSQTDIARFFKRPEQSVPVVPNGVDTQVFSPNPSVKKHPFGIITTASSDQPLKGLRFLLEAMVTIKKQFPQATLTVIGKLQEGGASDTLLKSLQLENTIVFKSGLTTQALVEQYQTARIAVCPSLYEGFGLPAAEAMACGLAVVSSNGGALPEVVGDAGLVVEKGSSDAIANAIISLFSTPHQIESLGAKARERIEQTFSWHTVAQQLTQHYLKIIQTKTYTHLLDDAFIKKAPARLTASETLPHADD

SEQ ID NO: 16857 - protein, 643 aa, Microbulbifer degradans 2-40
MLTPICKFVSHYQSVTPLTVCVITLSLAYIYPKVYIMTNKLLLAASFSAVLATAAATHAATEQNQSSSAVLLQGFHWNSHDYDWYSVMQANVNSIDNLGATHVWFAPVSDAASDEGYLPRELYDVTTNYGTEQQLRTLVASLNAKGIDSVADIVINHRVGTTDWADFTNPTWGSWAVTCNDEWPGATGACDTGEGYAAARDIDHTNGTVQGDLISWIRDFLFNDIGFKGLRYDYSKGYDAYYAGLYANAVSPSFCVGEVWTDLNINDVNPHRQQLVDFVSGTGGACGVFDFTTKGMLNEALHNNDYGRLSINGVPSGAIGWWPQKMVTFVDNHDTGPSEGCGIGQNHWPVPCDKVMQGYAYILTHPGIPTVYWAHAYDWGMYDAIKALVDIRKSEGLTSTSSVDIKAAQNGLYAAVIDGKVAVKIGPNSWAPSGANWELKASGTNYAVWVIGEQPPASRTVIFVYGQTQAGQDMFIRGGIDHGYAAANLGKNCTSSNYECAIPIIHNNLNNATTAGWKANDNYLDWYGVEASQSSAAEGSAADWTTNVWPSSWGAERTVAVDGYGVTPLNVYGQHYWMLDVEMDCSATVNGWFELKTYISNGPGWEADVNQSGTPYASGNHFAQCGKINVFSRGSSNATIVDF

SEQ ID NO: 16858 - protein, 501 aa, Microbulbifer degradans 2-40
MNQTLQPRPRPELNFWQIWNMCFGFIGIQFGFALQTANVSRIFQTLGAEIDAIPILWIAGPITGLLVQPIIGYMSDRTWNRFGRRRPYFTIGAVAATACLFIMPHSPALWMAAGMLWIMDASFNIAMEPFRAFVGDMLPPKQRTQGFATQSFFIGVASVVASALPWMLTNWLGMENTAPEGEIPSTVVYAFYFGGAVLVTTVMWTVFRTKEYTPEEIAAFNQYEQHNDSQADTSDDHKNYVAGGIGFAAVAIASTIAIHYFELREELYILAGLAAMFGGLQLIAHILQSKGRIHNAIYQITHDLFNMPRTMVQLAIVQFFSWFALFALWIYTTPAVTAFHYGTSDTTSAMYNKGADWVGIMFAAYNAFAALAAFFIPIMARRWGQKTTHCINLMLGAAGYISMMLIKDPSWLWVSMIGIGFAWASILSLPYAMLSGALPSSKLGLYIGIFNFFIVIPQILAASVLGIAVSGLFDGQAIYALVLGGVFLIIAALATLKVNDQ

SEQ ID NO: 16859 - protein, 296 aa, Microbulbifer degradans 2-40
MTGQAMNPNLSDAIELIITPKEKDLGEFTVRRTLPSAKRQAVGPWIFFDHMGPAVFPAGSGVNVRPHPHINLATVTYLFDGEILHRDSLGNKRAIRPGDLNLMVAGKGITHSERERPEVNSVQHSLHGLQLWLALPEEHEETDPAFYHYPSADLPKLTVNGVPLRVMIGSAYGVTSPVKTFATTLYVEAHLQAGQTLALPTADERAVYIASGKLCIDNTPLAAHSLTVLRNTTNVHITAEEESRIAILGGSPVGKRFIEWNFVSSSQARIDAAKKQWQLQQFDKVVGDEIEFIPLP

SEQ ID NO: 16860 - protein, 765 aa, Microbulbifer degradans 2-40
MLLLFQRVRNLPLTAKAYITIVIAAAVAVAWVSAVEWSIATNKHQQHIATATKNARQQLNQAIQTGNQLVLEHCLTNLVAQSIIKRATLIGPSSRQEKTSLNYATSEGFSTLREPLDAGWVLEMQVSTGMTAFLERLVIDLVGILLITGALLLYVRLALVSKLLQLNFAARTLNLENLNRSLLPKKSRQPQKRAADSQDELDSLLQALERIRLSMLEDREQRRTVELALMREKEEKIETRRLVQEAEAANRAKSQFIATMSHEIRTPMNGVIGMVEMLRDTTLDDSQRHYLGIIERSGDSLMNIINDILDYSKIEAGKMSLEHMQFDLEELLEDCVQMFSASTDKRNIELICSISPNTPKQLMGDPTRLKQVLVNLIGNAFKFTSEGHIYVEARQVNASDADLPMIHFSVEDSGIGIESNQQEKLFDAFCQADGSTTRKFGGTGLGLTICKQLAEMMGGEIGVYSREKAGSTFWFSAVFTHVEKAINEQPPQSLAGKKLLVVNQSKIVEKVIASHAADWNIACRIVHSGEKALEVISGQHHYDFIILSQDLQDMPGLDVADKVRTLAAYSSTPIFLVTKVRKSQLPEDRLHTITALLPYPLSIHKIENLLQTKPTHTVVEEQKTNTQATTVSEGPLHVLVAEDNPVNRMVIEGLLAKFDIAPKFAEDGLQALNAVTESPTPYDLIIMDCEMPEMDGFEATRSIRTWESNNNQPATTIIALTAHVEAEHRQRVFDSGMNYYLSKPVTMEKLSEALTTAGLAPQIAS

SEQ ID NO: 16861 - protein, 423 aa, Microbulbifer degradans 2-40
MNTLTNKRVLLGVTGGIAAYKSADLVRRLQDAGADVRVVMTRAAQEFITPLTMQALSGKPVHTELLDTQAEAAMGHIELARWADVILVAPASADFIAKLSHGEGSDLLSTLCLASKGLIAVAPAMNQAMWASPATQDNLALIAKRAVHIIGPAAGSQACGDVGMGRMLEPLAICEAVAGLFQAGSMTGRKVVITAGPTREAIDPVRYISNHSSGKMGYALAQAMAEAGAHTILVSGPTQLPVPERVTRINVESALEMAAQVEASVEGADVFIGAAAVADYRPANVAQQKLKKTEGMSNTIELVENPDIIRAVAERADRPITVGFAAETKDVQQYAASKLHAKKLDMIIANDVSQVGIGFNSDNNAVWVLRRKAPLNAHDAASGGSEASAALLEESIDQMSKAQLSRVLVTKIADFFKQAEAVK

SEQ ID NO: 16862 - protein, 289 aa, Microbulbifer degradans 2-40
MSNRTVVEQLQGRATSDGDGVKLLRVFGGPRPERFDPFLMLDEFGSEEASDYIGGFPPHPHRGFETVTYMLQGKMEHRDHMKNVGLLADGDVQWMTAAKGIIHSEMPRQTEGKMRGFQLWVNLPSKAKMGPAHYDDIAADRIPVYELNGATVKAIAGATEVTDNAAKTHAIKGVTQVVDTEVLYLDVHLTEGASVNISLADSHNTLVYTYDGTAAIGPQNTPAPAQTVSRLSEAGSLQLSNSAAEVTRVLVIAGKPLREPIVQYGPFVMNTQEEINQAIADYQAGVLTD

SEQ ID NO: 16863 - protein, 1132 aa, Microbulbifer degradans 2-40
MAAKQQIYRVRRSYNQWVNNQTLEDYALRFTAKASRKWSLLRVANTALGSISFLALEAIGAAITISYGFDNAMAAVLVVGLLIFFAGLPICYYAAKYGVDIDLLTRGAGFGYIGSTATSLIYASFTFIFFALEAAIMAKALELTLGIPLAIGYIISSLVAIPLVFYGITFISRFQLWTQPLWIALQLAPLIFILFNDATLVADWQSYTGTKQSSPGLNILLFGAAASVMFALVAQIGEQVDFLRFMPEKTAGNKTRWWCALIAGGPGWIIVGCIKLVIGSFLAVVAIQYGSSLIDASDPTTMYAIAYGYITQNQHLALVLAGFFVVLSQLKINVTNAYAGSIAWSNFFSRLTHNHPGRVVWLVFNVSIALLLMELGIYHAFESTLSIYAIIAVSWVGALVADLIINKPLGFSPPNIEFKRAHLYDINPVGVGSMLIASITGVLAYLGFMGEHAHALSHFIALATAFICSPLIAWGTKGKYYIARPAYVFSDQHQHVKCSICENNYETEDMAQCPAYDGYICSLCCSLDARCQDLCKTHQSISTRLVTLAQRCLPSFASNYLNIRLVHFVLLLTLVGAVTGVLLALVYTNIKTDSLTINQLLEATLWKVFFILTIVAGVICWLFVLAHQSQIVAQEESQTQTRKLVQEIEAHEKTDLKLQKAKEQAEAANNAKSRYLTGISHELRSPLNTVLGYAQLMEMDSALSEANQNKIAVIKRSGEHLADLIEGLLDISKIEAGRLEIQRNTIQFKSLLGQLEKMFLLQAQDKGLTFTCERLSPMPATVMGDEKRVRQILINLLSNAIKYTEHGEVKFSINYRNQVAEFKISDTGVGINEDEYERIFKPFERVRRPGSPAVPGTGLGLTITRLLTDIMGGDISVERNPNGGSIFTVWLMLSRVDTPKTAQVKPRKIYGYEGEKKSIMVVDDDATHRGLIGDLLTPLGFGVVEAPDAEACLAMISYFTPDIFLIDRRMPGMNGPELAAKLRQIGFSVPIVMVTANANEDILSHDELAQQNNKEVSDTAYNEYLVKPIKLDQLLQTLDRYLALQWKLAPSSSHSLQEIESRAFNGDGLPTQDIREKLIIHAEIGHLSMLKTIANQLANDPNINPLFLTQLKKYINEVKFKKVIELLQVPSL

SEQ ID NO: 16864 - protein, 783 aa, Microbulbifer degradans 2-40
MQSLMNIKTRILLAVFLLELAGYGLLLIYSHDTSRDALVDIRERQIRATVKDNYHRINALTDLMERKAIELAEVGTLMHTMAQQQAPTALDTAIQNYLKSVFTQFPESIGGGLWYEPYQFDPQRRLFGPYVFWNAKREVEFTWDLNSDEYNYPSQEWYLTALPTTWPRDQTRERRSYWTAPYWDEAGSKELMMTVDSLMYSQAGAIIGLATVDWSLKEMTQFTEANHITSNAESFIIDSQSDFILSNSLLPKSVMTRYEQLPWMQQLNIDYLEKGALNVSSNVSVNGEVYELYFLKSATGLVYGVLIPQAEFYLEIDEAMHSIMLNGIVMIVFFIACMLIALELLLKPFHSVTKIIRDSIQTSDDDRITIKPIEYDQKNEFSAVVDALNIVYHQINRYTDELDQANKAKTTFLATMSHEIRTPMNAILGYAQILTSDADIPDSHQDTLKAIEGAGKHLLSLLNDVLDITKIESGGMILYYENVYVRDMIESLDKVFSVRCQQKKLDWSSEIDIPEEYIACVDRAKLNQIAFNLLGNSVKFTEHGRVHLEAAIENDHLILTIIDTGPGITPENQQKLFTPFYQGQAGFEQGGTGLGLAIIQKLVELMGGTVGLKDTSALGSIFEVDIPLNGPNPDLAPAKRAVNDGSADYSKFELTALIVDDVSINRDILAKVLERVGVRTMQAPDGLEALNILKSVVPDILFVDIQMPIMDGLELLENLKEKYPQYLPYTCAISANINSHNNDLVKSGFAFAVSKPFQLKEIGDIVDFIVQDQFGNYTTLDDL

SEQ ID NO: 16865 - protein, 368 aa, Microbulbifer degradans 2-40
MRSTKALVSDGNGAFDVKQITVGEPAANEVRVKIKAAGLCHTDWDSIQNWNKPFIVGHEGAGIVDAVGEGVTKVAPGDKVILNWAIPCGQCQQCLTGYPHICEINSPVCGKGLCGHAHANATLYNNAPLERSFHLGTMAEYTVVKEAAVVKLETDISFSAASIVGCGVMTGWGSVVNAANVKAGSTVCVIGCGGVGLNVIQAARLSGAAKIIAIDINDERLAQAKQFGATHGVIANRADSHFDEVLTQVKQINNNRAADYAFECTAVPALGSAPLKLIRSAGTAVQVSGIEQRIDFDCELFEWDKIYINPLYGQCNPERDFPRILALYASGKLKLDELITKTYSLENITEGFDDLLNGRIAKGAIIFD

SEQ ID NO: 16866 - protein, 1653 aa, Microbulbifer degradans 2-40
MNKSSFNYLTRNSKWLIPTFAAIVLLTLAIAVDRVIYSRFALEERTAVHNEASKLRASIESTINSNLQAVQGLVLVLNAFPEPSQEEFASFAAPLFNQNTQLRNIAAAPGMVIKYMHPLEGNEAAIGLDFRATPAQKEAAERAERTGQLVLAGPVNLKQGGQGFIGRIPVFTYNKQNNTKSSWGLLSTVIDLDRFYSATGITQFNETLQLALRGKDAKGAQGQVFYGDEALFHADAVLLEVSVPSGSWQLAILPKQGWANSAEDSALLRIILLLIILAILIPIIISVNLLANRHDSDLKFRGLFELSPVGIALNRFTDGKYVETNTALENMLGYSADELHGKTYLEITSPVYEDHQKAVINSLKNYGRYGPYEKEFIRRDGTLLPVIMNGMLVTDSNGEKLIWSIVEDITSRKQAELALAQNRKQLEQIIDSTSVAIWDWNIVTGEIVINERWAEIIGYSLMDLEPVSIDTWTNFTHPEDLDKSSELLNAHWNGESNHYQCEARMHHKDGHWVWVLDSGKVIEWTSEGKPLRMVGTHLDITEQKESQRLIEQSQIELKNFFDLSPNFMCIIDREGFFERINDTFLSQLDFTRDDFFSCKYIDFVHPDDREITQDHFEKMKSGALTQVFTNRYMHSNGDYLYLQWYTFADPASGMVYTTALDITNQKLDEKRMARQQEMLLSMSEQGRIGAWEVNLEEQQMYWSTMTKDIHEVDANYTPHYESAIDFYKEGESRDTISRLLNLAINKGIPASIELPIITAKHNERWVSVTVQPEFRNKQCIRLFGSIQDIDARKRIEQGVQLANTKLEKQMTLVNAIAAAQASFIQQTDIAIAFRNLLDGVLELAESEYGFVSEILYTEKNEPYIRTHAIANRSTHDRYNAFFAAQGENPIEFFNLDSLLGAAVTSCKPVIANSPTTDSRRAGVPDGHPQLESYLGIPIILNGSIIGLIGLANNPNGYNQALVDWLAPLINTVGQMIENTRAIRERDNAQQALVKAKNAAELAARTKSEFLAMMSHEIRTPLNGVLGMLNLVKRTQLEDKQRYQIDIAKSSAESLLNLINDILDFSKVDAGKLDLEVVDFNIITLLEDIAHAMAGRALERGNELIIDTTKLEFTYLSGDPSRLRQILVNLIGNAIKFTQNGEVTVTASLTKNTSGFNLNISVADTGIGIAEEKIPLLFSAFTQVDASTTRKYGGTGLGLAICKKLCALMGGDINITSQEGNGSEFSFQILVKNSVKNIDLPPLIEQKVDLNDKTIFIAESNPKNTAILENMISSKRCIAVSSLPDSNLNLPNEPIDVAFIDRKLLTSMESITPLKNKPNFANTQWLMLTAINQTKDIENYTAKGFDTYLTKPITQSGLTLSLKSLKLDSNQAESEQQQTSEKLTLPQSPQGEASQFAARILLVDDNTVNQDVAKMMLEDFGLIIDVANNGLEAIAALDACSIREPYSLILMDCQMPELDGYETTKRIRKGATDFDNTKIPIIAMTANAMKGDKEKCIAAGMDDYLSKPIEADALEHMLKLWLPLHNFSQDSNTQATSQHPQVVEGFWQHDELLATLKGREDRLKILVASFTKRIPALLEEFEEATASNDLEALSFIAHSVKGSAGQLKCNLLFVCASELELTAKNGDLTTALELSQNFKQYTLDFYNLLNKYLA

SEQ ID NO: 16867 - protein, 861 aa, Microbulbifer degradans 2-40
MTNSSTTHLAKNQRIRLINSTWAAGGGVLLSFVAYYSTTMGLFLGDKNVLIWVLVGFWLGNFAFIGTIASGLNKRFRDPALTLPQMYWAVSTTNIALMFTTQLDVLYYLLIMLTMVFGIFRLSVRQFNVFCYFAIAQLLLSLFVRYSLYASDAIGTLIINWVAFGFCAITLTALCNSIVRLRHRLKQKNEELSEALKAKSEFLANMSHEIRTPMNGVIGMLDVALLSETSPEKHRYLSVARNSAQSLLGIINDILDFSKVEAGKLELEAIDTDIDDLVHEVLVNFSGLAEQNDVELIADISPTISHLVKCDPGRIKQILNNLVGNALKFTPHGEVLVKARAEKLVSGRIQLHFLVRDTGIGIAAQNQKHLFDSFTQADTSTTRKYGGTGLGLSIAKRLCETMNGAISLESYEGKGSTFAFFIEVEASEERPPKAILPEYIRDFRVLVVDDNATSRAVITKYLEYLEVHVVAVENGKQALTRLANNTTFDAVIIDRQMPGMTGDTLAQQIRMQQNDERVPIIMLSNMKAEGASNLITELRLAAYITKPLRANQLYTALGFTFNSACYISENAPNSDTADTPTDTAPLPTITKPTNKERKKILLVEDNKTNQEVALLTLEILGYNADVANHGGEAIEILKQQSDSEQHYGAILMDCQMPVLDGYKTTETIRSDAALSAFKYIPIIALTANALRDDKEKCLAAGMNDFLSKPIDSAKLGATLAHWLHEEAQPEISPPPKKKSAVTEAEESLVWNRAELERLVGNNAQRAYKLISGFVASLVAMRTELEAHIDGKRYSDAANTLHGLKGAASNMRVNKLAEAAGNFEHALKYESTATIASSQEHFVEQLEIAVSHLSEYLETHEQ

SEQ ID NO: 16868 - protein, 132 aa, Microbulbifer degradans 2-40
MPAVFLNSSQFSCKKIRSSLMKLITAVIKPFKLDAVREALSEIGVQGITVTEVKGFGRQKGHTELYRGAEYVVDFLPKTKLEVAVADNQVDSVVETISKAAHSGKIGDGKIFVSALEQVIRIRTGESGEDAL

SEQ ID NO: 16869 - protein, 112 aa, Microbulbifer degradans 2-40
MKLITAVIKPFKLDDVRNALSEIGVQGMTVTEVKGFGRQKGHTELYRGAEYVIDFLPKVKLELVLGDELIDQAVEAISKAAQTGKIGDGKIFITPCEEVIRIRTGETGPEAV

SEQ ID NO: 16870 - protein, 461 aa, Microbulbifer degradans 2-40
MLAPVNPTTGQPLAQVASLTLPECNRAIDKTYEAFPAWRDTSITERASALMRIAASLRKSKNTLAKLMAQEMGKPLCEGIAEVEKSAACAEYYTNNSADFLKPETLESDAAYSYVTYQPLGTILGILPWNAPVWLALRFLAPALMAGNTCVMKADPNVPATAAALTAAFNSAGLPKNVMTNLPIETELVGEAIDHPAVKAVSFTGSSAAGKKVAARAAGGIKPAVLELGGSDPCIVLADANLDKACNVITLSRMINAGQSCIAAKRVIVEASIYDDVCNRLFKIFSTITMGDPSQSSTSECTALPYAMGPIARKDLQTQLHQQVNQTIQSGARCIHGGDLPSTSGFFYPPTLLIDVQPEMSAFTEETFGPVLAIIKANDFEHAIQLANKTEYGLGASIWTADKTKAELAANKLQAGQVAVNGIVKTDPRLPSGGIGLSGYGRELGPQGIKEFVNVKQVWVG

SEQ ID NO: 16871 - protein, 247 aa, Microbulbifer degradans 2-40
MSFENKVAIVTGASRGIGEAIATALAEAGATVIGTATSDAGAAKITARIAEAGHKGEGMTLNVSDADSVAAVIKAVTDKYGAAQILVNNAGITKDNLLMRMSDEEWFDVVNTNLSAIFRMSKGCLRGMMKARWGRIVNISSIVGQMGNAGQTNYSATKAGVMGFARSLAKEVGSRNITVNSVSPGFIDTDMTKVLPEEQKQAMQTAIALGRLGQPEEIAKVVKFLCSEDASYITGENIHVNGGMYMC

SEQ ID NO: 16872 - protein, 408 aa, Microbulbifer degradans 2-40
MQKITRLAALVVAGLCLLGTQAQAKKFEHLAQTPPMGWNSWNNFGCDVDEKLIKETADYMVSSGMKDAGYEYVNIDDCWHGERDANGFIQADPERFPSGIKALADYVHSKGLKFGIYSDAGWTTCGGKPGSRGYEFQDAQMYAKWGVDYLKYDWCATDGLKAEGAYQTMREAIHKAGRPMVFSICEWGDNQPWEWAKPIGHLWRTTGDIYNCFDCEYDHGTWSSWGVLQILDMQDDLRQYAGPGHWNDPDMMEVGNGMTEAEDRSHFSMWAMLAAPLIAGNDIRNMSEATRKILTNKAVIAVDQDELGVQGFKYSSKNGVEVWFKPLANDEWAMAVLNRNKGEVKFEFKWRNEVVKDELTHRTITFNEQKFDWQDLWNKSNKGHTKKFLKTKIAGHDTLMFRLTPAKN

SEQ ID NO: 16873 - protein, 277 aa, Microbulbifer degradans 2-40
MHKTTPISTLADQKSQELDPVWQTIRQETREQVEEEPALASFLHATILNHDTLESALSFHLAHKLANPAISALQIREIIEESMSHDSCISEAVRADIRAVFDRDSACNSYALPFLYFKGFHALQAFRVAHCLYKRGRKSLAYFLQSHIALTFGVDIHPAARIGKGIMMDHATGIVIGETTVVEDDVSLMQGVTLGGTGKEASDRHPKVRKGVLVGAGAKILGNIEIGEGAKVGAGSVVLEAVPPHTTVVGVPARVVGVPQSQSPALDMNHGIQCDCE

SEQ ID NO: 16874 - protein, 613 aa, Microbulbifer degradans 2-40
MSEQAKKQSRIKELINRGREQGYLTYDEVNDHLPDDISDPDQVEDIIQMINDMGIRVYEVAPDADELLMTDGDSSADEIAAAEAAAALAAVETEAGRTTDPVRMYMREMGTVELLTREGEIAIAKRIEEGLRELNHAIALWPEAVQQYVNEYDLVEKEERRLADVISGWLDPAEDVAPPVVAAETAEDTDSDDDDDDDDDTDTEDEEESTGIDPEYARERFDELKAALLKVEKAIAKHGFESKAAGKEMEALGEIFKYFKLPPRQFDPIYQGIRQILTRVRAEEREIMRLCTRLGGMPRKTFMKEFPGQETDEDWIPATIGKGRDYSDSLKPYAEDIIRAQRKLKQIQEESGLSLGHIKEINRRMSIGEARARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKVRKVLKIAKEPISMETPIGDDEDSHLGDFIEDTTIDSPVDSATIQGLTEATRSVLAGLTAREAKVLRMRFGIDMNTDHTLEEVGKQFDVTRERIRQIEAKALRKLRHPSRSDHLRGFLDD

SEQ ID NO: 16875 - protein, 332 aa, Microbulbifer degradans 2-40
MFRLLGNREVPAVGLGCMGMSEFYGAADEATSLQTLNEAFNLGYRHFDTADMYGFGHNETLVGKFINQENINREELFISTKGGIVRDVNDKYNVSVNSTEQYIRAACEASLKRLNTEYIDLYYLHRLDPAIELEESIGTLKALVKEGKIKNIGLCEVSEDQLAKAHQIHPVAAVQSELSLWSRDSELGVLPLCVELGVAFVAFSPLGRGFLSGSIDKSFMAGVSDDLDFRKRLPRFSEDNIDSNMQLVEKLKGVAERLQAPVSQVALAWVLAKAPNVHIIPGSKTPKYLQNNFDSRLLSLEPNVVEELNTIFSPDAVVGSRYPQKILEKSSA

SEQ ID NO: 16876 - protein, 695 aa, Microbulbifer degradans 2-40
MPLCPPSNSEFTTSHFNKDSTMKRLQPSQFHQAEKAVQKRLGVADMVAQHSEGYIRSTMPGQHRDFFTNLPMVIVSITDFDGFPWPIPLHGKPGFIKSPNANTLEIETYPTLKDVLKLNFKKSQKIGILGIELHTRRRNRMNGTIKEINNNSFLVICEQSFGNCPQYIQKRELHWVDTPQKCLQTEDIFLTNTLTSTCAEWIESSDTFFISSRTKRLSTDKRDGLDVSHRGGKPGFVKVENDTLYFPDFSGNQFFNTLGNIQSDSRVGLYFPDYESGKIILISGTAKIIWDKELTRIFEGAERIISVKVRNCLILDSFLPMRGVLTELSPSLIRTGTWENPQEKSAARVYKQFKIIKKIKESRDVTSFYIRPLDGSALSSYLPGQFLPISIKQPHTSSTCLRTYTLSQAPLSNAYRFSVKREKFGLASRILHDTINTGDSLYVSQPEGKFTLQTNKKTNVLLSAGIGITPMIAMLQGLIREVEKGEKPQDVYFIHSTQNSETHTFANELKHLNKRHKWLQLYTIYSQPKLNDKLGQHYDVSGRISLDLLRKILPTDNFDVYLCGSESFMRSSYTNLKAMGIAESRIFYEFFDDGSFESHQLNKFQTAQRAEIYFAKSNITATWTPNDGTLLQFAEKMGLKPMYSCRTGNCGTCSCTLSTGEVTYANKPGYTPANGSALICCARPALNTTKLTFHI

SEQ ID NO: 16877 - protein, 214 aa, Microbulbifer degradans 2-40
MNVKFPKANAPIKLYRHPLSGHCHRVQLMMSLLDVPYETIDLDMDNGAHKTPSYLKISPFGQVPAIDDNGITLTDSNAIIIYLEKKYNNDYEWYPQDPVQAAEVQRWLSVAAGEIAYGPNAARLVKVFGANIDYEIAQRKTYTLFSVLERILNTRNYLAGNTITVADVAGYSYISLAPEGDISLESYPAIRGWLERIESQPRFIGTQRAPLSTI

SEQ ID NO: 16878 - protein, 649 aa, Microbulbifer degradans 2-40
MFDQIPTQRPNTPLLDVVDTPARLRELSEKQLPQLAKELREYLLYTVGQTGGHFGAGLGVVELTVALHYVLNTPDDRLVWDVGHQTYPHKILTGRREQMSSIRQLDGLSGFPKRSESEFDTFGVGHSSTSISAALGMALAAEMTDNQQQTVAVIGDGSMTAGMAFEALNHAAHADTNMMVILNDNNMSISKNVGGLANYFSKIWASKTYCALREGSKRVLTKIPQAWELARKTEEHMKGMVSPGTLFEELGFYYVGPIDGHDLERLVHDIRNMLAIPGPKLLHIITQKGKGFTPAEKDPVGYHALNKIEPKASITPISASGGAEAPAASTIKKPKYQTVFGDWLCDLAEVDPFVLGITPAMCDGSGMVEFAERFPDRFHDVAIAEQHAVTLAAGLACEKFKPVVAIYSTFLQRAYDQLVHDVALQNLDVTFAIDRAGLVGEDGPTHAGAFDISFLRCIPKIIIATPSDENECRQLLFSAYHHPGAAAVRYPRGTGPGAVIELENQHWPIGKGRELRQGKTVCFINFGVLLPDAIAVAEANNYGVCDMRWAKPLDKDLLLNMAEQYDYLVTLEENAVAGGAGAGVMELLAAEGISTPVLPLGLPDEYLDHGKRSQLLQAAGLDRASINQRINQWLSRHNGAAHDSQIHSL

SEQ ID NO: 16879 - protein, 484 aa, Microbulbifer degradans 2-40
  unsure (1)..(484): unsure at all Xaa locations
MPTYQIYGLGAALVDTEIEVTDLDLKDLRIDKGVMTLVDEARQAQLIRTLSKHVAASKRASGGSAANSIIAASYFGAKTFYSCRVANDENGKFYLNDLAEAGVSYYEKNGEPSGTTGKCLVFITPDAERTMNTFLGISETLSVDDIDEQALAESEWAYIEGYLVTSATGRPAAIKLRELAEAKGVKTALSLSDPAIVNFFKDGLVEMIGDGVDMLFCNEAEALQYTGCDTVETAAEALKQCAKAFAITQGAKGALLFDGEQFITVAAHKVTPVDTNGAGDMFAGAFLYGLTNNMSFQQAGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNIIGLYTVC

SEQ ID NO: 16880 - protein, 666 aa, Microbulbifer degradans 2-40
MATTRILLVEDDEDDYVIARDVLEEISFLDIELIRAANVSAAYDYLKQNNFDLCLLDYQLGAFNGIEVLKHARASGFSAPIIMLTGQADSKLDEQALDAGAADYLNKSEIGTGRFIRSIRYALARRDVERERVERLKAEAENESKNRFLAHLSHELRTPLTSILGYTELLLNSDKGAQAAVELDVIYRNGKHLLNLLNDVLDLSKIAADRLEINTSKVDVGSLIVDVYTLLRVNAIDKGLNITLASTTPIPTIITSDSTRLRQIIINVVSNAIKFTDEGEINIALSMDDHAGKEKLCVVVKDTGIGIPADKLEEIFSPFSQVADVISKSVGGSGLGLAISSTLAKMLGGEIVVESKIGEGSRFSIYIDVGDVSNVEREWLRFDKQASTAPKKLEYSLEGKVLVVDDLRDIRSLVGHIISQVGVKAEYAANGARAIAVIESAQQAGKPFDLVLMDIHMPEMDGKQAVTLLRNKGYSLPIVALTAASMRGSYEQLEICGFNGMLSKPVDIDKLFQVLNSYLIRKENAKPPHVSLVAESPAAMPSKSSTELSILLVEDDPDAANAVAELMGHLGAQVSVVNSVKHGCEQLQAKKWDAVLVDKNLTDGSGFSVITKIGEQGVSTYVAVVSGDEISLAAHPELSINEVLLKPLQLSALKQLVANIRGYAGA

SEQ ID NO: 16881 - protein, 428 aa, Microbulbifer degradans 2-40
MSKIANVIGFEVMDSRGNPTVMAEVVLESGVVGTACAPSGASTGSREALELRDGDKSRYLGKGVLKAVANINETIKPLLVGKDVAAQRELDDIMLKADGTENKANLGANAILAVSLAAAKAAAQDKGIPLYAHIADINGTPGKYTMPVPMMNIINGGEHADNNVDIQEFMIQPVSAPNFTEALRMGAEVFHSLKKVLAGRGLNTAVGDEGGFAPNLPSNEAALEAIAEAVAAAGYKLGEEITLALDCASSEFYKDGVYDMSGEGKKFSPEEFADYLAELASKYPILSIEDGMDESDWDGWKVLTEKIGSTCQLVGDDLFVTNTKILKEGIDKSIANSILIKFNQIGSLSETLDAIKMAQEAGYTAVISHRSGETEDTTIADLAVATAAGQIKTGSLSRSDRVAKYNRLLRIEAELGEKAPYRGRAEFK

SEQ ID NO: 16882 - protein, 333 aa, Microbulbifer degradans 2-40
MAVQEIEISRFEEEESIIATGITFDVESAKEPESPTRKRATATRASAESEDAYQKNLDATQLYLNEIGFSPLLSAEEEVFFARKALKGCEASRKRMIESNLRLVVKIARRYVNRGLALLDLIEEGNLGLIRAVEKFDPERGFRFSTYATWWIRQTIERAIMNQTRTIRLPIHVVKELNVYLRAARELSQKLDHEPSPEEIATLLEKPLEDVERMLALNERVTSMDVPIGPSSEKTVVDTVADQDVSDPVELLQESDLSQSLDGWLDELSEKQREVVARRFGLRGHETSTLEEVGKEIGLTRERVRQIQVEALRRLRDILEKQGLDAASLFGAM

SEQ ID NO: 16883 - protein, 322 aa, Microbulbifer degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 16884 - protein, 556 aa, Microbulbifer degradans 2-40
MPRMKFPAHLLVALALSRVFVHLGRLFVFTKDGANAYNCSFISQALAYLKTPLQALLMTLEVVTPMLRIAQEALTFDDVLLVPGYSNVTAKDVDLKTRLTREITLNIPLLSAAMDTVTEARLAIALAQEGGIGIIHKSMTIEKQAEQVRAVKKFEAGVVKNPITIDSSCSIKDLIALTRQHNISGVPVLDNGDLVGIVTGRDVRFETNLDATVASIMTPKEKLVTVLEGTAADEVRALLHKHRIEKVLVVNDKFKLCGLITVKDINKAETYPNACKDADGSLRVGASVGTSPDTDDRVAALVAAGVDVLVVDTAHGHSQNVLNRVTKIKKDHPQVQVIGGNIATADAAKALVEAGADGVKVGIGPGSICTTRIVTGVGVPQISAIANVVDALKDTGVPVIADGGVRFSGDVAKAIVAGADCVMMGSMFAGTEEAPGEVELYQGRTYKSYRGMGSLGAMAKTQGSSDRYFQDSSQGMEKLVPEGIEGRVPYKGPLNAIVHQLMGGLRAAMGYTGSVTMEEMRTKPQFVRVTSAGMGESHVHDVSITKEAPNYPVSGR

SEQ ID NO: 16885 - protein, 264 aa, Microbulbifer degradans 2-40
MSTQLFDLTGKVALVTGATHGLGMSMAVGLGKAGATLVINGHSSQEKIDKAVELYKEQGINAYGYRFDVTSENEAEAAVEKIESEVGPIDILVNNAGIIRRIPLLEMPLDEWENVIRTDLTGVFIMTKPVAQRMVKRRQGKIINVCSMMSELGRNSVGAYAAAKGGLKMLTRNMATEWAKHNVQVNGIGPGYFATSQTAPIRVDGNPFNEFIVNRTPAGRWGDPDDLQGTTVFLASNASNFVTGQIVYVDGGILATIGKPSNEE

SEQ ID NO: 16886 - protein, 240 aa, Microbulbifer degradans 2-40
MSRLALVTGGTRGIGEAISVRLKEAGYRVVASYAGNDESANKFKEKHDIPVIKFDVSSFDACTEAVKKITSDMGPIEILVNNAGITRDSTIHKMSAEQWHQVLDTNLGSCFNMCRNVIEAMRENKFGRIVNIGSINGQAGQYGQVNYAAAKSGIHGFTKALAQEGANQGITVNAIAPGYIATDMVRAVPEKVLEKIIAKIPVGRLGEAEEIARGVEFLVSDNAGFITGSTLSINGGQHMY

SEQ ID NO: 16887 - protein, 250 aa, Microbulbifer degradans 2-40
MKLENKVCVITGGIRDIGKQISLKLASEGAKLVINYYDNPEQAEQTLADVKAAGAEAILVHGDMTNGEDVQKLVDASLETFGAQIDILVNVAGGLVARKTIDEMDEDFWNFLIKLNLNTTFLLTKACAPHMVKGSSIINFASQAGRDGGGPGASAYATAKGAVMTFTRSMAKELGPRGIRVNALCPGVISTVFHDTFTKDEVRKNIQAATPLRREGSASEVADVVAYLASDESSFLTGLNMDVNGGLYFS

SEQ ID NO: 16888 - protein, 756 aa, Microbulbifer degradans 2-40
MLNDLRSIVQEVYAATDLSSVLEIIVRRVKSAMNTEVCSVYLRNETGAYTLMATDGLNREAVGRVTLAKNEGLVGLVAAREEPINLDDAESHPKYQYFAETGEERFSAFLGTPIIHQRQVMGVLVVQQAAKRRFDEGEEAFLITMSAQLAGVIAHAEATGTLRAMGSKSAVRFNGVPGASGVAIGECVVVSPVADLNAVPYATCDNIEEELAFFSRSLAAVREDVKRLGQSLENLLNKEERVLFDAYLGMLDDTSLAREVTEKISMGLAAPYAWSEVILDHVKTFSAMPDAYLRERASDVRDLGSRVLAYLQETTQKELVYPEKTILVGEDLTPSMLAEVPVGQLAGLVSVRGSSNSHIAILARSMGIPTIMGAVDLPFTKLNGREMVVDGYRGSVYIDPGEALLQSYQAILEEDLQLVAGLQSIKNLPCETSDHHRVALWVNTGLLADTMLSIERGAEGVGLYRTEVPFMLRDRFPSEEEQRLVYREQLEAFAPHPVTMRTLDVGGDKSLPYFPIEEENPFLGWRGIRVTLDHPEIFLGQVRAMLKASVGLDNLRIMLPMITNIAEVEIAQMLIHRAYDELLEEGYDVQMPPLGVMIEVPAAVYQAKELAARVDFISVGSNDLTQYLLAVDRNNPRVADLYHSLHPAVLRALRKIVKDAHSQGVPVSICGELAGEPAAALLLVAMGYDVLSMNATNLLKVKSVVRAVTLEQAETLLAEVMSLPDAESINRCLEAAFRHAGLNRMLRPDLGDDANI

SEQ ID NO: 16889 - protein, 414 aa, Microbulbifer degradans 2-40
MSDFHYQNGELFAEQCSLNAIADALGTPCYVYSKAAFTRAYQDYANALGNHPGMVCYAVKANSNIAVLQVLAKLGAGFDIVSSGELRRVLKAGGQPNRIIFSGVGKTREEMREALEVGIACFNVESEAELERLADVAAELGVVASISLRVNPDVDAKTHPYISTGLKENKFGIDIQRAPAVYARASELASLKVVGVDCHIGSQLTELTPFLDALDRLLQLVDTLAETGITIEHLDIGGGLGVTYRDEVPPAVADYLTQIKAKLGDRKLAIIMEPGRSIAANAGVMLTEVEFLKPTEHKNFAIIDGAMNDNIRPALYQAWQDVKPLSQREGETQQWDLVGPVCETGDFLAKDRALALQAGDRLALMSSGAYGFVMSSNYNTRGRAAEVLVDGDKYFVVRERESFEDLIRGEHLLP

SEQ ID NO: 16890 - protein, 258 aa, Microbulbifer degradans 2-40
MSEVFFKEMFGLNGKVAIVTGATRGLGQAMALALAKAGASVVAVGSKLENLESTMALLAEYDVPTLALACDQTKPAAITQVVTDTVEKFGRIDVLINNAGTIRRAPAVDFSDDDWENVIETNLNGVFRFCRAVGKVMLEQRSGKIINIASLLSFSGGLTVPAYAASKGGVAQLTKALANEWAASNVQINAIAPGYFNTDNTENIRKDAARFESISARIPAGRWGEPDDLTGAAVFLASNASNYVNGHIMLVDGGWMAR

SEQ ID NO: 16891 - protein, 428 aa, Microbulbifer degradans 2-40
EKAVQKRLGVADMVAQHSEGYIRSTMPGQHRDFFTNLPMVIVSITDFDGFPWPIPLHGKPGFIKSPNANTLEIETYPTLKDVLKLNFKKSQKIGILGIELHTRRRNRMNGTIKEINNNSFLVICEQSFGNCPQYIQKRELHWVDTPQKCLQTEDIFLTNTLTSTCAEWIESSDTFFISSRTKRLSTDKRDGLDVSHRGGKPGFVKVENDTLYFPDFSGNQFFNTLGNIQSDSRVGLYFPDYESGKIILISGTAKIIWDKELTRIFEGAERIISVKVRNCLILDSFLPMRGVLTELSPSLIRTGTWENPQEKSAARVYKQFKIIKKIKESRDVTSFYIRPLDGSALSSYLPGQFLPISIKQPHTSSTCLRTYTLSQAPLSNAYRFSVKREKFGLASRILHDTINTGDSLYVSQPEGKFTLQTNKKTNVL

SEQ ID NO: 16892 - protein, 128 aa, Microbulbifer degradans 2-40
LGRLFVFTKDGANAYNCSFISQALAYLKTPLQALLMTLEVVTPMLRIAQEALTFDDVLLVPGYSNVTAKDVDLKTRLTREITLNIPLLSAAMDTVTEARLAIALAQEGGIGIIHKSMTIEKQAEQVRA

SEQ ID NO: 16893 - protein, 283 aa, Oenococcus oeni MCW
MSILDETFQLNNGNQIPKVAFGTWRLKDGDEAYQAVAAALKIGYRHIDTAFHYFNEPSVGQAIKDSGIKREDIFLTTKLPAEIKNHDDILKNFQESLDRLQTDYVDLYLIHAPWPWADINLDYRYDGANREAWQAMEEIYKSGRAKAIGVSNFDVHDLKNIQQIWSVKPAVNQIEFYVGWTQPKIAAYTKSLDIQLEAYSPLATGGLATQPDIQKIAEKYQVSVPRVALKYVLQKNVLPLPRATKAEHVKSNAELDFEISAADMEVLDKLPDTGQARHNVTMG

SEQ ID NO: 16894 - protein, 633 aa, Oenococcus oeni MCW
MNNLSNFISRFFRSVHFKIALIFTVITLITLGLVGAFFVNQYSSQLIQSFDDRVTVPSTIKSQLISDLQNSNKKAANQDINQALSTLGGSTDQDYVYVVDKSGVIRGSLTVEMKQLVGQQIDSSISGKKVQSNIYHALSSSKDYVRRFRSESLGRRYETLTIPLESKPGDRSSTVGVFVYTASMESIYESIANITNMFVGALFIPLLMAIMIGFLMVHLLTRPITELAEQTEQITKGNYSIKNSIKSKDEIGILATQINDLSDTIASETATSNMESDRLNSLLSNMTDGVLAITRDGTITVINQAALDLLHIPRTYKAVGKNISDLLKLVDKKITLRKLFQSIRGFVVEPDGPDGVTLNAVASLVRRQSGFISGAVVVLRDVTRQLKLENDQKNFVSNVSHELRTPLTSVNSYIETLQEGALTQKKIAREFLGVAHDETQRMIHMINDLLELSRMDQGRTKMDTEAVNFTKFINYVLDRFDVMFKQGHSMHSDNHYKIIRNYDQKKSCYVEIDSDKFMQVVDNVINNAINYSPDGGNIEIGINETDDSIILSIKDHGLGIPKKDLENVFTRFYRVDKSRARKQGGTGLGLAISKEVVEALHGKIRVESTVNVGTTFFISLPKVDTSSSRFDFS

SEQ ID NO: 16895 - protein, 242 aa, Oenococcus oeni MCW
MKKKRSMINNSFLKYSAYVISLGGFLFGYDTGVINGALAFMSKPGELNLTPGLQGVVSSSLILGACLGALGCGNIADRFGRKRTLRWIAALFTISTFFCAISMNFAFMAVFRFILGLAVGAASSLSPMYLAEISPEKVRTINVNKNAIFIVLGQLAAFCVNAILGNIWGSWGPIWRVMIVSASVPAIILWINSFHIGGSPHWLLLKKDLSMQEVYFPNLDFQRKYLLILKIIPERVAINKKF

SEQ ID NO: 16896 - protein, 283 aa, Oenococcus oeni MCW
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVEAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKASSLIHQRSNIDIFDFSLTSSEIEQINALNRSDGRVDGQDPNTYEEFD

SEQ ID NO: 16897 - protein, 471 aa, Oenococcus oeni MCW
MNLSHASDSKISADIPLVNKKEKPLIKNTDKEEKHHLPKLRLSTIFAMTFGFFGINMAFSLQSSQLGRIFQTIGANPNNLGFFFILPPLAGMVIQPLIGKYSDRTWNRFGRRMPYLLIGAPAAAIVLILLPNAGSFGFGYASVAALCFGAVATLFMDLTSNICMQPFKMIIGDMVNEDQKDLAWSWQQSFSNLGGVLAAVIPFVLTLVGISNTAPKGEVPLTVKIAFYSAAIILLVTSLLTIIKVHEYDPKTYAQYHEIDLQAQKKSPSLVKLLKDAPRAFWETSVVEFFSWFAILYLWTYATGAISLNVWHTSNASSAGYQAAGNWYGVLTCIMSIAAVIWGIVVQARTKPTSRKFWYSFGLLAGAVGYFMIYFIHNKWLMIIPFCLIGISYLVINTQPFSLLTEALNGQHEGSYLGLFNCSICLPQICASVASFWLFPLMGQSMPAMFLVGGTSLVLGAISVRFVHSRF

SEQ ID NO: 16898 - protein, 297 aa, Oenococcus oeni MCW
MEIKANKLTDTYTLNNNVQIPVIGFGTWQSADGEEAYNAVKWALEAGYRHIDTAAAYGNEESVGQAIKDSGVKREDLFVTTKLWNYQRDNYENSLRGFHDSITRLGLDYVDLYLIHWPEPIEYRDHWQSLNADSWRAMEKIYKDGKTRAIGVSNFREKHIDELMKTAEIAPMVNQIFLNPGDQEKDLVTYNKNHNILTEAYSPLGTGNLLDNPELKKLADKHGVDVAQILIRWNLEKGYLPLPKSTHQKYIESNKKVFSFQLDYDDHKTLDALDGQGKQHTDPHEHNFQKVVPFLNN

SEQ ID NO: 16899 - protein, 382 aa, Oenococcus oeni MCW
MTDFSNKYTKLGLTFDDVLLIPAKSEVTPDQVQLGTDLTPSLHLNIPILSAAMDTVTESPMAIQLALNGGLGVIHKNMLLTEQAKEVSKVKQAVIDFDKYPDAATDEHGRLIVAAGVGVTNDTLDRVKDLVEAGADAIIVDSAHGHSEGVLRKIREIRETYPTLNIIGGNIATGAGAQAIFEAGADVAKVGIGPGSICTTRVVAGVGVPQITAITDAAEVASKYKKTIIADGGAKWSGDIVKAIAAGGNAVMLGSMLAGTQEAPGEVIVGEDGNKYKTYRGMGSMAAMQNGSKDRYFQGEVKEVNKLVPEGIEAVTAYKGTVDHVIFEDLGGLRAGMGYTGSATIKDLIENAQFVRITNAGLVESHPHDVHITKQAPNYVRV

SEQ ID NO: 16900 - protein, 470 aa, Oenococcus oeni MCW
MAYQTVSPYTNETIKKYDFSTQDDIERALSQGHTLYKKWRNGPLDKRVATLHTIAKLFREHEDELAKTAVNDMGKLLREAKGEVELCAMIADYFADHGPEMLKPTPLKTIATGDAEIVKHSTGVVFAVEPWNFPYYQIMRVFAPNFIVGNPMVLKGPSNTPGSSDAFGKIVQEAGAPEGSFTNLFLNYDQASALVADPRVQGVALTGSERGGRSIAKAAGENLKKNTMELGGTDAFIVLDDADIDQVADIAWRARLYNAGQVCTSSKRFIVADNLYDEFLTRLKEKFAAVKPGDPMDDSTTLAPMNSKRAKEKLQEQVDQAIKNGATLYYGNEPIYLDGQFFQPTILTDIRKDNPAYSEEMFGPVAQVYKVHSEQEAIDLANDANYGLGGIVFSGDPDRGAKVASQIETGMVFVNNFMSSLPELPFGGVKNSGYGREMSQLGIMAFVNEELIVKADKPDLSNPAGGLIFL

SEQ ID NO: 16901 - protein, 383 aa, Oenococcus oeni MCW
MLYHSWKRTGIYTIVPVSLAGLPRVMFGAIFGGALAGQLADRLGRRKMILISAIIFAVFSVLSAIAPNNGSYYLIIMRIFLGLAVGAASALVPAYISELAPAAIRGRLSGLNQTMIVSGMLISYIVDYILKGLPNQIAWRLMLGFACIPAIILYLGVMKLPESPRYLIKNGRLDEARKVMSYVRSSEGEINNEINQIKETAHKEQEAQKTSWSALFSGKYRYLVIAGVGVAAFQQFQCANAIFYYIPLIVQKATGQAATSALMWPIIQGVILVIGSLVFMWIAEKFNRRTLLMFAGTIMGLSFILPAIIRWIDPHASQMMIVVFLCLYVAFYSATWAPLTWVLVGEIFPLAIRGRAAGLASSFNWIGSWAVGLLFPIMTASMS

SEQ ID NO: 16902 - protein, 253 aa, Oenococcus oeni MCW
MVDRLKGKVSIVTGGTLGIGLSIVDLYLKEGAKVVFTGRRQKIGEEAFKHLSNPKNAKFVVHDASNEEGWKKLFADVIAEFGKVDILVNNAGIGVPGDVEHTDYAQWRQTMAVNLDGVYFGTHYGVINMKHPVSGDASIINMSSIEGLVGDPNLFAYNATKGALRIMTKSAAIYCAQNDYNLRINTIHPGYIKTPLVEDMDGFEKAMSERTKTPMGHIGDPEDIGWLAVYLGSEEAKFATGSEFTVDGGYTAQ

SEQ ID NO: 16903 - protein, 484 aa, Oenococcus oeni MCW
MALKQYQMYINGEWVDSDNGEKITVYNPSNEEAISQVPSASLKQVKEAIDDAYAAQKDWKRVPAATRGSYLVRIAALIRKNADYLARTLSEEEGKILSLAMTEVTFSADYIDYMAAQGRTYEGEVIQSDNANENIALLKQPIGVAAGILPWNFPFFLITRKFAPALVTGNTIVIKPSSDTPNIALEFAKLANQVGLPKGVLNFVTGPGSVVGSELSKNEKIGIISLTGSVDSRKRVMADASNHVAKVSLELGGKAPAIVCKDADIDLAVDSIINSRIDNNGELCNNCERVYVQEDIAEEFTKKLVAKMAATTIGDPIEHENIGMGPLINKAAVEKVDAMVQRAVKAGAKVECGGKRPEGKGYFYPATVVTNVKQSDELVQEEIFGPVLPILTFKKLDQAIDMANDSKLGLTSSIFTENMDAAATAANELEDGETYINRFNFEAMQGFHAGWKESGLGGADGKHGLEEYVNTHVVYLQRHPEKAD

SEQ ID NO: 16904 - protein, 233 aa, Oenococcus oeni MCW
MTELDAQKIIDFIANSKKQTAVKVTYKGHLNGRIPTSIQNFSNSDFGILYGDWSDIKPLLSGLNKKDYLIENNARNSAVPLLNIKDINARIEPGAIIRDQVKIADNAVIMMGAVINIGAEIGEATMIDMGAVLGGRAIVGKHSHIGAGAVLAGVVEPASAQPVRVGDNVLIGANAVIIEGVQIGDGAVVGAGAVVINDVPAHTVVAGVPAKVIKQIDEKTENKTALIDALRSL

SEQ ID NO: 16905 - protein, 198 aa, Oenococcus oeni MCW
MKTVIIFDHPYGITASHNQPHKRSYSAALAQQAIKDLKDSGNSVDIIDLQKDNFNPVMGKNDLLNWRTKSFVDKQSQNYFDRLQDADEIIFIFPIWWEMMPALTKGFIDKVFAKGQIKKANGHRLILPVKTKIRVLTAIGTPKIIYKFHYGNQLGKMLKRGVFGKMGLKDFKIINFNAEDRSKEQRINDLKKIKKIIL

SEQ ID NO: 16906 - protein, 259 aa, Oenococcus oeni MCW
MSNKVAIITGAGQGIGKAIAQRLAKDGFKTGLIGRHLEKVEAVAKELNEEYGSDTAIAKKADVSKRDEVFAAFQEISDNFGDLNVVVNNAGVAPTTPIMEVTEDDMEWTWKINVDGVVWGIQAAATIFKKFNHAGKIINATSQAGVQGNPDLTAYGSTKFAIRGITQTTAKELAKFGITVNAYAPGIVKTPMMEDIAHEVGKNAGKDDDWGMNQFAKGIALGRISEPEDVANAVGFLASSDSNYVTGQTIVVDGGMVFN

SEQ ID NO: 16907 - protein, 283 aa, Oenococcus oeni MCW
MSILTDTYTLNNGTKIPKVAFGTWQTPDGDVAYQAVSSALKFGYRHIDTAKIYGNEKSVGRAIADSDVKREDLWVTTKLPSQDKTRDLVLADFESSLSRLGLDYVDLYLIHAPWPWGEAGSKHFDEENAEAWKTLEELQKSGRVKSIGISNFDVHDMENILKIAEIKPVVNQIQYYIGFTEPKISKFAAEHDIRIEAYSPLATGDILNSEAIRKIAGRYNVSVAQLALRFTLQNGTVTLPKAISERHIQENTQLDFTINDDDMRTLNSMPDAAPAHFHNSTQG

SEQ ID NO: 16908 - protein, 448 aa, Oenococcus oeni MCW
MSLIASIYAREVLDSRGNPTVEAEVYSEDGFFGRGIVPSGASTGEHEAVELRDGDKSRYLGKGVTKAVANVNGAIAEALIGKFDVADQRGIDLAMIALDGTPNKGKLGANAILSVSIATARAAAEEAGLPLYQYLGGPNSYVLPTPMMNVINGGVHSDNKVDFQEFMIMPVGAKTVKEAIRMGSETFHNLKKLLEADGKNTSVGDEGGFAPDFANNEEPLQYLVKAIQAAGYKPGKDIALATDVAASELYDADTKKYKLKWSTGEEFTAPEFEKYIEGLVAKYPIVSVEDPLDENEWDDWVEVTKELGKKVQIVGDDFFVTNTDYLKRGIEMGAANAILIKLNQIGTLTETFEAIEMAKEAGYTAIVSHRSGETEDTTIADLVVATNAGQIKTGSMSRTDRIAKYNQLMRIEDELNQGEPEGVSIYKGINSFYNLNADAKKEIQSHQG

SEQ ID NO: 16909 - protein, 705 aa, Oenococcus oeni MCW
MELLLLFPIIISLIVVSSLIAHFFPLIPVSLLQIIFGVGLSFYIKGSIGLDTEWFLLLFIAPLLFHDAWRFPKRELWQLKAPIIANAIILVFLTVLGGGWLVHLLIPILPLPVSIALAAALSPTDPVAVGTILSRIKIPQNLLHVLMGESLLNDASGLVAFKYAVSATMLGSFVLHDAFFNFIYISLVGALTGFILISILDWGTEFIRKRGAGDEILHVIINVLVPFLIFYIAEDVEHSSGVIAVVVAGILTNLRNNADYNSSFEFDVLSETIRRTLAFVLNGTIFILLGMQFPHVYKDAIIDGDLDLFRGIIYGVMVWFVVFIIRAIWTYANEYLSFKRNPKDANAPSIIGSAIMAVSGVRGAIALAAVLSIQSVSGKTFPDYYLMVFIAGVVVILSLIVASIMLPILVKRAGPVSNLPVDVQLIDQESDFNINEFGQTERKTHFMSEEAARIFQLQSGIQALRSELTDIAAGDEVVDARQAAVYDLVYERQQKINDLQVKINHRRAKKLVAKEQAYRVIALNAEIEVIEGLYRQKKLSPAVYHANMLGVKWSLRDIGHRRSFSFQWFLRVIRRTLQLVELRVTRVKTNRAKKQNLMVHRARAKAGIKTLAAHLENKKIDNIGRQAAFNIIINYRSWLARIKASKTFNKSYDSSLMGLSLIAINAERDSIQQLFEAKRIPRHLGIKLLQEINFAEISALSDNGS

SEQ ID NO: 16910 - protein, 260 aa, Oenococcus oeni MCW
MKNVDNFNTNWFRLDNKNAIITGGASGLGQYYTRALMKSGANVLVVSHSEKGWKETSDLVKNTGQKIEFLKKDITDQNAPKEIVAKAKETFGHIDILINNAGLQKRNKWQEFKDKDWQAVINLNLNALYFLSHAVAKAMAEQKSGKIINIASMQSYRAGKFIFPYTASKHGVVGLTKAYADALAAENIQVNALAPGYINTPMTQALRDDKERNTEILSHIPADHWADPSELMGAIVFLSSSTSDYITGVTLPVDGGYLLR

SEQ ID NO: 16911 - protein, 335 aa, Oenococcus oeni MCW
MPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 16912 - protein, 366 aa, Oenococcus oeni MCW
MSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 16913 - protein, 480 aa, Oenococcus oeni MCW
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 16914 - protein, 280 aa, Oenococcus oeni MCW
MASVIDDKLAIWLAENGYFYIMHRFEPGKRFNFVTDMKQRGLISSISVGVKEEEYRLIDELVDAGLTPDYITIDIAHGYANTVIDMIHYIKKHLPKAFVVAGNIATPDAVRELEDAGADATKVGIGPGRACITKLKTGFGTAGWQLAAVRLCAKAARKPIIADGGIRHNGDIAKSVRFGASMVMIGSLFAGHKQSPGSDLVIDHRHYKQYYGSASAKQKGVYKNVEGKDLLVPYRGDIANTLNEMAQDLQSSISYAGGNNLQALRTVNYVIVQNTIMNGD

SEQ ID NO: 16915 - protein, 575 aa, Oenococcus oeni MCW
  unsure (1)..(575): unsure at all Xaa locations
MIILLQNCSQLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGEKSSSAATAFDEKAYAKSLKAFIKKNKKSGQVVYDDLENKMAKPFALNADQIDKLIEKVEDAGISIVDEDGNPSEKSLKTKSNNPSQEELSQASSAPKGVKINDPVRMYLKEIGRVSLLNADQEVAIAKRIEKGGSDGERARQELAEANLRLVVSIAKRYVGRGMHFLDLIQEGNMGLMKAVEKFDYTKGFKFSTYATWWIRQAITRAIADQARTIRIPVHMVETINKLIRIQRTLIQDLGRDPMPEEIGAEMELTADKVREIQKIAQEPVSLETPIGEENDSHLGDFIEDNEGESPIESTSDQMLKDQLEEVLGTLTEREENVLRLRFGLEDGKTRTLEEVGRVFGVTRERIRQIEAKALRKLRHPSRSKQLKDFMEE

SEQ ID NO: 16916 - protein, 257 aa, Oenococcus oeni MCW
MTNKVAIVTGGGQGIGRGIALRLSKDGYSVIINGRTQEKLDKVAEEIKNNNGKVITFVGDVSSKSANEQLVKKAESEFGRLDVFVANAGIDWVDTIEGTPADQVDNVININLKSQIWALQTAPKVMRKSGDGGSIVLASSIAGMEGFEMLGIYSATKFATRGLVQAAAKELAVDKIRVNAYNPGIVLTPMWDEIDARFAERKNVPVGSTRQAFIDGILLGRGEEPEDVAKLVSFLSGDESDYITGQSIAVDGGIKFS

SEQ ID NO: 16917 - protein, 579 aa, Oenococcus oeni MCW
MGYTMAETKKLTGIAASDGVGIAKSYLLVDPSLAFPYNEKIKDVAAEESRLDKALSASKDDLKKIEAKAEKNLGKEEAEVFQAHITILSDPELVSGIKAQIEHKQINAESALKNVTDNYIATFETMTDNAYMQERAADIRDIAKRVTSHLLGIDLPNPALIDEEVIIVAHDLTPSDTAQLDPTFVKGIVTDIGGRTAHASIMARSLEIPAVVGIGNAISEIKNHVNIIVDGGAGQVLIDPNEEEEVVYARKVGEYFARKREQAKLKNQTTESADGKHFDINANIGSPKDLDSVIESGAEGIGLFRTEFLFIDSDHLPTEDEQFSAYKAALQAVDGKPVTIRTMDIGGDKQLSYWKLPKEDNPFLGYRAIRISLKQDDIFRTQLRALLRASVYGNLWIMFPMIATLPEFRQAKKIYEEEKDKLLSKGTKIADDIKLGIMVEIPASAVLADKFAKEVDFFSIGTNDLIQYTMAADRGNDSVSYLYQPYNPAILRLVHNVIDAAHKENKVVAMCGEMAGDPVAVPVLVGLGLDEFSMSASSVLPTRSLIKHLKFSDMKKLAIESLDKDTNQEVIDLVKNSIK

SEQ ID NO: 16918 - protein, 165 aa, Oenococcus oeni MCW
MFTAAKFIQQHDPAAPGIWEILLTYSGFHAVGFYRIAHYFWQHKHRLLAMLISHWGKKATGVEIHPAAVIGKNLFIDHGLGVVIGETAVIGNQVTILQNVTLGSRRPIPGLRHPHIADNVFIGANAQILGAVKIGKYAKIGAGSVVLNNVPAHRTIVGNPGRLVD

SEQ ID NO: 16919 - protein, 422 aa, Oenococcus oeni MCW
MSKPDQLNLTPGLQGVVSSSLVLGAFFGALGCGRIADKFGRKQTLRWIAALFTSSTILCALSMNFLFMSFFRFALGLSVGAASSLSPMYLAEISPEPVRTINVNKNAIFIVLGQLSAFCMNAFLGNIWGNWNPIWRIMIVSASIPAIILWINSFHIVGSPHWLLLKKRFKKARKLFSKLGFEKSTFDGIEQESKTKSKKDDDISWKSILKKPSLVYLLISGILIALIQQISGVNTVMYYGTILMEKVGMGQSGSLYANILIGLVSFVASIFGTRLIARFDHHRMLLISLFGNILFLALLGLVLRLSLFTQTITNALVLIFLALFLASHQGIVSPVTWLIMSEMFPGKIKARFMSIATATTWITNFIISLIYPLLISAVGTAVVFFIFAASNGVSALLSIFVLNAKEIQRAYRKNDLMSQESN

SEQ ID NO: 16920 - protein, 189 aa, Oenococcus oeni MCW
MRITIIYSYPNKEGFNAGILKQVKNNLSTKHQVTIIDLYAENFDPVLHFDHLHQRRFLKDDPDLADYRQKITDSDLLIFIFPIWWSGMPAILKGFIDRTFSKGYAYSYKGLLPTGHLKGKKAWIITTNDTPSFYVHLVQKDYGKVLSKQVLKMCGIKTIKRSTAYYLRGSSLKRRQSFLRKIGLYSQRI

SEQ ID NO: 16921 - protein, 407 aa, Oenococcus oeni MCW
MIKGKKIMIFFKNKHILVVVTGGIAAYKSAILVRSLIKKGGNVRVAMTKSAENFVTPLTFSTLTKHTVLTDIFKANDGSVDHVAWARWADFIFVVPATANFVAKMAHGIADDTASTLLLASPAEKVIAPSMNDQMWNNPATVRNIKQLDTDGILIIEPTTGFLAEGYDGKGRLPESNDILEQAQIRLLAKNGKLKNKNVLITAGGTKEALDPLRYITNRSSGKMGYALAQAAVEAGAVVTLISTVERRLPFGSKLIKVTDAREMLDTVLEHFDKTDIFISAAAVSDFRPAKQSNQKIKKTGNQGLKVELVQNPDILATVGAKKTGQFVVGFAAETENIVEYAKNKLVKKHADMIVANEVGHPDSGFNVDNNRVIIFRPKQAQKEFPLQSKIDTARSIIEEIIKSVFE

SEQ ID NO: 16922 - protein, 283 aa, Oenococcus oeni MCW
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVEAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKSSSLIHQRSNIDIFDFSLTSSEIEQINALNRSDGRVDGQDPNTYEEFD

SEQ ID NO: 16923 - protein, 243 aa, Oenococcus oeni MCW
MFDRLKGKVAIVTGGNSGIGKAIAADFIAEGAKVVITGRNQEKGRQTALEIAGDILFIQQDVSQEADWQKVISKTIEKFGKFDILVNNAGVGGVGKPLAEMSLSEFNWTQSINLSGNFLGIHFALNKMTEPGSIIDVSSAAGLRGFPGAADYSASKGGTRLLTRAAALEALQMGKKIRVNSIHPGWIDTDIVPKDMREQVIAMTPMHHLGQPKDIAKLATYLASDESEYTTGSELAADGGLMA

SEQ ID NO: 16924 - protein, 156 aa, Oenococcus oeni MCW
MSYNQSMTEEFMQLALKQAQTAFDEGEVPIGAVLVKDNQVIAADHNRKEQSGIATAHAEKLVIEGANCSLGDWRLNDCSLFVTIEPCVMCCGAIIQSRIPRLFYGAADPKFGGVSSLYHLLEDSRSNHFVEVYPDVLAKQSANLMQDFFRKLRKNQ

SEQ ID NO: 16925 - protein, 353 aa, Oenococcus oeni MCW
MLLGWAKEASKMGVYTNADTPKDFQKALDFDADGIGLTRTEHMFFKPERLLQMRRLILAEDAAGRKDPLKKLLQMQQGDFYEIYKLARDKEVTIRLLDPPLHEFLPHDEKEIEVVSKQTQISSEKLKDRIDSLKESNPMLGHRGDRLAVTFPDIYEMQVQAIMNAVVRLHNEGVEVSPHIMIPLTNSKQEMAWVRNLVVKQIDRVSTENDIAVKYTVGTMMEMPRACITADAIAECSDFFSFGTNDLTQLTFGYSRDDIGSFVPAYIKEGILPVDPFQTVDTEGVGELMKIAVVKGRKTKKDLPIGVCGEVGGDPKSIEFFEEIGVTYVSCSPYRVPIARLAAAQAHIRSVVN

SEQ ID NO: 16926 - protein, 486 aa, Oenococcus oeni MCW
MTKQIYDFSEGNMKMRDLLGGKGAGLAEMTNMDLPVPHGFTITTEACHDYQRRQELSEQLLAELDQSLSALSRLTGKQFNGSDHLLLLSVRSGAAISMPGMMDTILNIGLNDQTVIALAELTGNERFAYDSYRRLLAMFGNVVDGIPEDDFDQILTDTKIANNYESDLDLTIDDLKEIVAKFKNLYENYDHGGFPQDPKEQLLAAVNSVFDSWNNHRAQIYRRQNNISEDLGTAVNIQEMVFGNYGEDSGTGVAFTRNPSTGEEGLFGEYLLNAQGEDVVAGIRTPKPVSVLKESMPILYEQLLDIAKKLENHYRDMQDLEFTIENGKMYLLQTRSGKRTPTASVKIAVDQVNEGLLSKKEALLRVEPESVSKMLHPEFEEEDLRQHEILTTGLPASPGAASGQVYFTAQDAKQASDNNKKVVLMRADTSPEDIEGMIVSQAIVTSRGGMTSHAAVVARGMASTGVVGAHELEVDYQKKLLRLRIN

SEQ ID NO: 16927 - protein, 255 aa, Trichodesmium erythraeum IMS101
MSKEFEGKIALVTGGSSGIGRATAIAFAKKGAKVVIASRREKEGEETVAMIKEVGSEAIFFKTDITQAIEVENLVNQTINTYSSLDYAFNNAGIEGIIGPSIEQTEENWNQVIDINLKGVWLSMKYQIPEMLKNGGGAIVNNASIAGLIGTLNSSIYCASKHGVIGLTRALALEQATAGIRINAVCPGFIQTDMIERAFAQIGDSEAKAKIVAANPIGRIGQPEEVANAVVWLCSDAASFITGHSLRIDGGLIAQ

SEQ ID NO: 16928 - protein, 219 aa, Trichodesmium erythraeum IMS101
MSDESVEKLDLVKLCQEMPMPVVLGNCVTYEVALSLMKAGAAGVLVGIGPGAACTSRGVLGVGVPQVTAIADCAAARNDYYQVTGNYVPVIADGGLITGGDICKSIACGADGVMIGSPIARAAEAPGAGYHWGMATPSPVLPRGTRIKVGTTGTIKQILSGPAQLDDGTHNLLGALKTSMGTLGAKDLKEMQQVEVVIAPSLLTEGKVYQKAQHLGMGK

SEQ ID NO: 16929 - protein, 1207 aa, Trichodesmium erythraeum IMS101
MWNIISYYIELFSMKKKSLRQLDRKTSFLKEIPLTYILVIPFLLQLLIVVGLIGWLSFRNGQKAINDLVSKLQEEVGARIDQKVDNYLQIPHQINQLTAHAVKEDNLSIFPVRGESLFVLQMNLFKSVQWIYCGSPEKGEYMGVTRLGKSQTLRLAFSNQSTDFLSYESALDSQVNITNSIQGSRTYDSRNRPWYQASVKAGKATWSEIYKDFNSGEPVITATLPVYDQQNQLKAVCGVDLYFYQELSQFLKNLEIGNTGQAFILNKKGIIIASSIAKAELEDKDRLGFQKAVDSNNLLIKSTAQYLIDQYKDFSHIDTIKQLKFEIDGEQIFMQVSPYKDEYGLHWLTVVVIPKSEFMTQINKNTKSTIELCILALAITLGLGLLIVNWITKSIKQLSRATCAISQGKLNQNVSIQGFKELVILAESFNKMTKELAESFNHLERKNQELQHLDQLKDEFLANTSHELRTPLNGIIGIADSIRDGATGPISELQKKNLSMIVGSGHRLANLVNDILDFSKLRHCSIKLQISSVGMREVTEIVLAFSRMILEGKDLQLINAISSDLPPVEADENRIQQIMHNLVGNAIKFTDSGVVKVSAELIDVNKKMAITVSDTGIGIPEDKYEAIFKSFEQGDGSTERQYGGTGLGLPITKKLVELHGGTISVKSTVGIGSEFTFTLNVSEKPAQNKIIESSSLNQMSLLDTDYLAPSVPEPTYLESEINQVQTSSLPSSSKKESEFQILIVDDEPVNLTLLSNQLSLHNYQVIQANNGQKALDILAQDFLPDLILLDVMMPGMTGYEVTQKVRETWLLHQLPIIMLTAKNRVSDLVMGLEVGANDYLSKPFHKKELLARIKTHINIKKLRTEKAHIRQTFGRYVTDEVVDNVLETPEGLKLGGERKKVTILTSDLRGFTSLSERLAPEEVVMVLNFYLSSMADVIISFQGTIDEFMGDGILVLFGALNPRKDDAKRAIACAVAMQQKIKLVNKQMEAWGYNPLEMGIGINTGEVVVGNIGSEKRTKYGVVGNQVNLTYRIESYSTSDEILISETTLTEVGESLLRIDGQKLVQPKGVKQPINIYNIGGIAGEYNIFLQKEEEIFLDLAEKILIQYIILEGKHVGENLFFGSLVKLSARGALVKSDSKETNSIPSVFTNIKINLLLSLHLGAVGEDIYAKVLDKPVEPGYFYILFTSKTPEFKAFIDIQYSKLIP

SEQ ID NO: 16930 - protein, 252 aa, Trichodesmium erythraeum IMS101
MEALPETLQRLKGKVAIVTGASRGIGRATALALAMEGANVVVNYAKSSDTAEEVVAEIVAAGGNGLALQADVSQVEEVDNLIKEVMEKWSRVDILVNNAGITRDTLLLRMKLEDWQSVIDLNLTGVFLCTRAVSKIMLKQKSGRIINVASVSGQMGNPGQANYSAAKAGVIGFTKTVAKELANRGITANVVAPGFIETDMTKDLKNSEEIIKFIPLGRYGKPEEVAGMIRFLAADDAASYITAQVFNVDGGF

SEQ ID NO: 16931 - protein, 314 aa, Trichodesmium erythraeum IMS101
MATTTLGTTGITVNPICIGTWAWGDKLFWNYGSNYGANEVEAAFKTSLEAGVNFFDTAEVYGNGLSEELLGKFMQETERPVQIATKYGPLPWRLFPDSVADAVTASLKRLIVPKVTLYQVHWPFTFLMSQETLLNALADEVKQGRIEAVGVSNYSEEEMSQAHKILEKRGVILATNQVKYSLLSRKIETKGILNTAKKLGITILAYSPLAQGLLTGKYTLEKSPTGARQFDFRFQKSGLEKIAPVMSLLNQIGEKYNKTPAQVALNWLVFQDSVIPIAGCKNSEQVRQNIGAIGWEMTQEEFNQLEQITRPWLN

SEQ ID NO: 16932 - protein, 559 aa, Trichodesmium erythraeum IMS101
MTNESYSGIVDNFLKTNNMKPITILGSTGSIGTQTLNIVAHNPNKFRVIGLAAGSNVEILAQQVRQFCPQIVAINDKSKFRELQEAIADLQPQPILVADQDGVIQVARYGESEVVVTGIVGCAGLLPTIAAIEAGKDIALANKETLIAAGPVVNPLIEKYRVKLLPADSEHSAIFQCLQGLPLEGLRRIILTASGGAFRDWPIEKLSKVKVADAIKHPNWSMGKKITVDSATMMNKGLEVIEAHYLFGLNYDNIDIVIHPQSIIHSLIELQDTSVLAQLGWPDMRLPLLYALSWPERIYTDWKQLDLVKAGSLTFKEPDNLKYPCIQLAYTAGRMGGSMPGVLNAANEQAVALFLEEKIAFLDIPKLIEYVCEKHNSNYQENPSLDDILAADKWARKEVLAASSIVNNSLINLSLVNLEENPTEIFTKIENEQIEFNDFYQRGLAKYEQQDYQSALAEFDRAIDIDSSHIDAYIYRGDAKDKLEDYEGAIADYNEAIKIDSSHPKAYYSRENVLRKAGDSREAIADYDQAIKLDPNYTPTKNWSHVHVNSETTEKLRQE

SEQ ID NO: 16933 - protein, 480 aa, Trichodesmium erythraeum IMS101
MKKINRRKFFILSSSAMATLITQCNINNTQKNQQLISSYPQIHQSQDGILEIDLTANISQINLGNKQAYVLNYNGQIPGPRLEVKPRDTIRINFTNNLPQPTNIHYHGLHIPMTGNADNVFLNISPGDRLTYQFQIPENHHAGMFWYHPHLHGLVAEQIFGGLAGLFIVRGELDEIPEVKAASEQFLVLQDFALDQKGNILPSHELSIMTGRQGNLITANGQSNPKLTIPPQNLLRIRILNASSSRFYRLSLEEHPFYLIATDGGALAEPVEMSELLLTPGERADVLVQGNREPGKYRLLNLPYERVGIGMMGRNVSESQPQVLATVSYDQQSTAVPLPTKLIPVPALPEPQKVRRFQMNHGMIPGQGMAFLFNGQPYQPERIDTQVQLNTVEDWELINTGIMDHPFHIHSNAFQVLSRNGKPEPYRAWKDVVLVRQGETVLIRMPLQDFAGKTVYHCHILDHEDLGMIGNLEIKARLSI

SEQ ID NO: 16934 - protein, 1388 aa, Trichodesmium erythraeum IMS101
MSKPMKLRKKTRIIINTVIASIVAILYVVQSIILLHHFQYLEANYVRLNVDRGLNILDEQLSNLSAIAKQDRVLLLSKNFANQNQLESNVNLTKEEFINFNSVKNFFINQKLNLILRVNSQGEILFSQVFDLNKQTEIPISESFKKHLSRIQNLKQENYLSKIGIIILPEAPMLIVATNVPNEKDSLSNDTLIVGRYLDNTMISRLAESTKLSLTISRNLQTNQQLKLKNSEIVVKPLSSNKIAGYKIIKDIYSQPVLILQVKIDRIISNSLQSFWGYLIFLWVIVGLVFCVVIIAVIEKLLVSRVLQLSKLVKKIASSGDFSSRISMLGNDELSSLAGTINNILEGLKNYHSDYQESEESYRLMIENSTCIISRHSLNGIFLDISPNCRNLLGYSPLELLGNHPQKLFAHEDTKAIAKAYYAVLKNSVTSTITYRLLCKDSKYIWLETSFRTIRDSKTGKVQEIIALSYDISELKQKKEELQESEAAILRLYQITSATCKDKNLDMDPSSFFNYRLQKLLEMGCEKFDLETGVLFKIEDGISTTIASITPDNCISKGQEFEVEKNFIFTAITEKPICFESITSSGFSITTDIDFQIEAYMGAPVMVGGLVYGTLNFWSPKPLRQPFKAIDKELLKLMAQWVGGELERQKTATDATDLAKARDEALAATRAKSEFLATMSHEIRTPINAVIGMTGLLLDTSLKSDQTEFVETIRSSGDALLTLINDILDFSKIESEKFDLEEHPFDLETCLEESIDLLVAKVSEQGLELVYFIDPETPTIVIGDVTRVRQILVNLLSNAVKFTSDGEVLVSVSGRKLEIEENVQNLAVENISESDTCDIWPAYEIQFSVKDTGIGIPANRMNRLFKRFSQVDSSTNREYGGTGLGLVISKRLAEMMGGQMWVESMGVVGGNPPATYRLPDLYEHSAAVNEKSGSTFYFTIVSKCSIQTVQNKFIQTNYVNGSQHKLVDKRILIVDDNSTNRTILLRQTESWGMIVRTAENANRALELIATENKFDVAIIDMKMPEIDGLSLGKKITEYPIYQNLPIILLSSLGQQEINFSDKLLGSVINKPIKQSQLYEALLNIFSGQDVKVKFKNNNKRNYQTIPVLAKELPLRILLADDHLVNQKVALRILQRMGYRADLASNGLEVLAAVFRLPYDVVLMDVQMPLMDGLEASRHIQREYENATKYSQKSPQKRPRIIAMTANVMQGYREECIAAGMDDYISKPIQIEELIKALSKCKSVVSEVKEKLNFPQLNTFLETEDNNNNIFPDKPILESKVIENLREVEYLDESIDIYLETSPELLENINIAINQTDPLRLKNAAHSLKSISGTLGAMNLYNICQELEVLARLAYESGNFTPKEVIDIFSEVKIEYEKVIAALKLEQHK

SEQ ID NO: 16935 - protein, 345 aa, Trichodesmium erythraeum IMS101
MDNVIGLEIIEVVEQAAIASARWMGKGEKNTADEVAVEAMRERMNKIHMRGRIVIGEGERDEAPMLYIGEEVGICTQPDAKKMCEVEQLIEIDIAVDPCEGTNLVAYGQNGSMAVLAISEKGGLLAAPDVYMKKLAAPAVAKNHVDINKSATENLKIISECMDRAVEELVVVVMDRPRHKQLISEIRQAGARVRLISDGDVSAAISCAFAGTNIHALMGIGAAPEGVISAAAMRALGGHFQGQLIYDPAIVKTGLIGESKEDNMKRLKDMGIEDPDKVYNAEELASGETVLFAACGITPGTLMEGVRFFPNGARTQSLVISSQSKTARFVDTVHMFGETKTLQLK

SEQ ID NO: 16936 - protein, 336 aa, Trichodesmium erythraeum IMS101
MSKLNQENKNQKKTQTKFGPTTYSSMDTVRTYLHEIGRVPLLTREEEIVYGKQVQQMMQFLELKEKLEEKLNRTATLLEWAEHLLVSEKVLKQAIKQGQRAKQKMIEANLRLVVAIAKKYQKRNMEFLDLIQEGTLGLERGVEKFDPTRGYKFSTYAYWWIRQAITRAIAQQARTIRLPIHITEKLNKIKRVQRELIQSLGRSPTPSEIAQALELEPSQIREYLLMARHPISLDLRVGDNQDTELQELLEDETSSPDDYITGELLRQDINTLLAELSEQQRRVLVLRFGLEDGKEMSLAKVGDKLQLSRERVRQLEHQALAFLRRRQAKVREYVAS

SEQ ID NO: 16937 - protein, 354 aa, Trichodesmium erythraeum IMS101
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 16938 - protein, 227 aa, Trichodesmium erythraeum IMS101
MNDFPKITHIIYDLDGLLLDTESIHAQVNQEVTSRYGKTFDKHIKCKITGRKSIDSARKIVELLELPITPENYLQQRNLLTYKRFPQAKPMPGAISLTQHLSQNKIPQAVATSSYREPFNLKTKNHQEWFQLFDYIVVGDDPNIQHGKPAPDIFLIAAQKLEVSPEKCLVFEDSLAGMEAALAARMSVVVVPDPDMDKNLFHSAHQILNSLTEFQPHLWQLPSFLST

SEQ ID NO: 16939 - protein, 1133 aa, Trichodesmium erythraeum IMS101
MAFKSLSLNLGRIFSKLSLKTILIVPYVIQILGAFGALGYIAFLNGQQTVDDLGKKLTNKISDRIQQHVLGYLNQSHQVLRITNDAIESANLDIYNFVALRRYFWEVVKEKDLQDYLFFGNEEGEFIGVEHFAEGEIYLKSCKIPTQSLCETYLLNNQGNISQYLNSKEYDPRDTPWYLVAKKLGEPTWSPILSSFSGQNSSLDIFAVQPIFDSTENLLGVLSNKTTLVKLTNFLKNLYISPNGQSFIIERSGNLIASSEVMEPFVIKGTQENRKIERLPATASENKIVSMTTKHLQQKFSSFAEITHTHEMNFPIEEEWYYASVIPVIDGRGINWLAVVVIPEDDFMEKVNMNIRTTILLSFAALTITVLLGIVTTNWITKPILQLNSAAKEISQGKWETQLKIYREDELGELANSFDQMASQLKKSFETLEAQNKQLTELDRLKDEFLANTSHELRTPLNGIIGIGEFLLEENTKNLNSITTSNLAIIVSSARRLSNLVNDILDFSKIRYHKLELQVRAIDVRIVVESVITLNRVLVGKNKNLQLTNAIPTDLPPVLADENRLQQILYNLIANAIKFTESGKVEISASLYSPKEDQDEATEIIIMVSDTGIGIPPDQLDRIFESFEQGEGSIIRKYGGTGLGLAVTKELVELQGGRIWVESEVGVGSRFNVTLPISNQLVPNSSLNFPSPTVNNIHYLIKNIETTIRSKPLGSKIPNGDFHVLVVDDEPINIQVLNNYLKANNYQVTQALSGKEALAALENNHNFDLILLDVMMPNMSGYEVCSQIREKYPAQSLPVLMLTAKNQIADLVMGFQFGANDYLTKPFAKDELLTRIQTHIKLSKITKAYERFVPHEYVELLSKESIINVKLGDRVSTKMAIFFSDIRSFTTISEQMTSQETFAFVNGYLKEVCPEIRDRNGLIIKFLGDGIMAVFPDGADDALEAAIAQLKRLQEYNQVLLSTGWMPIKIGIGIHWGHIMVGIVGEKGRMSGDAFSNNVNLTSRLEGLTKFYGVSLLISESAFNYLKNPQKYQIRFLDRASVKGIDEPINVYEVLDGEVDEIRELKLQTQVDFALGLESYRVGELVDAKDYFEKVLAVNSSDKTAQLYLERIDDLMVTGVPKNWNGVWAFTQK

SEQ ID NO: 16940 - protein, 384 aa, Trichodesmium erythraeum IMS101
MKILLPNNSGKHQISSPDSNNKSDMADQMKQISLIVAESLHKETQNQENSSMNISATTIPVSENQQDIDDAVGALFKQMSRYPLLNQKEEIELAKLIQELVVFEKLPEKLANDLGRTPTKSEVAVAAGFTESQLDHRLHQCRTAKRRMISSNLRLVVSIAKRYLNRGVPFLDLIQEGALGLNRAAEKFDPDKGYKFSTYAYWWIRQGITRTIANQGRTIRLPVHVVEQINKLRRVYRDLRRSLNRIPNDTEIAQELEISLPQLRNLQQIRRKTLSLNHRLGTDENTELLDFLEDNENSTPEAQMNDMMMRQDILEVLNHVLSNREQDVISLRYGLITGEPHTLDEVSRMINLSRERVRQIQAKAMRKLRRPQVAERLKGWLNRF

SEQ ID NO: 16941 - protein, 1878 aa, Trichodesmium erythraeum IMS101
MLIPSISQVINYHPLTATAETAVEDIIISMSSTGSSCVLITEKPSFSTSIKIVTPGDRSPGSPKGNHHSNSPDAKLQYLGPVIGIFTEGDLVQLASIGAPLSGFPIAQIMIRSIVTAQLSEIPDIFALFALFEKHKINHLPIVDNLERLIGLITGHSFLLNLNNIKKKGEKSILSRKKIKSQQKLSANQNNTVNKGLKSENNLLKNPNNQLLPQEITFDSSLELPGNFIPINHLEKTHESQVIQGSFSLSIKQITQLMSTHNVSYVLIIEATEKKYQNETDIYLNQESSNSQKSIKIIGTISSRDIVQLQALKIDFNKVKAGIVCNKSPIVIGSDVTLELAVDLINKKYCLLPLIVQNYIGKIDYFISPTKVIRQILLNKSLYQSLIRFYSYVEKTYLKLHQANKKLKQYTIEQNNLEKSQLAAPETTGITLKLDQDGIWDWNIETGEIFYSTLGEKMLGYTEHEISHKISFDEWLSRIHPEDRDKVNTAIQEHLTKKNTIYKIKYRIQGKDNNFIWIFDSGQTLWKSGKPVRMVGIFVDITKEKEAEIKQSFLVEKHIQIINNLSEIVWETDIHGNLIFLNQAWEKITGFKPKNSLGKNFLDYIHPEDINKLNFLTKNHPENTELAIIHNKLVADSYQLQLLTKTGGYCPVKMKSTLVFDRENKVTGIVSTLSNISEDIATQQQLQASQKAIKELYEVTTNADISFESKIVALLEMGCHRFGMDIGLLGQVLGELYKVIAAHLPENFLFGIAEGDIFTLEQTFDQEALQYDEPFVIESAKNSQWRHHPAHTVRHVESYIGTKILASGIVYGTLSFSSRLTKNKWSSIDIEVLKLMANYIGGELLREDERKALENKYQHFLLLKQITQEICSKLDTKEIFQTTVTQIGRAFKVSRCLIHSYVTEPDLHLPCMAEYLETNHESILGLDLIITSNYYTEKLLGEDRAIASPDVFSDPLLNSDVPMYQKLKVRSILAIRTSYQGKPNGIIHLHQCDYIRQWKQDEISLLEEVAFQVGLTLAKAQILESEVTHKEELEAENQALEKAREVAEVRNRAQGELLAMMSHKSQTNMNDVMMMTSLLLSMKLNPKQRDFVKTILARGDVVINMINNILDFTKIKSGEVELELSPLDIRGCVEDLLKSLDIIAKNKKLELAYLIDKNVPRIILTDDKKLVNILFNLLKNSINFTKTGEIVVYISAIKKSEKSQEYSQLEAISYEEISDFKGAGKITDNYEIQFAVKDTGAGIPLDQIDHLFKDFSQVSPATNREYDGLGLGLVISQRLSQMMGGQMWVVSQPLEIKNLSEEKKQISLLKIEDSRDINFPKNPINVYNSSSPESKVNIAGNPPHYFVKPELSGRGSIFYFTIQAKAIAMYSPEIVDGLLRGKKILVVESNIINQEEIKQQVKQWEMIPIVADSATKALSDLEQGKVFDLGIIAMDISDMDGLTLARKIRKLEAEQNSKQNKNDKSFLPLLMLNYIDTVDISRELQEAKVSLAGFLNIPIKQSQFYNVLLEVFGTRKEEEVNDKVPSLDMEDFQDLSEKNRDYTNIRILLAENNVVNQKVVIHLLEKIGYLADVAANKVEFLDALKRISYDVVLMDVQMNNGDGIGITNQICQRYSEEKRPWIIAMTANARSGDREKYLNAGMDDYMTKPVDQEKLVEVLNKFKRIRNQKLGSKTDLENAVRSHSSVIRSTLVKTNSSRQPVIQKPSFTNFQVESTSQSDEIISLKSTLPIVIPSNIEDVPETKEITMPGLDLLNDQQLAVDPKIIEKFCNLYYDEPDTPIILIQDYLTDGNKNINMIRNYINKGNFNALKTASQKFKTSSALLGAINFSKLCEELEKMALAVIESREDFDLEKATKIFLQSKNEWERVQKELSTKMNC

SEQ ID NO: 16942 - protein, 483 aa, Trichodesmium erythraeum IMS101
  unsure (1)..(483): unsure at all Xaa locations
MVKILLVEDNEMNRDMLSRRLIRKKFEVVIAINGVEGVEMSISEIPDIILMDMSLPELDGWEATKKIKANQQTKDIPVIAITAHAMTGDREKCLQAGCDDYDTKPVEFPRLLEKXXXXXXXXXXXXXXXXXXMKNDRGNVLVVDDNQFNRDLLARRVKRQGHMISSASDGFQALEMVRNHSFDLVLLDIMMPQMNGYQVLETLKADPALRHIPVIMISAVDDIDSIVRCIELGAEDYLSKPFNPILLKARINACLEKKRLRDQEQAYIKQLAEEQEKSEKLLLNILPAPIAQRLKQGEKTIADSFSEVTVLFADLVGFTKVSANLSPAELVELLNMIFSCFDQLADKYGLEKIKTIGDAYMVVGGLPTLRKDHAEAIAEMALDMLYQVKQISESQEKSLQIRIGLNTGAVEAGVIGTKKFAYDLWGDTVNTAHRMESHGIPGVIQVTEDTYGCLANKYIFQERGIINVKGKGMMKTYLLISRK

SEQ ID NO: 16943 - protein, 396 aa, Trichodesmium erythraeum IMS101
MKILVLSWEFPPRIIGGIARHVAELYPELVKLGHEVHLVTVKSGEAPMYEIVEGIEVYRVPVGPSHNFFHWIGNMNEAMGRYGGKLIKEEKNFDIIHAHDWLVADATIALKHIFKLPLIATIHATENGRHNGIHNRSQQYIHEKEKELIYNAWRVIVCSNYMRGDVTRTLDSPWDKIDVIYNGICPEKKPTLNQFDYLHFRRHFATDEEKIVYYLGRMTPEKGLSVLIHAAPRVIEEMGDRIKFIMIGGGKTDYWKQEIWNLGISERFYFTGFMSEEKLDKFQAIADCAVFPSLYEPFGIVALESFAARVPVVVSDTGGLPEVVEHGKTGIVTKVGNPTSLALGILEVLKGRSFVKELVNNAYQELENKFCWGKIAKQTDRVYHRVLAERTQVTWK

SEQ ID NO: 16944 - protein, 338 aa, Trichodesmium erythraeum IMS101
MPARFSYYLKVDLSSGMKIMKIGKTSDIDSVCTYLREIGRVPLLSHEEEILYGKQVQRLTALQEFNQTLAEALGREPTLLEWAEAKELSKSELQRIIREGERAKRKMVEANLRLVVSVAKKYIKRNVDLLDLIQEGTIGMQRGVEKFDPTKGYRFSTYAYWWIRQAITRAIAEKGRTIRLPIHITEKLNKIKKVQRQLTQQLGRSATTGEIAEELGLTPKQIRECLERARLPLSLDLRVGDNQDTELGDLLEDTGASPEDYALQSSMRTDLESIMVDLTPQQKQVLALRFGLEDGQTMTLSKIGAHLNISRERVRQIEREALSKLRKRKQDMNDYLAS

SEQ ID NO: 16945 - protein, 156 aa, Trichodesmium erythraeum IMS101
MIDDPSYLVHKKWMSRVLELAKTAGDAGEVPVAAAVVNSDGKLVTEAQNRRERDFDPTGHAEILALRQAGQVLQNWHLNQCTLYVNLEPCPMCTGAILQARIGLLVYGADDPKTGTVRTVANFPDSVFSNHRLSVLGGIMEGACRQQLQSWFAKFR

SEQ ID NO: 16946 - protein, 465 aa, Trichodesmium erythraeum IMS101
MIANTIKKSDNIPVSAGGTDPEYFDWQEVWYPIYYIEDLEKNKPTTFTLLEQDLVIWWEEKNNQWRVFEDQCPHRLAPLSQGRINEAGCLECPYHGWAFSGGGNCEIIPQQIAGGKAEKSSRAKVKSLPTKVCQGLLFVYAGKIENAAQTPIPKVDVLDENSNEWICLNTFRDVPYDGLTLMENVLDASHIPYTHHRTVGNRANVAPVELEVLESGKWGFKGVWEEGPRKGTLGRQETTFIAPGMMWHDLTSKQFGRTLTVVYATPIRKGECRLFARFPFKFSSPLPKFFIQLSPRWYSHIGQNGVLEDDQIFLHYQERYLEAKGGSANFSKAFYLPTKADLFVFELRSWVNKYNAQLFPNATLSSALNSEILLDRYHSHTKKCSSCRRALKNLQRIKVGVVLVTSFIWASIFFMLLILDDFNMTLMTFLILSLPVGVVFWLLLSKLEKQFYQGREIPPRNLLNN

SEQ ID NO: 16947 - protein, 97 aa, Trichodesmium erythraeum IMS101
MSIYVGNLSYDVTQEDLSEVFAEYGTVKRVQLPTDRETGRPRGFGFVEMSSEEEEQKAIDALDSAEWMGRDIKVNKAKPREERKPSNRRDPGAGGRY

SEQ ID NO: 16948 - protein, 707 aa, Trichodesmium erythraeum IMS101
MIKKFQSSFNRILLSRILLLTISGLVLGQYIIYRQARSTFLNTARQNLKESADRKAEYLQQWATSLKSSLVSASESYVLESGTVEEHQSYIKRLDEMLSTQISCVQLSNLRTEEIVANTCGTERIDSLPENIWPQQQKQLFRDKYNIYVSYSILELLSADSESNGQKVNQKTQVSLVWSVPVYVSEAGERKLRYALSIKSALPMPTNRERGSFTGSTVVINVPEYRILASLDSRKLGRRISELSDTQTAKKLESIMKKAEEGQKHFAHIFSIEETDILSKNQGSDRSKNTFREIIDKLKEILPKLLRLKLSEDNEFLAGYVAIPSPIDRDNDKVWVVLAITPIDFALSGLREVQKVLIILILFLLGASIIASIFLARDLAIPLKKLRDYAITLNDLNAPSKVPQDLKIPEFNQLAVSLQKMVERLNRWADKIEVASKEAQVANQLKSEFLANISHELRTPLNGIIGSLQIIYDGFCDTREEEIQFLKQANDSAIHLLRIIDDILDIRKIDARNLYMTFENINIIKLLEETVDIFRYDLEQKSLVLKLNASEEKILVYVDKKELQKVFENVISNAIKFTEKGNIDISICRKYNQCIFSENQNNLVNAHTHKVNQVLVTIQDTGIGIDPEEQDKLFQPFVMVDGTKTRKFGGNGLGLAMARGLVEMMNGNIHLYSEGIGRGTTVYITIPIQERLSLEKKQDISTEIKLN

SEQ ID NO: 16949 - protein, 569 aa, Trichodesmium erythraeum IMS101
MSLTSRSKKQSIHQQKSGFKHLLSIIGIRKKIVFGYALGIIIVMLGVLTGQILEFNYKYQIRGKIKQGQQEVDLLTNLTKKVLKIIIIQKDVSQKVNNWKILEKKISLELSSFYEVNTIFKQLKLTLETGDKNISKNTDDVQLEEFIQTYFNPLKIYINQLENLVQDIKQIPPQTKETVETASLESLNVIFNSQITIQLQNLSQDSEQLVILANQRVEKQNRDYQKVEKLGIYILICSLLLSAITTVIIAIYTTNSIITPLKVITKVAEEVTEQANFELQLPVTTNDEIGELTESLNELISKVAEYTEQLQEAKLKAEAANRSKSAFLATMSHELRTPLNAIIGYSDILYEDVLEGGYKDFIPDIERIKLAGKNLLEMISDILDISKIEAGQVTLYLESIEVNKLVKDVFSTAKNITEKNRNKFELVLGENLGSMYADMPKVKQVLINLLSNAAKFTEDGTITLSVEKVKNNQQKNNQNHNAKSLSNENYHIVFRVIDTGIGITEEQLKHIFQPFTQADTSTTRKYGGTGLGLAICKRLCERMGAEITVKSQLGKGSTFTVWFPEKVLI

SEQ ID NO: 16950 - protein, 689 aa, Trichodesmium erythraeum IMS101
MTIPKSVLAELVLEVPQIKPQIYFKSSLTALSHAMEDQVLASSDQPLVIATFQKESFYRQEAHRYRRIGNLTSQVYVLAAPETEFKHSSEYHETVAFNSKDALSREWNLLVLGQGYSSCLISNECDNSGLAKKISQFNGIDQIRRFEGIWTFERQVCLESAILLLTRILNYRPELKEKVQRATEVYGINLDLRKGKKSVKSKSSYSCTNFQKASEVIENNNFNYPFAQRLVTYLQASQYKLIKAYRSIAAQEKKQRLINIISSAIRRSLDPDEIIKVAVEELGKALLASRCLIYQCRPTDKIAIITYEYLGRSVKSLLNQVWPLKDNYLFEEAIQTQGRVYIEDTSLLPESLVPQTSETAKSEGKNYLENLISQWEISSWLMIPLLYQGRVLGMVELHNCGSCDHNWSEEQIDLVEAIATQLSMTLIHTETYAHLEELNQQLEALDRTRSNLIAITGHELRTPLSTIQVCLESLSQEPDMPEELRQVMLETALGDANRMRNLIQDFLTLSHLESGRAQWNIEYLPLLECVDLALSSVRGHNLEKELPNITTQVSAELPLVLADGEWLVEVLSKLLDNACKFTQAAGRVIITATSNSENMLEVTISDTGRGIETDRLEAVFDRFYQEEGALRRSVGGTGLGLAICRQIISRLGGKIWAESAGKDQGSQFHFTIPIVDHTQKQKERQKELN

SEQ ID NO: 16951 - protein, 443 aa, Trichodesmium erythraeum IMS101
MQTEFNFFQHWYPLSPVEDLDPEIPVSITLLGMGLVIWKPRYSQNYQVFLDVCPHRLAPLSEGRVDEKTGNLMCSYHGWQFNSEGICTDIPQAENQEIIEKNRQNFCVTSLPVRQENDLLWVWPDRKTADLAASTPLPLSPQIDAEKGFVWSSYVRDLEYDWETLVENVADPSHVPFSHHGVQGNRNKARPIVMEILQSTINVIKVSISRGLPTIITFEPPCRLEYEISIGKDGKKIGLVTYCLPVSPGKSRIVAQFPRNFAKIIHRLTPRWWDHIQNRNLVLDGDMVLLNQQEYLLQQKQSSKSWKTAYQLPTSADRLVIEFRNWFDKYSHGQLPWSEVGVSDSNNSLVNNNHGSLLNRYQQHTQHCSSCRQALKNLKRLQIFLITYFVVTVSGVAILPDNLRIKIGLPLIITAVLGMGIYAGLQFWLIPQFYFVDYIHARK

SEQ ID NO: 16952 - protein, 464 aa, Trichodesmium erythraeum IMS101
MTTTTKFNPYLMSNFAPVSKEITTNNLEIKGELPRDLSGMYLRNGPNPQFTPLGKYDWMDGDGMIHGVRISGGRAEYRNRYVRTGGFEVEKDLGYAVWSGRLEPPQMNNPYGPYKNVANNGLTFHNGKLLALWEAGLPYEIRVPSLETTGPYLCDGYLDSAFTAHPKIDPMTGELIFFGYALDVAPYLKYGIISARGELLQITPINIPVPSGPHDFAITKNYTILMDLPLRFRPEREKQGLPAWMFETGVPSRFGILPRCGNNEDIHWFEAQPCYMNHILNAYEFEDEIILYGCRMSSTYWYPGTARDPNENIPRMYGWAFNLKTGAVREGMLDKRPSEFPCINHRFVGRQMRYGYTSRMASLRPLFDGIIKYDFSTGRSLSHDFGEGRYGGATTFAPRIGSIDEDDGWLLTFVYDEKEKHSELLVIDAQDIMGEPVARVMLPQRVPYGFHGTWVSEMQLIASN

SEQ ID NO: 16953 - protein, 115 aa, Trichodesmium erythraeum IMS101
MNNLKKVEAIIRPFKLDQVKIALVNAGIVGMTVSEVRGFGRQKGQTERYRGSEYTVEFLQKLKLEVVVEDDQVQTVIDKIINASRTGEIGDGKIFVSPVDKIVRIRTGEDNTDAI

SEQ ID NO: 16954 - protein, 369 aa, Trichodesmium erythraeum IMS101
MEIKAAVAFEAGKPLTIETINLEGPKAGEVMVEIKATGVCHTDAYTLSGADPEGLFPSILGHEGAGVVVEVGHGVTHLKPGDHVIPLYVPECRQCEYCLSMKTNLCQAIRTTQGRGVMPNGTSRFSLNGEIIHHYMGTSTFANYTVLPEISLAKIRKDAPFDKVCYIGCGVTTGIGAVINTAKVEVGAKVIVFGLGGIGLNVIQGAKMVGADMIVGVDINPAKQELAKKFGMTHFVNPKEVEGDLVPYLVDLTKGGADYTFECIGNINVMRQALECCHKGWGMSVIIGVAGAGEEISTRPFQLVTGRVWKGSAFGGAKGRTDVPKIVDWYMEGKINIDDLITNVMPLEKINEAFDLMHEGKSIRSVVTF

SEQ ID NO: 16955 - protein, 395 aa, Trichodesmium erythraeum IMS101
MSSKILVVDDEPDFESLIIRSFRKKIKQKELDFIFATNGIEALEILSEGVNIDIVLTDINMPLMDGLTLLDNLRVFYPDIKAVIVSAYDDLDKIRSAMNRGAFDFLTKPIDFQDLEITIQKTLENVQQLKENKRLKQEKHEAEAANRAKSVFLANMSHELRTPLNAIIGYSEILLEDAHSLGSKDFIHDINNIHTSGKHLLTIINDILDLSKIEAGKMDVHWESVNIMVLIENVLATIQPLIEQNNNILEIICEDNQEPIMADPNKMRQVILNLLSNAAKFTENGKIILKVKVANNDEDFISQNRDCNFTDKVLILSVADTGIGISEEKIDSLFQPFTQADNSTTRKYGGTGLGLAISRHFCKMMGGDITVVSEVNKGSIFTVKFPVPQIISIDS

SEQ ID NO: 16956 - protein, 318 aa, Trichodesmium erythraeum IMS101
MTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 16957 - protein, 386 aa, Trichodesmium erythraeum IMS101
MIQTDKVIETTIQPQLESSELFQPTPTRQVNDELEILIGDREEYIDAQSDEDDLKSGKVAKSRTRTAGKKKHYTEDSIRLYLQEIGRIRLLRADEEIELARKIADLLELERIREELIYHLDREPQVSEWANAVDMELPKFKRRLILGRRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATSMEMTIEKLRFIAKSAQLPISLETPIGKEEDSRLGDFIESDGETPEDEVSKNLLREDLESVLNSLSPRERDVLRLRYGLDDGRMKTLEEIGQIFNVTRERIRQIEAKALRKLRHPNRNSILKEYIR

SEQ ID NO: 16958 - protein, 1172 aa, Trichodesmium erythraeum IMS101
MSFRQEKPKTKILVVDDEPYNLDLLYRTFFQNYKVLRAEGGSEALEVLEKSGEVAVIISDQRMPKMSGTEFLSLTAEKYPNTIRIILTGYTDVEDLVEAINSGKVFKYVTKPWDDHELKALVKQGVDTHNVLKSHTEELRRALQQESLLYAVTNTIRSAPNYREMLQRIVESIGQMLEVNLAICCPFQDNHGEDEWFAIYQDQEHNSKQSTNNNLPKIPQEILASLIWKTDTVEIISDTKNHEKLKGETVEAQKRQQAYLEANVYSSLIVPLFSRSELIAVLALHQCGEYRNWLDYEVQLLITVTDQAALALSQARAYEQLRSLAQRETLVNTITTAIRSSLNPQEIFTAITQELGQALEVDGCALSLWTEADEYVQTVGLYDAQAKSSVSTTEVEALSDQSVMETQVSNDENFLISMNLPQSVVPISSNPVLGELLKTKKTVAISDLNKHQKLDKSDLPLRSNSRALMVVPLIVDGEIIGSISLRNNSYERQWQASEIELAEALASQAAIAVQQSRLYQTTRKQAERLLEADRLKTEFFQNISHEFRTPLTLMIGLLEEAVNYQQDLPLESSAIALRNSRRLLRLVNQLLDLQRLDAGRMQPSFRPCSLVDLCRNIVESFTPYCQKKELSLVTDFSDTCLLVYLDVEKFDKVIYNLLSNAMKFTPAGGSIRISIESSQEYCLLKVEDTGIGIRQEQIPFLFQRFRQAEGSANRSYEGSGLGLALVKELVELHGAQISVESVYGQGTTFKVWMRTGKSHLPVAQVLETPAEFDATKLAVELADVEAELQEVEDLQTVDQQESIATVNYDDMAVTTILVVDDNPDLRNYVSRILRKSNFNVVLARDGAEGFEFAEIHHPHVIITDLMMPVVSGLDLIKMIREEKQLRGTPIILLTAKADEDTRIEGVERGADAYLSKPFNDRELLAEVRNLLVLKENERHMQELNYYLTESVLQRFLPSEMVQRAAAGELVLDFTPETRLVTVLFSDIVGFTRMSNILQSSRIADLLNEYLAEMTRAIFANGGTVDKFVGDAVMAIYGSPEELTPQEQARRAVASAQAMLKALDKLNERWQNLQLIGSNGVPPVRFRCGIHQGNAVVGMFGGPKRSDYTAIGPSVNIAARLEEAAEPNTILVSATVAQYLDSRMVKKYGFLKLKGIDEDILGFLVSRSPISEN

SEQ ID NO: 16959 - protein, 502 aa, Trichodesmium erythraeum IMS101
MLTKLWSFRGRYRILHLTWFAFFLSFVVWFNLAPLATALKEDLGLETSQIRTIAICNVALTVPARIIIGMLLDKYGPRITYSLLLMYAAIPCIGFALAQNFSHLVISRLALSIVGGGFVIGIRMVAEWFPPKEIGLAEGIYGGWGNFGSAGAAFTLPTIAAWLTFGSGDVLNWRVSIALTGIIAALYGVFYFFNVLDTPPGKTYQKPKCARGLEVTTPKDFLFLVLMNIPLTGVLCLLGWRLSKVGFLSTSQLYIVWLVLLGLYAFQTYNCWITNKELIAQEKHYPPSDRYKFSQVAILELTYFVNFGSELAVVSMLPAFFENTFGLSKTMAGMIAASYAFMNLVSRPGGGLISDKLGSRKLTMTVLTVGMAIGYLTMGNVKGSWWLPAAVLLTMLCSFFVQAAEGSTFAIVPLIKRRVTGQIAGNVGAYGNVGAVLYLTLYSFLPEGAIGDKIFFEVIGVTSMIVAFICAFFLKEPEGSFAEHHEGEEEVQIESHTLFAEE

SEQ ID NO: 16960 - protein, 428 aa, Trichodesmium erythraeum IMS101
METAIESIQAREILDSRGRPTVEAEVHLVNGSMGLAQVPSGASTGSFEAHELRDGDKGRYSGKGVLTAVKNVEEQITPNLVKINALNQNLVDSKMIEIDGSPNKSNLGANAILAVSLATAKAAANSVGMPLYRYLGGPQASLLPVPLMNVINGGAHAANNVDIQEFMIVPVGATSFKEALRWGAEVFATLSGVLKDKGLLGGVGDEGGYAPNLGSNQEALDILIAAIEKAGYKPGEQVALALDVAASEFYKDGNYIYDGATHSPSELIDYLASLVDQYPIVSIEDGLHEEDWESWVQLTQKLGSKVQLVGDDLFVTNGSRLQKGIDMAAGNSILIKLNQIGSLSETLETIDLATRNSYRSVISHRSGETEDTTIADLAVGTRAGQIKTGSLCRSERVAKYNRLLRIEDELGDRAVYAGVIGLGPKSRS

SEQ ID NO: 16961 - protein, 448 aa, Trichodesmium erythraeum IMS101
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 16962 - protein, 853 aa, Trichodesmium erythraeum IMS101
MAISYKIIGDMPSFPPAKPDLILPLNILEPLSQLLQKTVQGLDSIIITEDILATTQSLIFPGVKFTAVISKKFNGLLWGKLIKDLSNPKSQNREQQEKSYSLQSNSFSFPFNTKNLGSLKLNVGLSFDPEEIKFFLHQIINRLEADKTKLFIRSKLKYRINHLQANNSSIQSEFTLKLIKLLTSDEKIDSIFRMTSNQKPREKKNYTELSKINFHSKSTTNTEFITETNLLQNKKLLASDSVMNDQEYPLVCKPIEIALNQKLEQERLLNQVTAQIRQSLELPEILSTAVKEVRKFIQVDRLLIYELNNPLLLTDNITTVNEQKGSVKYESLVSNKISSLLGLSERKNCFFLPNSSLFEYSKISVHFIADIEVAYEKFPELLELMEQHQIKAKLLVPIIVDQKLWGLLIAHQCSEREWQDDEKRFLEEIAEHLAIAIYQAQLYGELQKQKQTLEKRVVERIQDLYDAVQSAESANRAKSEFLATMSHELRTPLTCVIGISSTLLQWSYGNRGAKKMPIQKQRDYLKIIHDSGEHLLELINDILDLSQVEAGKTVLKISEFSLSKISYELLQNFREKAEQNEVKLIFEPTVNPQLDLFAADQRRVKQILFNLLSNGIKFTPNGGSVRLKVMRYKNTAIFQVEDTGMGISQEQKPLLFKKFQQLNSPYNRQQGGTGLGLALTKQLVELHNGIIEVESTVNVGSTFTVKLPAQQLKSGNEKRKQKGESLSNVLSLQGSVVLIEQEEDIATVICDILTTAGLKVVWIIEGSTAVEQVILLQPVVIIIDMQLPGINGIEIIDQLRTTSSSKNIKFLALTTLNTEINREYCDAIGVDECLTKPVNLEYLLNKMIHLLAN

SEQ ID NO: 16963 - protein, 358 aa, Trichodesmium erythraeum IMS101
MKIYPLQTPHSGYHWDGSDRRFFEGWYYRVTLPEEKQTFAFMYSIEDPIGGQPYSGGGAQILGPNDEYLCRTFPDVKKFWATPEVLELGHWGQTNLTSPVGYLDPQLFEDQIKEGYQATANWHQGVLWDPRRNNYCRWQYKTQPIYGWGNPNAIQQSTAGWLSFLQIFEPGWQILMAHGLATGWIEWNGRIYKFTNAPAYSEKNWGGAFPKKWFWLNCNSFYDVSDLTLTAGGGKRGVLWWMEKVAMIGIHYQGKFYEFVPWNSKVYWQIQPWGEWQMQAKNDLFEVELTATTNHSGTLLRAPSEQGLIFLCRDTMRGHLTLKLKEVRDSHSKLILEARSDLCGLEVGGGSWEQAWVK

SEQ ID NO: 16964 - protein, 410 aa, Trichodesmium erythraeum IMS101
MITTSEIYPYTEDTLQSNNLQNECSEHLGQTINELTIEDKKVDSSQINTNYSGRDSVRSYLQEIGRVDLLQRDQEVSTAQKVQRYVHLLELRNKAAEQEQEIQRYVEMIKIRDRLAARLGHKPSFERWLKAGNLSMAELKEIIAVGKLRWAKLTGLNVKELEQIQTEGIEARHQMISTNLRLVVSIAKKYQNRGVELLDLIQEGTLGLERAVEKFDPQRGYRFSTYAYWWIRQGITRAIATQSRTIRLPIHVSEKLNKIKKVQQKIFQEKGYTAKVEEIARELKITAAQVREVLVKIPHSVSLETKVGRDRDTELGELLETKDASPEEMLIRESLVQALKELLLDLTQRERYVITMRYGLEDGRACSLSEIASALKLSRERVRQIEVKALHKLRQPKFRNQIQDYLESLN

SEQ ID NO: 16965 - protein, 750 aa, Trichodesmium erythraeum IMS101
MKILTKFILSTSISLGLVTSLLGVSRLLIGRTEKSIEKARNHTNQAVYITHALMLSLETQTSFLKDYLLFNRGVFYLNSYQQEKLKFLASLEKIKELIPESQKTEVVGRRYQLLVRLANEIINNQDYSTSSIKQDIKAIKSFGGDIRLFLSFLLEEVRVKNDQSQQFAIQFKQNAAILTYCLILVVLLIFIGEFYLTLLPVIRSIQTLKTAATKLDIGTLNYHLDIQTGDEIQQIAQQFNQMAVKLANSYYSLDFLEQKRQVADAANKAKSEFLANMSHELRTPLNGILGYTEILSRSEAWGEKEKKGIDIIHQCGSHLLTLINDILDISKIEARKLELQPQAIHLPSFLQGIGEIICIRTEKKGVDFVYLPDANLPEGIVTDPKRLRQVLINLLGNAAKFTEKGQVTFKVRIIDSMAEQKKDKAQIPQDNVRLSFQIKDTGIGISPDSLEKIFQPFEQVGEGKRHSEGTGLGLTITDNILSLMGSNIQVKSELGVGSTFTFEIDFPLALEWQDQVITDTKKQLIGYEGDLQTLLVVDNKWENRSVIVNLLEPLKFNVIEAENGEDGLNKANKFRPNLIITDLMMPVMDGYEFMKHIRTSEILKPIPVIVSSASVISTVRQKSLDAGGDGFLEKPVGSDELFKLLQEHLQITWKYESILTPGSSDLQHQQNSRKQKTTAVDVLPPLVVLEDLFQLAQQGRLKKLVAVAQELEKENQEYGAFVDHIVQQAKDFEIKKITIFIQESLEKSNN

SEQ ID NO: 16966 - protein, 288 aa, Trichodesmium erythraeum IMS101
MTTLLTDNIRTLPNTTHNSTLQKYQGNLRSQNKPTVETEVSQENLISESNRELSSSSCFHRFWYKYFIFPEIETILTDFQIIFERDPAARNWIEVLCCYPGLHALLLYRLAHKLHYHKIPLIPRLISHFGRFFTGIEIHPGAQIGQGVFIDHGMGVVIGETAIVGDYSLIYQGVTLGGTGKEIGKRHPTIGTNVVVGAGAKVLGNINIGNNVRIGAGSIVLRHVPSDCTVVGIPGRVVSKSSERTEVLDHGKFPDTEATATRALVEKIQQLEEKLQTLIGETRKNNNV

SEQ ID NO: 16967 - protein, 403 aa, Trichodesmium erythraeum IMS101
MDRKVLIGICGGIAAYKVCEIVSTLVKSGAETRAILTDAAQQFITPLTLSTLSRYPAYTDKDFWQPSHGRPLHIQLGEWAEIIVIAPLTANTLAKLTYGFADNLLTNIILASSCPILLAPAMNTDMWEQTAVQRNWQQILAEKRFHGISPSTGILACDRIGKGRMAEPKEIITKIKSLLYTAGKKDLVGKKILISAGGTREHLDPVRFIGNPSTGKMGIALAQAALHRGANVTLVHSIVGKILLSGVKMIEVVSAAQMQQAMLAHFAQSDIVIMNAAVADVKPAKYNGEKLAKRSLGNSLPLKPVPDIVAELGKLKQSHQYLIGFAAQTGDIVPPALEKLWVKNLDAIVANPIDQKGAGFGSNTNQGIFLDVEGRQLDIPSCSKLEMAHYLWDFVLERYGANY

SEQ ID NO: 16968 - protein, 89 aa, Trichodesmium erythraeum IMS101
MSVYVGNLSYDATDEDLKTAFAKYGNVKRVQVPNDRETGRPRGFAFVEMESEDEETAAIEGLDGSELMGRILKVNKARPREERGSGGRR

SEQ ID NO: 16969 - protein, 231 aa, Trichodesmium erythraeum IMS101
MTLKAVLFDFNGVIINDDFLHEKLIAQLLLEENLLLKAGEYQKFCLGRSDKAGLEDLLIHRGRYVKQEYLERLIKRKTLSYQQQLESLEKLPIYSDTIDFISQLSQTDLKIALVTGAVRADVELVLNKANLVDFFKVTITGDDIKASKPEPDCYLLAVDILNQQYIDINLKPSECLVIENTFPGIKAAKLAGMPVVAVAHTYPFHMLQRLANWCVDYLSDLELDRIQKVYQ

SEQ ID NO: 16970 - protein, 348 aa, Trichodesmium erythraeum IMS101
  unsure (1)..(348): unsure at all Xaa locations
MTAVNTQKLDVYGVGNALVDILALVEEDFITKFSLQKSGMTLMDAQKQGGILAGLKDISLKKRSGGSAANSMIALAQSGGTGIFVAKVASDPNGELYRQDMLNFKMDFNVPPAPTADNPTGTCVVLTTPDAERTMCTNLGVSVNLSVSDIDVEQIKRCKYSYVEGYLWTGDSTKEACKQAMQYSKDEKVKVCFTFSDQFLVDMFADEFRSLLLDYCDVLFCNADEARSFCKKDSLDDSAKSIGELVETAFITNGKEGCLVVKDKQITSVPGFNATAIDTVGAGDAFXXXXXXXXXXXXXXXXXYGLTHGYEPTQAARWGNYLASNVVQIQGPRLEGSWADKVQQIINA

SEQ ID NO: 16971 - protein, 412 aa, Trichodesmium erythraeum IMS101
MDDTCPHKLVQLSLGTINQNGDLMCRHHGWCFDGAGKCTNIPMLSDEKALKTAFNSKRSQVQIYPIQVQQGLLWVWPDNSYTAFEDSTSKQPAVMPECKLDSSSTDWFMLEVPVGYTVSLESSFDPSHSQFLHEGIAGFSPERAIPMEHFEVFGKMSAEDGFTLKHSGYNVFNKDMDAMRKFTPPCSNTTIYEYSNGKSALFQLYFVPTKPGYCKYITKFIFDAVPKKNNFWMELLPKYLLTGLQHSSNNKLSNQDLSMMYSQAVNESARNQTWQKSYFMPALSDVGIVTFRKWLDEFAGGKPEWEGVIETGFKELNDEELYDRWHRHTKHCPSCRKSLILIEKIQDFCQNFTVVLALFALLLIAINLPTKIIFIPVLLALLSFISSYKLDLIRHSFLSSIPKKGLPVVKLY

SEQ ID NO: 16972 - protein, 302 aa, Trichodesmium erythraeum IMS101
MFNTLLADFRIIFERDPAARNWLEVLTCYPGFQALVFHRIAHSLYFHKVPFLPRLISHIARFLTGIEIHPGAVIGQGVFIDHGMGVVIGETAIIGDSCLIYQGVTLGGTGKETGKRHPTLGENVVVGGGAKILGNINIGSNVRIGASSVVLKDVPPNCTVVGIPGRVVDRSGVKVNPLEHGSLPDSEAKVMRALFNRINSLEEQVQLIKILQFQEPELESVVAKPHLKSFANHSNYRLTDLALFNRINYLEEQVKLIKSLQSQLLELDSTVAKPPLKSSANNYSNYDFQDLEIQDFFDGSGI

SEQ ID NO: 16973 - protein, 323 aa, Trichodesmium erythraeum IMS101
MRELPYGWDFFMENVSDPAHVPVSHHGLMGSRYTDNKYYDMIRVREFSTQEGFSFKIQPINTPGVKQAIHDFQPPCHMRIVSELENGGKSIFALYASPSRPGWCRTIGCQVFVKDEQGKRGKGLAFFGLPMPEWLNHLLGPLFLHQDLVFLHYQEKILANKQEEKYLDAVYTPNPQDKMVITFRKWLEKRAGGGIPWSKECNPELPTPEYDRRKLFDVWETHTKNCMVCQNALKNINRFKILTYVVAVLCLCLGIIIDARAIAIQVATATITETGTSVSGFPLPPLGFWFALGGAALFAFSGYKLQQLIRLFYVYEFEHADNH

SEQ ID NO: 16974 - protein, 336 aa, Trichodesmium erythraeum IMS101
MQLKLTNSKLPLAPLLLIAPFFFWGTAMVAMKGVIPQTTPFFMAAIRILPAGILLLLIGMLQGRPQPQNKLAWLWILLFALIDGALFQGFLAQGLVKTGAGLGSVMIDSQPLAVAILSLWLFQERIRFWGWLGLGIGVFGISLIGLPDEWISSLLHPETIQISLGMDTFSQSGEWLMLLASLSMAVGTVLVRWVCKYNDPVMATGWHLILGGIPLLAISAGVESQQWVNIDQYGWIAMGYAAVFGSAIAYGLFFYFASSGNLTSLSALTFLTPIFALLFGNLFLGEILSRLQSIGVGLTLVSIYLINQRDVLAERLNFSSSRQEVFSNITTRNLLK

SEQ ID NO: 16975 - protein, 927 aa, Trichodesmium erythraeum IMS101
  unsure (1)..(927): unsure at all Xaa locations
MLSVEIPKPQLKTSFLQRLQSPDRPVLIFDGAMGTNIQSQNLTAEDFGGAEYEGCNEYLVVTKPEAVAKVHRDFLAAGADVVETDSFGSSPLVLAEYNLADRAYELSRKAAELARSCADEFTSPEKPRFVAGSIGPGTKLPTLGHITYDELKASFMVQAEGLYDGGADLFIVETCQDVLQIKAALSAFEAVFAKKGSRLPLMVSVTMEIQGTMLVGTDISGVLAILEPFPIDILGLNCATGPNLMTSHIKYLSENSPFPISCIPNAGLPENIGGQAHYKMTPLEFKTSMSEFIGQYGVQIVGGCCGTRPAHIQALADAVEETPLKERSVRKNAVGKVRTPLSYTPAAASIYSAQTYEQDNSFLIVGERLNASGSKKVRKLLNEDDWDGLLAIAKSQVKEGAHMLDVNVDYVGRDGERDMRELVSRLVTNTTLPLMLDSTEWTKMEAGLKVAGGKCLLNSTNYEDGEERFFKVLELAKEYGAGVVIGCIDEEGMARTAKKKFEIAQRAYKDALKFGIPPHEIFYDTLALPISTGIEEDRENAKATIESIRLIRENLPGVHFMLGVSNISFGLSPATRITLNSIFLNEAMKAGMDGAIVSAAKILPLSKIDEEHQQICCDLIYDNRKFEGDICTYDPLTKLTEIFAGVSAKDARSGPSLADLPIDQRLKQHIIDGERIGLEDALKVALDAGHKALEIINTFLLDGMKVVGELFGSGQMQLPFVLQSAETMKSAVAFLEPYMEKIEGEDEDRGKGKFLIATVKGDVHDIGKNLVDIILTNNGYKVINLGIKQAIEAIVEAYEQHKPDCIAMSGLLVKSTAFMKENLAAFNAKGITVPVILGGAALTPKFVYGDCQDTYQGQVIYGKDAFADLTFMDRLMPAKDKDCWVDTEGFTGEFAQFNQRGRKAIKDLXXXXXXXXXXXXXXXXXIR

SEQ ID NO: 16976 - protein, 1119 aa, Trichodesmium erythraeum IMS101
MALKYLSRLFAQISGKVPLRTTLILPFIVQVFGVVGLIGYISIENSQRAINDVVNQLLNEQVARVEQNLEAYLRVPHQVNQINATTIRNGQLDLENTSQLENYFWQQLQIFDVLGFTGLGLENKVNLGAERLTQDTLHLRISTQESNYIFETYSTNQFGERVQLLNSIKFDPRTRPWYKAAVASGQPTWSEIYPNTAGLTAYLGASKAFYNDQGKLQGVLLTNINLSQIGDFLGSLEIGKTGQIFILERSGMLVATSTGEKPFRTINKAYGAERVQAIESYNDLTQATAKYLSTEFDLNKLINDGKYLQFKINNQRQFLNIKPFQDQYGLDWLIVIVIPEIDFLDNIYKQTKITIILCLLALVLATVIGILTSRWVVQPILKLKDVATALSEGEFNQKIELNRDDEVGELAKAFNSMAFQLQNSFNLLTIKNKQLENLDKLKDEFLANTSHELRTPLNGIIGITESLIDGVAGELSSEVKNNLYLVIFSGKRLSNLINDILDFYKLKHRNIELKLKPVGVREVAEIVINLSSSMIGTKPLQIINSISYDIPFVDADENRLQQIFYNLVGNAVKFTDSGKIEVSAKVLENQLENSSNNVSLLEITVSDTGIGIPSDKLDQIFESFEQANGSTSREYGGTGLGLAITKKLVELHKGSLCVLSEVGVGSQFKFTIPISKTQVVNFPQVTLSPSIPLVTDFEPKSKDVKLQYLEAEMGDFTVLIVDDEPVNLQVIRNNLALQNYAITEANNGIEALEMIEKGLMPDLILLDVMMPHMTGYEVAKKLREKYLHIELPIIMLTAKPLVSDLVEGFVSGANDYLIKPFSKQELLARIKIHIRLSKISSAYNRFVPHNFVQLLNSESIVDVKLGDSIKQKMSILFSDIRSFTTLSESMTPEENFKFINAYLSRMEPAILDNEGFIDKYIGDAIMAIFIRKADDAVQAAINMLKNLADFNQERQKLSQEMIKIGIGINTGDLMLGIVGGERRIDGTVISDAVNLGSRLESLTKLYGVNILISENTLLNLEEAYKYNYRFLDKVKVKGKKQAVGLFEIFDGDPEEQKELKKQTKTKFEQAVFLYFQQKFATAKQIMIEILQINPEDKVAQFYIRRFDESKLIEELKDGE

SEQ ID NO: 16977 - protein, 425 aa, Trichodesmium erythraeum IMS101
MVATPVKIKYEVKDESLAVLGKQRIEWAGREMPVLRQIQERFAKEKPLSGIKLAACCHVTTETAHLAIALKNGGADAVLIASNPLSTQDDVAASLVVDHGISVYAIKGEDEKTYLRHVEIALDHRPNIIIDDGSDVVATLVKNRQDQLPELIGTTEETTTGIVRLRAMFNDGVLTFPAMNVNDADTKHFFDNRYGTGQSTLDGIIRATNVLLAGKTTVVVGYGWCGKGTALRARGLGANVIVTEVDPVRAIEAIMDGFRVMPMAEAAPLGDLFITVTGNKHVIRGEHFNVMKDGAIVCNSGHFDIEIDLETLGKNADNVKTVRPFTQQYTLKNGKSVIVLGEGRLINLAAAEGHPSAVMDMSFANQALACEYLVKNKGKLQPGLHSIPTEVDKEIARLKLQAMGIGIDTLTDEQLEYMNSWTVGT

SEQ ID NO: 16978 - protein, 496 aa, Trichodesmium erythraeum IMS101
MIMIGHTLELDDLKKISSPKKIVALFEKLGFNFQIEHLDIEQLELPSYCRETIDNTYKIYNPNQEELQVFLLELRQEKFKTNYKEQERIITISQGILRNKNNFLLIATKKYNKLIIVAPHRRENQNIKISIKWWLIDCQNPNYYDTYWLENVAINNCEPTEELTNKHNSEGSYDPDIEPPTGTFTEDSIQLYYKQVNSFARLHPEEEIHLAHQIDGLLALEKIYEKLEEKLNRSPNEIEWATEAKMSKWELCDRLEQGRRAKNQMVTANLRLVTSVAKRYQNRGLDFQDLIQEGVIGLLRATEKFDHTKGYKFSTYGIWWIRQAITRAICDYSRIVRLPVYLYETISQIKKIVKQISIECSPLTAEEVATRMEMTTEKLQFIIECAQETLSLDYPINKGENIIYKEMIKFNGETPTKYVFENCLQEDVESVLKTLTERERNVLQMRFGLDDGQEKTLKEIGDTFNLTRERIRQIEAKALRKLEDPKRNHILREYIH

SEQ ID NO: 16979 - protein, 635 aa, Trichodesmium erythraeum IMS101
MHLSEITHPKQLHNLSIHQLEEIARQIREKHLETVATSGGHLGPGLGVVELTLGLYQTLNLDRDKVIWDVGHQAYPHKIITGRYHNFHTLRQKDGIAGYLKRCESKFDHFGAGHASTSISAGLGMALARDMKGDNFKVVSIIGDGALTGGMALEAINHAGHLPKTNILVVLNDNEMSISPNVGAISRYLNKMRLSPPIQFLQDNLEEQFKQIPFVGETFTPEMEGLKGGMKRLAVSKVGAVIEELGFTYMGPVDGHNLEELITTFNQAHQIPGPVLVHVATTKGKGYPVAEEDKVSYHAQNPFNLATGKALPASKPKPPKYSKVFAHTLVKLAENNPKIIGITAAMATGTGLDKLHGKLPKQYIDVGIAEQHAVTLAAGLASEGMRPVVCIYSTFLQRAYDQIIHDVCIQKLPVFFCLDRAGIVGADGPTHQGMYDIAYLRCIPNMVVMAPKDEGELQRMVLTGIKHTDGAIAMRYPRGNGYGVPLMEEGWEAITIGKGEILRNGDDVLILGYGSMVYSAMQTAEILSEHGVAATVVNARFVKPLDTELILPLAQRIGQVVTMEEGCLMGGFGSAVTEALMDNNVLVPVLRLGVPDKLVDHAKPDESKADLGLTPSQMAERILQSFKPRLSTINV

SEQ ID NO: 16980 - protein, 323 aa, Trichodesmium erythraeum IMS101
MGFYNQGQAFSAHPRIDKGKDGKGDVLVNFSVKPGLSSTITIFEFNSQGKLLKRYSNSIPGFAFLHDMVITPNYCIFFQNPVAFNPFPLLLGLRTPGQCLEFLPNNSTQVILIPRDGSKAIKILKTKPCFVFHHANAWEKDGEIYVDSICYESVSQTDLGDNFLEVDFDSMTEGKLWRFKINLSENNVEHKLLESRCCEFPTLNPNNVGKAYRYLFIGAADKPSGNAPLQAILKIDLHTGKRQTFSVAPRGFAGEPLFVPFPNGVNEDDGWLLMLMYDAAEHRSDIVILDARDLNKKPVARLHLKHHIPYGLHGSFTPNYFQE

SEQ ID NO: 16981 - protein, 851 aa, Trichodesmium erythraeum IMS101
MRKQVAIHIVREVDNYLQIPHQINQLTAYAINEDNLSIFPVRGQGLFWLQMNLFKSIQWIYCGSPEKGEYMGVTRLPQKSEYMGEQRLGKNDMLWLAFSNELTNFFRYEYALDSQGNMTNLVIQGSKKFDSRNRPWYQAGESAGKATWSEIYKDFATGKLTITATLPVYDRENNLKVICGVDIFFSEELSLFLKTIEIGDTGEAFILNNKGILIASSVVEDKDKLGFQKAIDSNNQLIKSATQYLIEQYKNLSQIETTKKLNFIQDGEKIFMQVSPYKDKHGLHWLTVVVIPENEFMAQINENTKSTIRLCILALAIASGLGLLIVNWITKSIKKLSTAAYAISHGEINQNVSIQGFKELVILAESFNKMTKELAESFNHLERKNQELQHLDQLKDEFLANTSHELRTPLNGIIGIAESMMDGATGNISELQNKNLSMIVVSGHRLANLVNDILDFSKLRHHSIKLKMSSVGMREVTEVVLTFSRIILKEKDVQLINAISSDLPPVEADENRIQQIMHNLVGNAIKFTEVGVITISAELIDLKNNPKMAITVSDTGIGIPEDKHEAIFASFEQGDGSTERRYGGTGLGLPITKQLVELHGGTISVKSNPGVGSEFTFTLNISKEPVHSFSLKNVNNLIEGVETSVDINKNENHLIPNNGNFHILVVDDEPINIQVLNNYLKANNYQVTQALSGKEALAALENNHNFDLILLDIMMPNMTGYEVCSQIREKYPAQSLPVLMLTAKNQIADLVMGFQFGANDYLTKPFAKDELLTRIQTHIKLSKITKAYERFVPHEYVELLSKESIINVKLGDRVSTEMAIFFSDIRSFTTISEQMTSQETFAFVNGYLKEV

SEQ ID NO: 16982 - protein, 428 aa, Trichodesmium erythraeum IMS101
MHLSEITHPKQLHNLSIHQLEEIARQIREKHLETVATSGGHLGPGLGVVELTLGLYQTLNLDRDKVIWDVGHQAYPHKIITGRYHNFHTLRQKDGIAGYLKRCESKFDHFGAGHASTSISAGLGMALARDMKGDNFKVVSIIGDGALTGGMALEAINHAGHLPKTNILVVLNDNEMSISPNVGAISRYLNKMRLSPPIQFLQDNLEEQFKQIPFVGETFTPEMEGLKGGMKRLAVSKVGAVIEELGFTYMGPVDGHNLEELITTFNQAHQIPGPVLVHVATTKGKGYPVAEEDKVSYHAQNPFNLATGKALPASKPKPPKYSKVFAHTLVKLAENNPKIIGITAAMATGTGLDKLHGKLPKQYIDVGIAEQHAVTLAAGLASEGMRPVVCIYSTFLQRAYDQIIHDVCIQKLPVFFCLDRAGIVGADG

SEQ ID NO: 16983 - protein, 271 aa, Trichodesmium erythraeum IMS101
GESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISN

SEQ ID NO: 16984 - protein, 88 aa, Methanosarcina barkeri
MVFITPDAERTMCTFLGASADLQPEDVPDAILTTAQWCYVEGYLVTAPNTLAAALKGLQQARANGVKTALSFSDVNMVKFFRDGFSQM

SEQ ID NO: 16985 - protein, 75 aa, Methanosarcina barkeri
MRGFGRQKGHTELYRGAEYRVDFLPKLKVELAVDDSILEQAVEAIQKGAKTSKIGDGKIFVYDLESAVRIRTGES

SEQ ID NO: 16986 - protein, 385 aa, Methanosarcina barkeri
MCFRWRISFQEHDFNRIKKFSRGKETPFLTVDLQKIEQSYDELVEHMPFAKIHYAVKANPMDEVVLALKSKGSNFDVATVYELDQLLRLGVEPERISYGNTIKKEKDIEYAYEKGVRLYVTDSDSDLKKLARKAPGSRVFFRILTESDGADWPLSKKFGSHPDLIYKLILKAEKLGLEPYGLSFHVGSQQRDIGQWDNAISKCKYLFEAAAEKGIHLKMINLGGGFPAKYQAQAHDLETYAGEIRRFLHEDFGEELPEIIIEPGRSLVANAGIIVSEVVMISKKARFNQYKWVYLDIGKFGGLIETLDECIKYPIFCDKKGCAEEVILAGPTCDSMDILYEHHKYTFPHTMREGNRVYIFTAGAYTQSYSSVCFNGFPPLKAYLT

SEQ ID NO: 16987 - protein, 299 aa, Methanosarcina barkeri
MDRVISIVGHTALDYIVDVERIAGKNESSPVIDYEEYPGGGAANIAVAIAKLGGKSQLISPVGTDFVSSGYEKLLTEANVDLSRLYRIEDQKISKAFIFTDKEDNQTTYFYWGASSKFKKLEPEPVDFVHLATADSVYNAKLAQIAGFVSFDPGQDLVTYSKENLELILAHTDILFANRHEIRRVSEMTGKSFSELKAMIDIIVVTYDSKGSKIYTDKNEFLIPVISVQAADPTGAGDAYRAGFLLALTRGYPLPTCGKIGSTVASFAVQARGCQTDLPTWEEMKARYEANFGRLEKEC

SEQ ID NO: 16988 - protein, 120 aa, Methanosarcina barkeri
MMIKMKYIIAMIRPEKLDSVKKEIQKIGAHGLTVSSISGYGAQGGHLNVDRTKTEKYEANLLDKVKIEIAVKDEFLQTTVEAIERGSKDVDGYIGSGKIFVLPLENVMRIRTKETGNDAL

SEQ ID NO: 16989 - protein, 533 aa, Methanosarcina barkeri
MAGDSKCYQECSGPEADRLRFCLSDEEVLKLSGYAIAIEDHYSEKYGESRPMDIEWAKDGITDELFIVQARPETVQSQRRKDILETYVLEKRSEILARGRSVGDKIASGKAHVIPDISDLPSFKPGEILIADTTTPDWEPVMKNAAAIVTNKGGRTCHAAIVSRELGIPAVVGAGNATEVLETGREITVSCAEGEEGLVYDGILPFHKDTLSLKDMKRPKTDIMMNLGNPEEAFGFSMIPNDGIGLARLEFIITSYIKVHPMALVHPEKVKDLKVLQEIEQLTRGYRREDYFVEQLAQGVSTIAAAFYPKPVVVRMSDFKTNEYASLLGGSYFEMEESNPMIGFRGASRYFDERYREGYALECRAMKKVRDEMGLTNLILMIPFCRTVEEARKVIDEMEKNGLKRGENGLQVYVMCEIPNNVLLIDEFSDFFDGFSIGSNDLTQLTLGVDRDSELLAAEFDERDPGVMKIMSMAVQGAKRNGRHSGICGQAPSDFPEIAEFLVKEKINSISLNPDSVMKITLKVLETEKELGR

SEQ ID NO: 16990 - protein, 428 aa, Methanosarcina barkeri
MSYIGLQQDSGEYKIQKIHAREILDSRGNPTVEVDVFTPKGFGRAGVPSGASTGTNEALELRDADPNRYGGKGVLTAVKNVNTIIQKELLGLDVRNQREIDELMIELDETDNKSNLGANAILGVSMAVARAAADSLNVPLYRYLGGSNAFTLPVPTMNVLNGGKHAGNDLAIQEFMIQPKGAETFYEALQIGAEIYHVLGKILEKKYGRSSTNVGYEGGYAPKMSESTEALDALAQAIEEAGYTDTEVTIGLDAAASEFYEDEAYAIDGKKLSAPELMDYYVELVNSYPILSIEDPFYEEAFEDFEALTNELWDTIIVGDDLFVTNIERLSKGVDMGAANALLLKVNQIGTISEAFDAANMASRNGYTVIVSHRSAETEDTTIADISVAIGAEMIKTGAPARGERTAKYNQLLRIEEDLGEVAHYVQL

SEQ ID NO: 16991 - protein, 280 aa, Methanosarcina barkeri
MTDQVQPLVNLSKKPTEPKMIINLRRIKRKILIMSGKGGVGKSTIAANLAIGLVLHGYRVGLLDCDIHGPTIPTIFGMESMKPEVSEEGIMPVEVLPNLLLMSVGFLLEDKDSPIIWRGPLKMGIIEKLLEDVVWGELDFLIIDLPPGTGDEPLSLALLIPEIDGSVLVTTPQDVALVSVRKSIGFSKELNVPVIGIVDNMHGLICPHCGKPIKVFRNGGVEKASKDFNIPILARLPIEPKVAKMEDKGTVVQEMLKHDTEWQKNFENFVIAVEKILKEK

SEQ ID NO: 16992 - protein, 493 aa, Methanosarcina barkeri
MVQEYKLFIGGEFKDSSTGETFEDINPATLENLATIQVAGAEDVDMAVEAAEAGFRLWNEVPAAKRAEVLFRAARILQERKEELSVLMTKEMGKVLPETRGDVQEAIDITNYAAGEGRRMLGETTTSELKEKFCMTILRPIGVVGLITPWNFPIAIPAWKVMPALVAGNAIVFKPASDTPLLAFKLIEVLSEAGLPPGVINLVTGPGGTVGKAVVQHPRIKAISFTGSLDTGKWIMEECSKTMKRVSLELGGKNPVIVMDDADLELALEGVLWGAFGTTGQRCTATSRLILHEKIKDEFIKRLLAKAKALSIGGGLLPETDIGPVINKAQLEKIERYVKIGKEEGATLLYGGNRIDPGLPGYFFEPTIFTDVRPDMRIAQEEIFGPVLGIFTVSDLEEAITLANSTKYGLSSAIYTGNIGNAFRAIEKVEAGITYVNAPTIGAEVHLPFGGVKGTGNGFREAGTEAVKEFSEVKAVYIDYSGMLQKAQIDSAE

SEQ ID NO: 16993 - protein, 422 aa, Methanosarcina barkeri
MYEDTKGLIELLVTYFKEGLEGGEYCLWVSPDKLAAEEAKNELMKVGVDVEPYLTSSQLEFLPANPLPEDLTLLASTVTELAEKGYRKTLSGGFSGFRTNFEIKNAGNSLKPCLETCGKAIEIMALEKNKSITFLYTIPLEELSGRVLLELMEESNVFTKRKGKLESLRSLEEKIELKNEFLKAKKDIDASNWAKNGLIVNMNHELRTPLNSVIGFSDLLLEGAFGSLNTRQSKYVSNILISGKNLLEIISNLLDISRLEAGEKNLNYEDVDIASLLGEVRMSLLSFASSKKVSIEIKVDASLENIRADRTKLRQILYSLMNNAIKLTPEKKKVTVSALKKEGMLEIKVSDSGIGLSKEDHERMLMPFIQADLSTTSGYGGTGLGLYIAKNFIDIHGGKIWVESKGGKGSTFIFTLPLNGRN

SEQ ID NO: 16994 - protein, 815 aa, Methanosarcina barkeri
MSENKSKYIRWFDETSIEDVPLVGGKNASLGEMYRELTPKGVKIPNGFSVTAEAYWHVLKAGGILEKLKQTMEGLDTSDVSELAKRGKAARDLILEAGIPDDLWQEIKSGYDRLCEQYGENTDVAVRSSATAEDLPTASFAGQQESFLNIRGYPALRDACVRCIASLFTDRAISYRVINNFDHFKVALSIGIMKMVRSDLASSGVIFTLDTETGFRDVVFITGSYGLGENIVQGQVNPDEFYVFKPTFREGYKPIIEKNLGDKEIKMIYGQGGSKTLTRNVNVPEADRRRFCLSDEEVLKLAWYAITIEDYYSNKYKKSMPMDIEWAKDGATGELFVVQARPETVQSQKSRDILETYVLEKKSNVLTKGKSIGDKIAAGKAHVIPNVSDLPSFKQGEILIADSTTPDWEPVMKIAAAIVTNQGGRTSHAAIVSRELGIPAVVGTVNATEVLKTGKEITVSCAEGEDGLVYEGILPFHKDTLSLKDTRRPKTAIMMNLGNPDEAFSLSMIPNDGIGLARQEFIISNYIKIHPMALVHPEKVKDSKVLQEIEKLTQNSDNKEEYFVDKLAQGVGTIAASFYPKDVVVRTSDFKSNEYASLLGGSYFEMEENNPMLGFRGASRYFNERYREGFALECRALKKVREEMGLKNLIIMIPFCRTVEEAQKVIAEMEKNGLRRGENELQIYVMCEIPNNVLQIDKFSEYFDGFSIGSNDLTQLTLGVDRDSEILTAEFDERDPGVTKIMAMAVKGAKQNGRHSGICGQAPSDYPEIAEFLVKQGIDSISLNPDSVMKVTLKVLETEKGLGGKKEAEKITGVH

SEQ ID NO: 16995 - protein, 157 aa, Methanosarcina barkeri
  unsure (1)..(157): unsure at all Xaa locations
MEDSYTXNFSGGSAMVVAQYYKILRFGRAGYTRIMKNIREVSQDLAEKVDRLGRFEMLNKGERLPIIAFKQKEETDYSLQQLSYKLRERGWIIPAYCLPENAADIEIMRIVVRENFTSDMAAILVNDIENACQFFENGRKSETKKPCPPDDGMVHIC

SEQ ID NO: 16996 - protein, 314 aa, Methanosarcina barkeri
MGIKEDIRTVFEKDPAARSTLEVICCYPGLHAIWIHRISHSLWERHFYFLARLLSHISRMLTGIEIHPGAKLGRRVFIDHGSGVVIGETAEVGDDVLIYMGVVLGGTALEKVKRHPTIENDVVIGSGASVLGPITVGRGAKIGAGSVVIRSVPAGATVVGVPARIAETHPSVSAGQLDHDKLPDPGLIVISQILDRLSSLEDKFQAHEELVSGHGKTPQGTVLKDEQIYSLLKDVVDPGVGMDIVKLGLVKEVVVDGPNVEVNLVLTTSACPMIEYFKEQIRRKVLSAEGVEKVNVNILDEPWSWDQNKKKVVH

SEQ ID NO: 16997 - protein, 280 aa, Methanosarcina barkeri
MTDKVQPLEGLSKKPEEPKIVVNLRRIKRKIMIMSGKGGVGKSTVAANLAAGLALRGYKVGLLDCDIHGPTIPTIFGLESQRPDINEEGILPISVLPNLSMMSIGFLLGDKDSPIIWRGPAKMGAIKQFLEDVVWGVLDFLIIDLPPGTGDEPLSVAQLIPNCDGSVLVTTPQDVALISVRKSIIFSEKLNVPIIGLVDNMHGLICPHCGKPIEVFGTGGVEKASKDFDIPILASLPIEPKVAEMEDKGTIVQGLLDHSTEWQNNFEAVVTAVEKTLEEE

SEQ ID NO: 16998 - protein, 829 aa, Methanosarcina barkeri
MEIITRSKVVKATLQSLFCLTIMSLTSAIAAASEANLKIPNLSQEQNNLLLWGIVVCVLGMLFGLYQFMKVKKIRAHKSMLDVADTIYETCKTYLIQQGKLLCILFVFIGLCIAFYFGFLQKMPLSGVLLIMAWTILGILGSYTVAWYGIRMNTLANSRTAFVSLEKKPLKLLNIALDAGMSIGVLLVCVELIMMLIILLFVPRELAGASFIGFAIGESLGASALRIAGGIFTKIADIGSDLMKIVFGIKEDDPRNPGVIADCTGDNAGDSVGPTADGFETYGVTGVALVSFIVLAVQPDLTGILLTWIFVMRILMIITSVASFYINKAISQARLSGKDDFDFEQPLTSLIWITSIFSIIGTFAVSYYLLGPKSGVPVELEHLWLVLSIIISCGTLGAALIPEFTKVFTSPNSKHVAEVVKASREGGPSLNILSGLVAGNFSSFWIGMVFFLLMFVAYYASGYGLSEIMIYPSIFSFGLVAFGMLGMGPVTIAVDSYGPVTDNAQSIYELSLIETIPKIKEQIQKEFNFKPDFDKAKHYLEANDGAGNTFKATAKPVLIGTAVVGATTMIFSLILVIKDVLGVQPEEILTLLNPYTIFGLLAGGCVIYWFTGASIQSVTTGAYRAVEYIKRNIQLDENASQKASTEKSKEVVKICTQYAQQGMFNIFIAIFSFTLAFSCLSAPISRNDSVSLFVSYLISIAVFGLFQAVFMANAGGCWDNSKKVVEVDLQEKGTDLHEATVVGDTVGDPFKDTSSVALNPIIKFTTLFGLLAMEIAISESFRNIAPYVGGVFLLVALFFVWRSFYGMRIPLRNENPNMEKMKEPVADQE

SEQ ID NO: 16999 - protein, 671 aa, Methanosarcina barkeri
MEGLIFIAPSAGIISLAFATFFANNVLKEHTGSKRMQEIAGAIQEGSVAYLSRQYRTIAMVSTMLMVLILFLFDDGLKVAVSFLAGAISSTAAGYIGMSVSVRANVRTAYAASSGIEKALSVAFRGGAITGLAVVGLALLGTSGFYILYGDVNLVVGFGFGASLISLFARVGGGIFTKAADVGADLVGKIEVGVPEDDPRNPAVIADNVGDNVGDCVGMGADLFETYVVTSLAAMLLGSLIVNVYENAILYPLVLGSTAIFASIISMFFVKLGREGNVMKALYKGVAGSVIISLVSFYFVTNSLMGNPGLYYAAFIGIIIMVLMVVITEYYTSTRYRPVKSIASFSETGAATNIISGLSIGFESTLLPTVVIVVGILASYFIVGGTTNPEIGLYGIAISAVAMLSTTGMVVALDSYGPITDNAGGIVQMAKLPAHIRKVTDALDAVGNTTKAVTKGYAIGSAALGALALFADYRNKVNLGGQSLNLDDPVVLAGLLLGALLPFIFSAVTMRSVGRAAFEIVNEVRRQFREVPGIMDGTARPDYGRCVDIATKAALQKMTLPGFLAILAPLLVGFLLGPKALAGLLIGLIVVGFMVALLMDNGGGAWDNAKKLIEDGAHGGKGSEAHKAAIVGDTVGDPFKDTAGPALNALIKVVNMVAILFSSLIMGKGLF

SEQ ID NO: 17000 - protein, 413 aa, Methanosarcina barkeri
MNMTEKELIESGNMKMDWARNHMPVLAIVRKKFEEEKPLKGMKVGMALHVEAKTAVLVETLAAGGAEVAITGCNPLSTQDDVSLALGTRKNINCFAKYGVESQEYYKAIDQVLDIKPDITIDDGADLIFKLHTERTDLLPNILGGCEETTTGVHRLHAMEKEGALKMPVIAVNDAMTKYLFDNRYGTGQSAWDGINRTTNLLVAGKNVVVAGYGWCGRGVAMRASGLGANVIVTEVDPVRALEARMDGYRVMKMADAAKLGEIFVTTTGNRDILTAENFKSMPDGAILANSGHFNVEIDMGALESLAKSVRTVRHNIKEYDLGDRRINVIAEGRLVNLAAGDGHPAEVMDMSFANQALCVRYIAENKLPNGVHKVPLELDTFVARMKLQSMGITIDELTTTQECYMSGWECGT

SEQ ID NO: 17001 - protein, 105 aa, Methanosarcina barkeri
MKMIKALIRPEAADDVIEGLAEGGFVSLTKIDAFGRGKQKGVTVGTIHYDELPKTMLMLVVENESVEEVVKLIKYKAYTGYQGDGKIFVIPVDNAYTIRTRDAGL

SEQ ID NO: 17002 - protein, 173 aa, Methanosarcina barkeri
MNLLKKLLNSSNTKRTPVIKETVKFSSFPLTMHTQYVPGMQAFEEGEIMKEIIAIIRPKKVVPTKEALEKLGVPSLTAIPVFGRGKQKGIATELDIEIRPEILDQSIKAGRRMEYIPKRLFSIVTRNEDVDTIIETIMKVNQTGDIGDGRIFICPVDDAIRVRTDEHGDNALL

SEQ ID NO: 17003 - protein, 213 aa, Methanosarcina barkeri
MKVLYVYAHPEPKSFNGALKETALAALQEKGHEVKLSDLYAMKFHPVLKASDFPERKKQDVFKPFFEAIQASKTGAFAPDVKEEMDKVKWADLLVFQFPIYFTFMPAIMKGWIDRVLAPGFGFNPVTNSDYDTGLLKGKSAIIVTTTGAPKTMYSEGGAHGDLNKHLESITHCIFEYMGMKVLPSYIIYEASSMSRERGAEELEKYRHRILDL

SEQ ID NO: 17004 - protein, 476 aa, Methanosarcina barkeri
MKMQINGKAVEACSGEFFDIINPATGELIDRVPKGTEDDAAIAVESASSAFNGWASTSPQQRARILYTAAGIVRQRKDELAVLLTREQGKPLAEAKNEIEGFAHVLEYYCGLASSFHGDFVPVPQNGYAFTVKKPLGVCTAIIPWNMPALIMAWKIGPAMISGNTLVLKPASNTPLTNLALASILSEAGLPPGVLNIVTGPGEVVGESLVKSPKVKKISFTGEVRTGKRIAELAAGGMKRVTLELGGSDPMLVCDDANLEAAVAGALRGRFYNCGQACTAVKRLFVFESVAERFIKKLEAGIRNLRVGNGLHENIDLGPLNNRRQWEYIKELVADAEEKDEGRIVAGGRVPEGSACSKGYFFEPTLIVDVDRKSRLLNEEVFGPVLPVVRVKDLDEAIEEANNTCYGLGASIWTKNLDRARIGCEQLNAGIIWLNQHLKVAPEVPFGGTRESGIGNENGPDALSEYLDLKTVMLKI

SEQ ID NO: 17005 - protein, 454 aa, Methanosarcina barkeri
MKLKSINPYTEKINWAYDSFSIGECRARIEKSRTAFSLWDSLPVEEKAKHFKTAAEILRESTDTYAEIITKEMGKPVRQSKNEVQKCAQLCDYYAENSTELLKDEIVDIGTEKSYVTFEPLGVIFGIMPWNFPFWQVFRFAIPAMCAGNVCVLKHASNVPKSALEIENILLEAGFPENVFNTLLIDSKTAMQILKEELVDGISFTGSVGAGSKIGKLAGRGIKPVVLELGGSDPFIVLEDANIERAAQAAVKSRFLNAGQSCTAAKRLIVVEDIVMDFIESFEFKVKELKIGDPMDEKTDIGPLAKKEFLGSLERVLKDAKKKGAKPHVYGEEHKKGFFFRPTIIPAASTDMEVCRTEIFGPIAPVITVKDENEAVAIANSTEYGLGAKIWSGDLDRAERLAKRIKSGSVSINGMIKSDPRLPFGGTKKSGVGRELSHYGLREFVNIKTVVVNR

SEQ ID NO: 17006 - protein, 105 aa, Methanosarcina barkeri
MKMVRAILRPEWTEEVTDGLAEAGYYSLTKINVFGRGKQKGITVGDVHYDELAKTMIMMAVEDEAVDEVIKIISGKAYTGNMGDGKIFVNTVEAAYTISSGEKGL

SEQ ID NO: 17007 - protein, 123 aa, Methanosarcina barkeri
MKEITAVVRPNKMSATKDALDKIGYPSITAIPVLGKGKQRGISGELNFYIQPRLLAKRYSTGMKYIPKRLLSIVVNDEEVDQVIKTIIEVNQTAQIGDGRIFVESIDEVIRIRTGEKGKLALK

SEQ ID NO: 17008 - protein, 115 aa, Methanosarcina barkeri
MTKMCKIEAIIKPMKLHEVKDALEEAGYPSLTVTDVKGRGQQKGIVQQWRGKKYCVDLLPKTKIEIAAPEDKIEEIIKIIQSSAYTGEIGDGKIFVTPIETVVRIRTGERNGDAL

SEQ ID NO: 17009 - protein, 353 aa, Methanosarcina barkeri
MIDCSGPIECDLLPRLIHVTEAAAIAAAYQMGRGNKSFADQVAVAAMRRMLNKLDMKGIIQIGEGERDEAPMLYIGEHVGTGKGDLEVDIAVDPLEGTNLTADGGPGSVAVMAMAERGGIFHGPDIYMDKIVVGPDVVRYEEEHPDERIDLDAPVKRNLEIVAKALDRSVDELVVVVLDRPRHAQKITEIREAGARVKLISDGDLMPGVSTAIRGSGVHMVMGSGGSGEAVLTAAAIKILGGKVLARLLLPTVANGKSQDKVDKEIEEKMPRLEKMGITLQNINDVLDTDRLVPGNDVIFSASAVTPGHFLREVNLFGSGDARVHTISMGASGSVRFTDSIYIKDKRETPLYL

SEQ ID NO: 17010 - protein, 346 aa, Methanosarcina barkeri
MEEEKHHTEHVPEWKKDEIENIMELIQSHKVFGMVGIEGILATKIQKIRRDLKDVAVLKVSRNSLTERALNQLGESIPEMNKYLDKQTALVFTNESPFKLYKVLEQTKTPSPIKGGAIAPADIIVQKGPTSFPPGPILGELQSAGIPASIDAGKVAVKETKVVCKAGEVVSQKLATMLTKLEIYPLIVGLDLRAVYDNGAIYEPELLAIDESQYFSDITRAAQSAFNLAVNTAYPTSATIGTLLAKAFAESKNLGVNAVVFDSGVMDALLAKAHVQMTSVASEAADKDANAVDDQLREVLGAAASAAAAVAKEPEKKEEVKEEEEEEEEEDHSEEDGMAGLGSLFG

SEQ ID NO: 17011 - protein, 174 aa, Methanosarcina barkeri
MATGPRYKVPFRRRREGRTNYHLRLKLLISKQDRVVVRKSARNVQIQLIAPTPEGDITYSSAVSSELAKYGYTGVTGNTTAAYLTGLLFGLKSLKKGYEGGILDIGLQASSAGSRVYAALKGIVDSGFEVPCSPEVFPSDERIRGEHIAEYREESSDLPEQFEATKEKIFAEFS

SEQ ID NO: 17012 - protein, 117 aa, Methanosarcina barkeri
MVVMKYIIAMIRPERLDAVKRELQKLEVNRLTVSSVAGYGAQKGHLEIYRATEHEANLLEKVKIEIAVEDHFLKSVIEAIKTGAKGKDGYIGSGKIFVLPLENVIRIRTNETGPEAL

SEQ ID NO: 17013 - protein, 125 aa, Methanosarcina barkeri
MKEITAIIRMNKAQRTKDVLLECGFPSFTVRRVMGRGKQRGLCHEFNPPLPDPEKEAETCIRFIPKRMFTIVVDDENVSEVVQKIIEINQTGNAGDGKIFVSDVTEAIRIRTGESGEATVNKELV

SEQ ID NO: 17014 - protein, 105 aa, Methanosarcina barkeri
MQMIRAIIRPGMETKVIECLEKEGCISLTKMEVFGRGKQKGIHIADINYDELQKTMLLMVVKDEHKDRAIKTIMESARTGKYGDGRIFVTPVEEAYTIRTGKPGL

SEQ ID NO: 17015 - protein, 249 aa, Methanosarcina barkeri
MNLNIRIKNYWEGEAQGYSEAIEDELNGFERKAWSDLVLEYAPSKDRLDILDIGTGPGFFPIVLSQGGHNVTGIDLTENMIEFARLNLAREGASAKLVTMDCQNLKFPDNCFDLLVCRNLTWTLDDPAKAYKEWHRVLKPGGRVLIFDACWYLHLFDENMKIAYEKKEKEILMKYGHPMHQHKDQVEGDALSRKLFMSDKVRPQWDLDIMLKLGFSKVFADTSVGERILNEQQQDRNSMHPPFLVGGEK

SEQ ID NO: 17016 - protein, 401 aa, Methanosarcina barkeri
MKVLEACQEFPNRYYPQLGTFIKQSIDSIANQGVDVTVISPKPFVLPFSALPYHNFFKLPRIEHTEKYDLHYPRYIYAVPKKYFYPITGFSYSHFIFEYAIKNIKPEPDLIHAHFSYPDGYGMMKLAKKWRVPLVISALGTIERKVAYEGSYTSKQIIEAMNFADKILSVSEDLKLHIVNLGINEEKVHVVPNGVDTVKFKPAGKAHARNLLNLPQDKNIVLFVGALRKIKGVDYLIEAAKDFASMNTTLFMVGRDDGLRKGLEKRAQELKIADYIRFIGPVNHENIPLWISASDILVLPSLSEGRPNVVLEALACEVPVVATDVGGIPELMVDGETGYLVPAKNPGELSRKINKLLENKSQRENMGKLGRKSIIQRGLTWEAHAKKTVGIYSELLEKASK

SEQ ID NO: 17017 - protein, 324 aa, Stellaria longipes
MENFPIINMENIERKNTRDMIKDACENWGFFECVNHGIPHSLLDKMEKMEKLTKDHVRECLEERFKEMVASKGLEGVESEVTDLDWESIFFLKHLPVSSISELPDLDEEYREVMIDFSKRKEKKAETKKDKKCENKGKEKSYLKNTFYGSKRPNFGTSVSNYPPLPKPDLIKGLSAHTDAGGIKLLSEDDKVSGLELLKDSDWIDVPPMRHSIVVNLGDELEVITNGKYWSVMHRVQIDTNITRMSTASFYVPGNDRVIAPAEALPKEFKDDEVYPKFVFKSYMKAYAKLIRQSGLKFEAKEPRFEAMKAHRIGSSCNSHLEHD

SEQ ID NO: 17018 - protein, 864 aa, Methanosarcina barkeri
MRDLLGGKGAGLAEMANLGIPVPPGFTITTEVCVLYLKGKKYSEEVLKQVEEAIDKLETLNNKKLGDPEDPLLVSVRSGARVSMPGMMDTVLNLGLTDKSVLGLANKVNDERFAYDCYRRFISMFGDVVLGIDFDKFESLIEDKKKELKVESDTDLDAKALKDLAERFKGVIKLEKGFEFPQDPKVQLQMAIDAVFDSWNNPRAITYRKLNEIDDSWGTAVNVQTMVYGNRGNTSGTGVAFTRNPSTGERKFFGEYLINAQGEDVVAGIRTPDFIDTLGNKIPEAYNQLVDICRKLEAHFKDMQDIEFTIQEGKLYMLQTRTGKRTAAAAVKLATDMVAEGLIDKETAVTRVKAEHIDLLLHPRIDPNAKLEVVAKGLPASPGAAVGKVVFTAEVAEEMAEKGEKTILVRTETSPEDIGGMAAAQGVITVRGGMTSHAAVVGRGMGKPCVVGCGDISIDTKSNLFMVNGYTVKEHDYVTIDGSTGSVIIGKVELIDAEINEDLKKILQWADEIRTLGVRTNADNPADAGLARELGAEGIGLCRTEHMFLGEERIPVVREMIMAEDEKSRRKALKKLLPMQKEDFLGIFRSMEGLPVTIRLLDPPLHEFLPDKEELDAKLRELEASGDSSGKINEVKKVIQRVVSLKEINPMLGHRGCRLGITYPEIYDMQVRAIMEAACELTNEGMKITPEIMIPLVGLVKELAITREEVCKMAEAVMAEKGVKIDYKVGTMIELPRAAIVADQIAQEADFFSFGTNDLTQTTFGFSRDDVSKFVPIYQKAGIIEHDPFAVLDQEGVGEIMKIGISKGRSVKPDLKMGICGEHGGEPRSIHFAYDIGLNYVSCSPYRVPIARLVAAQSTIESRK

SEQ ID NO: 17019 - protein, 256 aa, Methanosarcina barkeri
MAINETKRFLGKVVFITGGATGIGQATAVAFAREGANVALTYHKQGAEQTARMIEELDGQALVIKCDVSQDEDVKNAIEKTIQTFGRLDYAFNNAGIEGETVITAEYPVEEWNRVIATNLTGVFLCMKYEIPQMLKQGAGAIVNCSSGAGLTGFPGIPAYVASKHGVVGLTKTAALDYAKSNIRINAVCPGMTDTPMMERYSGGTPEGYKKIIEQEPIGRMGRPEEIAIAVLWLCSDAASFVTGDAMRVDGGQLAH

SEQ ID NO: 17020 - protein, 1046 aa, Methanosarcina barkeri
MNVSRKILAIIYIIFALLISVVIFASQSILGSTFSDLQEKEVTDNVEKVESMIELQILQLEKINSVLSSRDDVRNLMLNQDFQNLSSGTSLDDIFSISGCDFIFLVNNSGYIVYSDISDPEPSTNASALNASILNVSILNVSTLNASPLPKVRQRINDGSFLCKGAETSLKGLFMLKNDPAIISSQPVSAAPESKEISGTIILGKYLDSSFIESVQESTGSTFTLYSFNNASSDLLQAFFENPGPNFTYTVTGEHTTCYSVLEDLSGSPAIVIRADAGSNIYAEGQEALRYIVFFLLFAGLMIGASCKFLLDREVVSRIVAIDNFVEKVGMNENFSERYFMEGDDELSRLSKGINQTLDRLRTTSNEFKAQEHEKKLILDSLSELVVFMDSELKIIWLNKAALDHMGMKINDVIGRHYQDMYILYKENPGKSPVLKVLESGNEEFGEVVTQDGKIWTVTAIPIKNEDGRITGILKTGLDITAHRRSEEKLIQAKLEAEEANNSKSEFLANVSHELRTPLNSIIGFSDILIEKVFGELNEKQFRYVNNISTSGKHLLVLINDILDLSKVEAGKMELHYSEFSIDPVFEEVKAVLFPLIQAKPLEVTFNVEPDFTTLEADRGRLIQILYNLISNAIKFTPNGGKVSVYCKESGNRALISVIDTGIGISAEDQVKLFQPFTQLDASTSRQYCGTGLGLALVKKIVNLHQGDIWVESDPGKGSNFTFALPLRKPLERRKVSEIGIEDVTIEFEMNKAEALSVKENAENLQEEVKLPEICHSEKGDVKQELILVVDDDKSSSELHSTILKDAGYSVAILYSGKRVLEVAKNLKPDIITLDVFLPGTNGWLVLRQLKNDPYTTSIPVLIISMTNNNELGITLGATYSFAKPVNRIELVNSLREITGKFRFEYPKVLIVDDDENTVELLSSMIEPEGFETIKAYSGRECLQKLFFSEQQPDILILDLMMPEISGFDIISSMRADVHTKDIPLIVCTSGELTEKNLEELNSELERHLISILKKGTFGRKELINRIKQLAMLKRRNDEKNPDCRR

SEQ ID NO: 17021 - protein, 505 aa, Methanosarcina barkeri
MATLRGHEKVFSIAVTPNGKYAVSGSHDGTLKVWDLEKWREIRSLRAHSKSITAFAITSDGKLVVLGSLDGNLEVWNLETGEEKAAFKEHSEPITEIVITPDGKRAVSGSSDNTLKVWDLEKMEELTTLISHSNSVSKIAITPSGKYAISGSSDNTLKVWDLKKLDEETISTGHSKSVNKIVITPDGKLAVSSSYDGTLKVWDLKTKEEKVTLKGHSGPVTDFVITPDGKRIISGSSDKTLRVWDLKKGNMTLKGHKREVTSVAITSDGKYAISGSFDRTIKVWDLENGKIKVTLEGHKNYISTISIIPNKNCIVSSSHDETLKVWDLDRGIDTITLIGHSGSVSSVAITPDGKSIVSASGDGTHKIWSLENREEIATLEGHKSAPSTIVITPDGKYAVSASYDRTIKILDLKKQIVKTSLRGHTDSATLVAVTSNSRYVVSASRDNTLRVWDLESSSEVSCFTGDVPFTAFDILKDENIIVVGDSLGKVYFFHLHIPCKNNFYF

SEQ ID NO: 17022 - protein, 462 aa, Geobacter metallireducens
MSRLGVIIDLAICCHRHKEPAHPLQAKYSASRGTPTVTQTGTTAVTDADRIVELEHLLVELKAELAERKNIERDLKRAKVSAEAACHSKEDLLALVSHEIRSQIQMLTGAVELLRETPLDKKQTEYLNAFNHAGEFLLSLVNDLLDNSRLDAGRIHLDQIEFPFRELLERTAQLIAWQAGRKGLELEYHLSPDIPAQLVGDPKRLQQVILNLAGNAIKFTEQGKIIITVEPEASSLASQEMQLIFTIQDTGIGIPGDKLEEIFERYAQASPATFRTYGGTGLGLNIAKRLVGLMGGTIRVTSKEGKGTSFVFNARLGVTPPLLSSAVERRKSKSLPERSLRILLAEDAAEIRMLLGAFLGTTSHAVDMAHNGEEALKKFTSSNYDVIIMDIQMPVMDGLSATRKIREWERTHDRTPVPVVALTAGPERSDYLRAREAGCTTHLAKPIKKELLLNTISAVVLQ

SEQ ID NO: 17023 - protein, 1313 aa, Geobacter metallireducens
MNRRELMAGVLLGSAGFLVNWFKLSLFFNVDFLFGSVFSMFALLRFGPATGLLAAVIAAGCTWLQWHHPWAIVIFGCEALCAGWLRNRKRMDLMLGDIIYWFSGGLVLVWLFYHQVMGFNAGATLLVALKQGMNGIINTLIAEALFLLSWRLRGGTELPSLRKWLGVILEGVVLVPAFVFAFLDTSWYFRQQMTRLQESTARTAEVGNLTISSWLDEEQHKLGMLVKLVGDPDHNPSQEMQRLLERYHAAHGSDTYRLGVMDRNHVTRAFSPRVDEKGVSTIGVWLGDRPYIAELNDPSHPIVFDAFMGKIGVPGPRLIMLAPCMVGGEYRGAVFSVVSLGHPAALLKGIVGKRDVNLTLLDRHRRVVASTDSGKKFLEQFALPKGGQLHSVGSNVSQWVPDPQPGGGPMKRWNRSFYMTEIALEPKSGFRLVVQSSLAPSLKEINNRASILLGVLAILTLVVVGLSRYFSRRLLAPFAMLGKVTSQLPVRIAQGEQISWRPAEVREEQELQDNFRLMENALQNSFSELTAINEELEHRVTERTAELRIAKEAAENSELQLRSITNSAHDAILMMDHQGSISYWNPAAEQILGYSAAEALGKNLHDLLTPERYLADHLTAFSEFQQTGSGNAVGKTLELFARRKDGQEIEVALSLSAVFLNGAWNAVGLLRDITEQKRINASLRMLSAAVEHSPVSIIITDRDGRIEYVNPKSCQMTGYAFEELRGQNPRIMKGPTHPPEFYKNLWETILSGREWYGEFHNRRKDGSLVWVMASISPIYDEKGEITHFVGVREEIEKQKKLQEELANIAQLEKVARDRAEQANRAKSEFLAGMSHEIRTPLNAIIGMSDLLAETRLDGEQSGYLSVVHSAGETLQGLINDILDLSKIEAGMLQLDSVPFSLRDCIRQLTDITSVKASSKGVTYSFSVKSAVPDWLMGDSLRLRQVLINLVGNAVKFTDSGGSVLLEVEPVQQSDAEVLIRFSVADTGIGIAPEKLDTIFESFSQADSSTTRRYGGTGLGLAISRHLAGMMGGEIGVESTVGKGSCFRFTVPFAISRRTEEPLPKEQLPGDKLGRPLSILVVDDNLANRTVLTAYFRRTEHTVECAVNGEEALAKIKGGGYDVVFMDMEMPVMDGYTAVRLVREWERETGRAPLPVIALTANALKEDQLRSLDAGCTAHLTKPIKKDKLLEIVGEYQQRPRTNGKQGTNMDRDNVPDKIVVVCDPDLEDIIPAYLEGRKTEGSVIRELAVNGQFDEVRTIAHGLKGSGGCYGFSRITEIGRDMELAANDGNLVEVLKQLDTLEAYLQAIEVRYE

SEQ ID NO: 17024 - protein, 250 aa, Geobacter metallireducens
MHGASMEFAGNTIVVTGGTRGIGRAIALRFAREGARVFAAYLRNENAAREVAAEAAGLSGEIVTLQADVSTQEGAQGLIETAAASGTIDILINNAGIIRDGYLAMMADDDWDAVIRGNLYPLFHCCKWGIRKMMANRRGAIVNVSSISGIAGTAGQTNYAASKGGIISFTKALARETGPMGIRVNAVVPGLIETEMIAGMKRDMVDRIVAGAALGRLGTTCEVADAVAFLASDRATYITGQSLVVDGGIL

SEQ ID NO: 17025 - protein, 326 aa, Geobacter metallireducens
MDDFLEKEAVEPEEHAERQPDDFLEPEPTSFEYEEAEEEEEQEEEIKVVEVEHFDDAIKLYLREIQRTTLLTADEEKVLASRIAKGDKAARDKMIESNLRLVVKIAKRYINRGLPFLDLIEEGNMGLIKAVERFKLSKECRFSTYATWWIRQSIERALVNQSRTIRLPVHVSDDINKMLKITRELVNRFNREPTVKEVATEMNVNSAYIRRLMVLLKKTYSIERPMGENSDYFLIDTIEDTSSVSPAVLLEDLNKYEIVSKWFASLSENEQKILTLRFGLEDKEPQTLDTIGRSFGVTRERIRQIEAKSLEKLRKYIDNSDGSAIE

SEQ ID NO: 17026 - protein, 80 aa, Geobacter metallireducens
MKGFGRQKGHTELYRGAEYVVDFIPKIKMEIIVGDDIVGKVVETIEQAAKTGRIGDGKIFVTPVEEVIRIRTGERGEDAL

SEQ ID NO: 17027 - protein, 517 aa, Geobacter metallireducens
MNINRRDFLKLAGAGGLALALPGCAGNLPLPKEVFPDFGDSGRPWLGLATSLREEHDYEARIEGTIPSALRGTLYRNGPALFDRGGLRKRTLLDGDGMVQSFTVGDGGVRYRNRYVRTEKFVAEEAAGRFLYPTWSTQKPGGFWGNFWQAGSVPNQAGITVFWWRGKLYAFDEGNIPYELDPESLATAGPSNLGLTPGTAFYSAHPKLDPHTGEWLHFGVKYGPRPLLHLSAFAADGSLKRHRTFPLPRYVYMHDWIVSGRYLILSLHPVEIEFWGFLLGFRSLFASLRWRPEWGNLLMIVEREGEGKPRLVETEACYMWHSFNAYEEGGETVADFIGYRNPDHFVGDDPVISAVMEGRRGHYDFPGEIMRYRIDPVRCTVRRETLNPGSCEWPRIDERLRCRRHRIGYAVKCLPGEFFWSIVMRVDFLSGTTAEYSFGRGKYCTEAVFVPKPGTSADASQSAGEGWLLTEVYDSHTRKSFLAILDAGRVADGPLAIAHLTHHVPFSYHGWWHPSPV

SEQ ID NO: 17028 - protein, 827 aa, Geobacter metallireducens
MVLQKQASSIKARLLRINLLLLGVTSLVIVLVVNVAQKRLALNDAGRDAERILVRYLAIHAYINKELKPRLLDFTASLRDKDYFDPVWMSSTYAVREIDKIFQSRHGKGYYYKECAINARSPRNEADPFEREFLERASHNPAVTTFNGVREIDGKLFFVAMARGEAMEKSCLLCHSNPETAPGGLVRTYGPNRSFSRHENELVSAISIRIPLSEAYAEANSFSLRLSALLLAVIASFFAIKNWFFGRVVLSPLASVTESARRIAHDRRYLGEQIPLGRDREMNELAASFNVMSTELHAFINNLEEKVEEKTAELVQAREEAEEANRVKGEFLATMSHEIRTPMNAIIGINQLLQETHLSQQQRRLVDDSSNAAESLLTIINDILDFSRVEARRLELSDEALELRSFVESLRRLFAVKAERENISLSILVGDEAPQFICGDPARLRQVLTNLLSNAIKFTPTGGRVTLAADADPAGGNLLFTVSDTGIGIEKDKHERIFEMFRQADSSTTRNYGGTGLGLAITRGLVELMGGTIEVESEAGKGAVFRVLLPLRPATGPPADKTAGEELSDSVLPSLSVLVVEDNELNRTVAIGLLTALKQRVAAVANGREAVDALRDGTYDLVLMDISMPEMDGIEATRAIRRGDAGEKARAIPIVALTAHALKDDRDRFLAAGMSDYLSKPLIRGELQRMLLRIAGERGELPPEERCPMRDAPDEGSPFDLEFQQSQFHDAGIGDCLAEVLSIFAQSTATECERMEEYLATGKYAELAAAAHSVKGAAATIGAPHVSRYAADVETAARKSDGVAVARTIPLLRREVRRVEAAVGEMS

SEQ ID NO: 17029 - protein, 429 aa, Geobacter metallireducens
MSEITDVYAREILDSRGNPTLEVEVFLESGVMGRAAVPSGASTGEREALELRDGDKSRYLGKGVLKAVDNVNNIIAEQIIGMEATDQIGIDQRMLDLDGTEYKSNLGANAILGVSLAVAKAAAEEVGLPLYQYIGGSNAKELPLPMMNILNGGAHADNNVDIQEFMIMPAGAKSFAEALRMGAEIFHALKGVLKGKGYNTAVGDEGGFAPNLKSNEEALEVIMDAIQKAGYKPGEEVLLALDVASSELFNDGVYTLENEAEPKKTPAQMVDFYENLVNKYPIVSIEDGMAENDWDGWKLLTDRLGKRIQIVGDDLFVTNPRILKEGIQKGIANSILIKLNQIGSLTETLDAIEMAKRAGYTCVISHRSGETEDTTLADLSVAVNAGQIKTGSLCRTDRVAKYNQLLRIEDELDTTALFRGKDVFYNIRK

SEQ ID NO: 17030 - protein, 491 aa, Geobacter metallireducens
MLDETIQEGLTFDDVLLVPAHSQVLPRDVSLNTRLTRNIHLNIPLVSAAMDTVTEARTAICMAREGGIGIIHKNLTIEEQAMEVDKVKKSESGMIVDPITMRPNQKIHEALAIMEKYRISGVPVTNAKGKLVGILTNRDLRFETDLNLPISARMTKKRLVTVAVGTTLEEAKEHLKQTRVEKLLVVDDDKNLKGLITIKDIEKVRKYPNACKDGLGRLRVGAAVGPTADMLVRADALVKAGVDVIAIDTAHGHSQGVLDAIRSLKSAFPGVELIAGNIATAEAAEALIKAGVDAIKVGIGPGSICTTRVVAGVGVPQISAIAQCAKVARKYDIPLIADGGVKYSGDVTKAVAAGADVIMIGSLFAGTEESPGDTILYQGRAYKSYRGMGSIGAMKEGSKDRYFQSDVESEVKLVPEGIEGMVPLRGPLGANVHQLMGGLRAGMGYTGCHTVSELQQKGRFIRITGAGLKESHVHDVMITKEAPNYRVENVR

SEQ ID NO: 17031 - protein, 480 aa, Geobacter metallireducens
MKEYRLFINGEWVPSSTGTMADDINPATGDVYAKVHQASRDDIEQAIASAYRARVDWGKTVPAQREAILIKAAAILEERIPEFAEVLIEEGGATFGKAMFESSFVVTLLRSAAGECRRIFGETIPSDAPGLFSMSVRRPLGVIAGISPFNFPFLLAMKKVALALAAGNTFVLKPASPTPVIGLKIAELFEAAGLPKGVLNVIPVKGSTLGNTLVEDPRIRMVTFTGSTDVGKQLAEVAGRHQKKITLEMGGKSPLIVLKDADIDYAVDAAVFGIFLHQGQVCMANSRLIVEADIYDRFCEKLTAKVKGLKMGDPHKPDTVIGPLIDAKQCAFIDSQVHDALADGARVLSGGRSEGAFYQPTIVADVTRKMRIFDEESFGPVVCVIKAANSEEALALANDSSFGLSAGLITNDLQKAFDLSLRLESGMVHINDSSIFDEPHVPFGGVKDSGVGREGGHYSMEEMTEVKWITVQMGKRQFPF

SEQ ID NO: 17032 - protein, 247 aa, Geobacter metallireducens
MDLKGKNAIVTGASLGIGSAIALDLAKSGANVAINYRKHSEEANAICAEIQKMGQKAIAVQADVASFKDAQAMVDKVAAEFGSVDILVNNAGVNRDAVIWKMTEEQWDECLAINLKGYFNYCRAVAPLMKEQGSGKIVNVTSINGMRGKFGQTNYSAAKAGIIGLTKALARELAKSNVNCNAIAPGLIETEMMAALPEDVKQKSLADIVLGRMGKPEEVAWLVTFLCSEKSRHITGECIKVDGGQYI

SEQ ID NO: 17033 - protein, 225 aa, Geobacter metallireducens
MFARLHEDIQSVKERDPAARSSVEVFFCYPGLHAIWFHRFAHWFWMREFFFLGRFLSHIGRFFTGIEIHPGATIGRRLFIDHGMGVVIGETAEIGDDVTIYHGVTLGGVSLEKKKRHPTVDNNAVIGSGAKVLGPFTVGVGAKIGSNSVVVKEVPANATVVGIPGRVVMAADEPAKKADFEHGKLPDPEAKAISCLFDQLRELERKYADLADEHAALRRRVESGK

SEQ ID NO: 17034 - protein, 509 aa, Geobacter metallireducens
MELPLCDFPFTLQLDLQKTTKESSEMMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 17035 - protein, 1011 aa, Geobacter metallireducens
MALTKEHSMHSSELNARIVSRGKEFFTSIAGEKPSLFDKGAWMGKAMDWSMRNDQFKVQLFRFVDVFPSLTTSRLLTEHIREYFGDEEAMPPFMATGAKVAGMLGSFGGAVLNRVLTSNVEDMARQFIVGETTKEAVKNLEKLRKDGFAAVVDVLGEATLSEEEAEAYTNTYLELLETLKKEQGTWKGLPGTGGDPDLDWGHAPRVNIAVKPTALYCLANPQDFEGSVVAILNRMRRIFRKVMALNGFLCIDMESYRFKDMTLEVFRRLRLEHPGYPHLGIALQAYQKDTDRDLDGLLAWAKEQGVPISIRLVKGAYWDYETVRARQNGWEVPVWTIKAETDAAFERQSRKILENHAVCHFACGSHNIRTISAVMELARELNVPPDRYEFQVLYGMAEPVRKGILRVAGRIRLYCPYGSMVPGMGYLVRRLLENTANESFLRKSFAEEARIEQLLEDPAVAAEREREARAARPEKERTGPDGLPPFGNEPMVDFTRPDHRAAFPDALARVRTQRGKTYPLFINGKEVLTAELMPTVNPNNPSEVLGQICQAGTKEAGDAVAAAKAAFPAWRDTDPRTRADYLLKAALIARTRIFDLSAWQILEIGKQWDQAYADVTEAIDFLEYYAREMMRLGEPQRLGHAPGELNHYCYEPRGVAAVIAPWNFPLAISTGMAAAAIVTGNCVVYKPSGLTPIVGWHLAELFREARLPDGVFNYVPGRSSVMGDYLVDHPDVSLIAFTGSLETGLRINERAARVQPGQANVKRVICEMGGKNAIIIDDDADLDEAVPQVLSSAFGFQGQKCSACSRVIVLDAIHDRFVARLVAMARAISVGPPEDPAHSMGAVADDNAMKRIREYIEIGKTEGQLLHEGPVPAGTGYYVPMTIIGGIRPEHCIAREEIFGPVLAVMRAKDFDEAIQWANAPRFALTGGVFSRSPEHLAKARREFRVGNLYLNRGITGALVERQPFGGSRMSGGGTKAGGPDYLLHFMDPRTVTENTMRRGFAPSDEESGRL

SEQ ID NO: 17036 - protein, 171 aa, Geobacter metallireducens
MVRRKAEGVRDDSYWMGKALREAEKAAARDEVPIGAVVVRNGAVIGRGHNLRENKQDPSAHAEMIAIRQAARRLGCWRLTGCVLYVTLEPCLMCMGAIILARFDRVVFGCHDPKGGAAGSLYDLSDDRRLNHRVELTSRVREEECSAILSGFFADLRTRKKKARRAPSAGI

SEQ ID NO: 17037 - protein, 508 aa, Geobacter metallireducens
MNNLKILIVDDEADIALILKLQLEDAGYRTTRARDGLEALEMLAREHYDLILLDIRMPRLDGIEVLERIRQEWPELVVVMMTAHGSEDIAVEAMKKGAVDYISKPFSSDDMKKRVERAIEYNRTRLENERLQREVEEERRKMEAILQGMAEALVAVDRQGLVMSINRTAAELFGVDAAAVHARPVEELLSAAIPADRLPCRVVLATGEPCLDVAYDLRLPGRIVPVLSSAAPLANAAGEMIGSVEIIRDISALKALEQEREDFVSMLSHDLKTPITAIIGSIDLVKEGRLGPVNPEQSMYLDAAVESCAEMVDMIDTLLDVHRFEAGRMVTTLVEEELGPLLQRTVGRFEPVARHSGLELTLSLPGAPVTFLVDRKQFGRLLGNLLSNALKFTTEGGIEVRAELPENAAAAAQGITPGAYPTERLPREGRYLLVSVSDTGAGIPADSLVTIFDRFVQARNRKMGKSSGTGLGLAFCRKVMDAHHGFIWAESEPDRGSTFRMLFPLGTD

SEQ ID NO: 17038 - protein, 434 aa, Geobacter metallireducens
MNFLERLNSEVLVGDGAIGTMLYAKGVSLDANVEHLNLVRPELVLELHREYLGAGAKVIETNTFGANWTKLSAIGLDKREREIILRGARLAREAAEGTDAFVAGSMGPLARVKGDERELSPAETTEIFRRQALALAEGGVDLLILETFTDLAQILCALSAARETGLPVVANMAFLENGRLAGGADVERAARELTAAGASVVGANCGAGPLEVLGTIRRMAGATALPIAAYPNSGFPEYVNGRHVYRTTPDYFAERAAEMVAAGAALVGGCCGTTPEHILRLAERLAGLRPAVRNVAVPAVSVEERRGESTEAEGFLARWGEEPVVTVELDPPKGFDCGKVIEGSRVLKGAGADAINIAENPWPASGWGISPWGISSSKRWGSRSSSTSPAGTATSWGSSRTSWGRASWASGASSPSPGTRPGSGSRPGPRRSTT

SEQ ID NO: 17039 - protein, 804 aa, Geobacter metallireducens
MKTPFLQAIKERVLVLDGAMGTMLQERGLRPGQSPEELNLTMPDVVAGVHREYLEAGADIIVTNTFGGTRPKLEHYGLEEKVREINARAVEIAREVCGDRAYVAASMGPTGLFVEPVGEATFDAMAAFFREQAAALIEAGADLITLETFLDIKEIRAAVIAIREVSPTIPVIAQLTFDNEGRTVLGTPPEAAAVTLAAAGADIVGSNCGLGPDGICAVLGAMRGVTRLPLISQANAGLPKLVDGKTVFPGTPDDMTAFHDRMLGLNVRVIGGCCGTTPTHIRAIKEALAGRDQSWRDCGPPAGVTFLASRTSVVALGGGLPAAIIGERINPTGKKAFAQELREGKITTIRREAMEQTAAGAHLLDVNVGTPGIDEPAAMERAVFCVTGSVAVPLVLDSSDPAALERGLKAADGKVLVNSVNGETKSIERVLPLVKKYGAAVIGLALDETGIPETAEGRLAVAERIVAAAEGRGISRNDVVIDCLTLTVSAEQKRAMETLRAVRLVKEIIGCPTVLGVSNISFGLPRRPLISSAFFAMALAAGLDAAIVNPKEEEMMAAWRSAMVLLNRDPSAAAYIAAYAGTAAAAPEPAASGEALDIRERLKRAVITGDRENIVALVEEALGQGLEPLQVSNEGLLPGLEEVGRRFEKNLVFLPQVMQSADTMQAAFGRLREVMKGSPAASRGKILMATVEGDIHDIGKNIVCTLLENHGFEVIDLGKNVPADRIVGKARELGVDAVGLSALMTTTMTEMENVIARLKEAGIRTFTMVGGAVVTQEYADEIGADLYARDAMEAVARIKALLEK

SEQ ID NO: 17040 - protein, 329 aa, Geobacter metallireducens
MNCAHTQLNRKDINYMSTMIATRDAYGQTLAELGEENSSIVVLDADLSGSTKTSTFAKKFPERFFNMGIAEANMVGTAAGLAAAGKIPFVSTFAIFAVGRAWEQVRQSAAYPKANVKIVATHGGITVGEDGGSHQSVEDIAIMRAVPNMTVIVPADGPETAKAIRAAAAYKGPVYVRLGRNKVPTVTAADAPFEIGKGVQLADGTDLTFVTTGLMTAQALAAAETLKGEGISARVVHLATVKPLDGDILLKAARETGAIVTAEEHSIVGGLGGAVAEFLAENSPVPLKRVGINDRFGTSGKAEELLKYFGLMPIDLVEAARGVVARKGK

SEQ ID NO: 17041 - protein, 899 aa, Geobacter metallireducens
MSPSQPQRRSAMAEKYVYFFGNGKAEGKADMKNLLGGKGANLAEMTAIGLPVPPGFTITTEVCTYYYANNKSYPSVLAAQVAENLKSVEAIMGRTFGDPKNPLLVSVRSGARASMPGMMDTILNLGLNDETVQGIIVQSGDERFAYDAYRRFVQMYSDVVMGMDKEALEHLLEEKKAAKGVHLDTDLTAADWKELVGAFKAKIRETLGTAFPENPQEQLWGAVGAVFGSWMNQRAITYRRLNGIPADWGTAVNVQSMVYGNMGNDCATGVAFTRDPSTGENYFYGEYLVNAQGEDVVAGIRTPQPINRANSKDATLPSMEEVLPECYQQLVQIRGILEKHYRDMQDIEFTIEKGKLFMLQTRNGKRTAKAAIKVAVDMVKEGLIDEKTAVLRVSPSQLDQLLHPSLDPKAPRTIIAKGLPASPGAASGEVVFTADEAEAAGRLGLKVILVRIETSPEDIHGMHAAQGILTARGGMTSHAAVVARGMGKCCVAGCGDIKVDYAAGQFVTAKGQVVKRGDTITLDGSTGEVMLGEVPTVAPQLTGDFGVLMGWVDTYRKLKVRTNADTPNDSRVAREFGAEGIGLCRTEHMFFEADRIAAVREMILSEDVEGRTKALAKILPMQKGDFLGIFREMKDLPVTIRLLDPPLHEFLPQEEKDVDALAKTMGVTAQTLKNKVDYLHEFNPMLGHRGCRLGLTFPEIYDMQVQAIMEAACELTKNEGFTIVPEIMIPLVGVVSELARLRENTVRVCEEVIARYGVKIDYLIGTMIELPRAALTADEIAREADFFSFGTNDLTQTTFGLSRDDAGKFLPFYVESGLLEEDPFVSLDQNGVGILVKMAVEKGRTTRAGIKLGICGEHGGDPSSVIFCHKIGLDYVSCSPFRVPIARLAAAHAALGEGN

SEQ ID NO: 17042 - protein, 278 aa, Geobacter metallireducens
MSDVTDAQAIADHWGRGDVFGLIVAALNQMAKPLDGLTVEELAPVDHFHSRGFPATVEFADRLPINAGEQILDIGCGLGGPARYMAKRFQCRVSGIDITGPFVEAANRLTALLHMEQQVEIAQGNGQRLPYPDSCFDGAYTQDVTMNVAERAGFFAEAYRVLKPGAFFALSEHGLGPQGKPHYPVPWSDDGTGAYLTAPAETRAILERTGFEAITVEDTGAKCVAGYGKVIERAEKGALPPLGLHLFMGESMVEKMRNAARNIEEGRTHPIQLICRKP

SEQ ID NO: 17043 - protein, 807 aa, Geobacter metallireducens
MGNDMRNDVKSLRAGIFSEIIIVFLPLTMLLIYQTVSDITVSDRLADTHRLLAASSSAYQRYRLFVNGVVDAIDTGRVSEDAVHNLEHTTVELKSITTGDRSSDFSSLAARTNALLAHLRKDRSFGKVLPLRDTINGIDADLSALAAQCDETNRQMILENINSTQSRKIMVFTALALGALVTLALIVMLIRHVTRFELVLRESEERMRVMFESINAGIVLIDCDNNSIVDVNPTALRLHGGTKEELIGYPSERLFHGDNVRTDPEHDEGKAIDISKGMLSLCNGERLPVLESVNYVAINGRRYMLKSFVDLSKQMTLETELLAAKEAAEAASRAKSIFLASMSHEIRTPMNAIIGYAQLLKREGNLAPQQGQYLNVINNSGEHLLKLINDILEMSKIESGTVNLTPVPFNFHNLLHDVESLFADRARQKKLRFDVRLQGEVPVVLDADEMKVRQVLINMIGNALKFTDEGTIAVTVSSSTDSPDKERDTYGETAITVDVEDSGIGISAEEADQVFALFEQTESGRRRIGGTGLGMPISRQFARLMGGDLFLVRGEPGIGSAFRFVFRAKALDLAEFKQPAVDERFFWRIIPDEKEWRVLVVDDQENNRSLLSHMLTRAGFAVREADGGIDGVAQFRAWLPDIVLMDILMPDMDGYEALRQIKATSEGGVTPVIAVTASVMMDEHQKALDLGFDGFIMKPVSMECLFEEIRRLTNVAYLYDDSRSSGDAAAEILPPWVDRLTTLPDVLLGAMRDALEAGDIASLRGLIEQIGESEPIPAEALRRLVDSYSYDELTTLLAGGDARYASA

SEQ ID NO: 17044 - protein, 462 aa, Geobacter metallireducens
MTGTILIVDDERAQREIIQTILEGEGYRVAAAPGGREALEQLETSEFDVILTDLKMQGMSGMELLERVLEADPLQCAIMMTAHGTVDSAVEAMKKGAFDYLEKPLERDNLLLTLRRAFERVNLLRENRVLQKRLKETSSIPNIIGEHPKMREVFRIVTKIAPTASTVLIYGESGTGKELVAKAIHDGSPRKDKPFFAINCAAIPESLMESELFGHEKGAFTGASSRELGIFEAATGGTVFLDEIGEMSVAMQAKLLRAIQSKEIRRVGGKVNIPVDVRIISATNRDLEAEIKRGGFREDLFYRLNVIRITLPPLRERGSDIAALADFFVKKCSAQAGVTVRGIAKPALKLIMDYSWPGNVRQLESVIERGALMAESDLIQPEDLPAEITEGLSRAGWLPFELPPDGIQFDELERNLIIKAMERADWVIAKAAPLLGMSYKTLQYRLEKFEIGRDRGTGNGDQ

SEQ ID NO: 17045 - protein, 112 aa, Geobacter metallireducens
MKLIEAIIKPFKLDEVKDALTEIGVEGITVSEVKGFGRQKGHTELYRGAEYVVDFIPKVKIEIAVADEVVAKVVETIENTAKTGRIGDGKIFILPLDEAVRIRTGEKGAEAI

SEQ ID NO: 17046 - protein, 324 aa, Geobacter metallireducens
  unsure (1)..(324): unsure at all Xaa locations
MAGGREELMILTEQNGKTCLRNICFEELAARYGTPFYLYDLDKVKEKCAAVRKAFGDSLELLYAVKANPNRELLAAMRGEVDGLDIASAGELERALETGYDAGCISFAGPGKTRDELRRSLEAGVGCISVESLRELNDLRDLVRAGSHRAYILVRVNPQLLIRDFAVKMGGKASQFGIDEEELPSALDFIKANADAFDFKGIHIYAGTQCLNEEALAQNLANTLAIAARITTDYGMECRVINIGGGLGVSYYEEHPGLDLDKLALLFXXXXXXXXXXXXXXXXXXFQGRVRPVPRGHGDKTPHPPGAGTVPGCRGRNLRNSGGE

SEQ ID NO: 17047 - protein, 664 aa, Geobacter metallireducens
MDIVGFRRDYIQALIMRSQSLGSSLRANLEKVVGLGIDVKDIEGLNDKCREVVASSPEVAYCIITDSEGNILHLNDPVYRNIRFDIIRRAFTTRLDQNIHLIGDDGSYYDTVTPVRSPDGKQVALIHIGFSVHVVSAKVQVIIIRSLLLLAVVFLVSFSLVVIFVKRNIGQPIAALLAGVRKVSEGEFNHRINQLPVYEFNELASSVNLMSDTLKNREEEIRSNYQELENIHNDLHSSYLKLESLSLDLEKSEELYKSLLEDASDAIVVTDENDMVKMVNKMAEDFFGHDAAELVGLSLSRMLTLVGTQNSSIVYNFFQVAGTGKHVAEEIKFLRKDKELVVGLIHANIVTIGAERLIQAIIRDVTREREILLNLEKSAADLARLNKMKDSFLGIASHELKTPLTVIMGYAELILTDPPCQVDPNIIDMVNNIAGAANRLDNIVKDMVDVSMIDEKRLQLKLSEVDVNRLVEDSLNELRFFVSMRKQQLVFELDDAIPAIKGDTVRLMQLLSNVIGNAIKFTPDGGRIMVSTRAKYILRSKQIPTVDPVQSLVNIGKDQHLYVEITVADTGIGIDIDDQLRIFDKFYEAGNIEEHSSGKVAFKSRGAGLGLSISKGIVEMHGGEIWVESPGYNPDQFPGSTFHIVLPLNPITGDGTIDYLNLLK

SEQ ID NO: 17048 - protein, 625 aa, Geobacter metallireducens
MTAILDTIESPCDLKGVTQRELAQLAAELREKIITVCARNGGHLAPSLGVVELTLALHRVFDSPADKIIWDVGHQAYAHKLLTGRRDRFATLRTLGGISGFPKRCESSHDAFDTGHTSTSISAALGFAVARDLRGERNKVVAVIGDGSMTGGLAYEGLNNAGHLNKDLVVVLNDNEMSIAENVGALSNFLNRTVTSEFVHTMKKDLEGFLGGLDRIGHGVLKVAKRAEESLKGLFTPGMLFEAFGFEYIGPIDGHDTARLMETFEKVKRFDDAVLIHVLTKKGRGYPPAEEKPALFHGVGPFELETGKVIKGKGGAASYTGVFGEAIRKIAAEDERVIALTAAMPDGTGLTPFAADYPTRFFDVGIAEQHGVTFAAGLAAEGYRPVFAVYSSFLQRAYDQVFHDVCLQNLPVTFAIDRAGVVGSDGPTHHGLFDLAYLRHLPNMVVMAPKDENELQHLLLTAIEHDGPAAVRYPRGNGYGVSLDQTCSVLPIGKGEILREGLDGALLAIGSTVYPAREAAEALAAEGIDLAVVNARFVKPLDRDLILSLARTTGRLIIVEENVIQGGFGTAVLELLEEEGINGVKVLRLGYPDRYVEQGEQHELRAQYGLDAPGITARVRTFMKG

SEQ ID NO: 17049 - protein, 314 aa, Geobacter metallireducens
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 17050 - protein, 613 aa, Geobacter metallireducens
MMRILLFTIQSFWLDLVRTVSYRMSVFWQQLMSGVHGMMTKSGMACRSCFLVLLIALLTFSNLAIPTAGAEARVVTVGVYENSPKIFTDDSGKPSGIFIDIIEHIAKTEGWNLHYVHGTWVEGLDRLAKGEIDLMPDVAYTAERENLYSFHRIPVLTGWSQVYARKGSGIQSILNLNGKRVAALEQTIQFETFRRLASSFGLKITLIPVPDYKTEFDMLANGKIDAAVTNRFYGLRHARESGLEDTPIMFDPAPFFFAAPRDASRHLLDAIDRHLAELKKDPRSAYYASLNRWTSEDVQFKLPVWLQVSGLILGVVVIMTVTGFILWNRTLRRTVKLRTAQLEQELAERKMAEEELRKYRENLEDLVRERTAELAVAKERAEAADQLKSAFLATMSHELRTPLNSIIGFTGILLQGLGGPINDEQAKQLTMVRHSANHLLSLISDVLDISKIEAGQLKISPEPFQLRESVQKVTQSVAGLVDKKGLRLILEIADDVGSIVSDQRRVEQVLLNLLSNAVKFTEQGTISVRCSRESEWYVTSVADSGIGIKEEDLERLFKPFHQVDTGLSRKYEGTGLGLSICKRLVELMGGSITVESRQGEGSTFCFLLPANGG

SEQ ID NO: 17051 - protein, 589 aa, Geobacter metallireducens
MRFTIQWKLMASYLLLVLFIGGVFFAYLNHTLNQHLTAEIRQNLATEARLTRMIAHRDIGRMKDDAPAVAAAISRETRARVTIILAGGEVVGDSEIAPGQLKELENHLNRPEVQQALKSGSGESIRYSATIKTPMLYVAVPLQTAGGEEGFVRLSLPLTALEKAEGSIRTLLGASLAVSLLVALVLSYILSRVTSRSLRTITALAKQIGKGNFNRRIPVPTRDEVGELARVMNDMAARIEQQLERTSAEKNRLDTILRGMGEGLMVTDANGLITLVNPAFLGLFSLNESVEGRHIIEIARHPVLNDAFKAIVASGDERVEKMTLTMGEEKHVLTHWVPLVDNGELQGVVAVFHDITDLTRLENIRRDFVANVSHELRTPVTVIKGYAEALIDGAMETDPERARKFVGIILSHSERLAALIGDLLTLSQLEAGSMNLEKTTVRPEQVAKRAMELLQPKAARKGITIDCSGLSGAQSVLADPGRLEQVLVNLLDNAIKYTPEGGAISFSAAVKENMVRIGVKDTGVGIPPKDLPRIFERFYRVDTARSRDEGGTGLGLSIVKHIVQLHGGAVGVESEPGKGSEFWFTIKKA

SEQ ID NO: 17052 - protein, 403 aa, Geobacter metallireducens
MLNGKQIVLGVTGGIAVYKAVELVRLLTKAGADVHVIMTRSATEFVGPLTFQTLTANPVHTEIFNLIAEREIGHIALADRADLFIIAPATANVIGKIAGGIADDMLTTTVMATRASVLIAPAMNVNMCTNPIYRENEEKLRRHGYRFVAPVKGMLACGWEGEGKLQDPAIIMEEAVCALTRQDLVGERVLVTAGPTLEEIDPVRFISNHSSGKMGYSIARAARRRGAEVVLVAGPTCLDDPWGIETVHVCSAAEMRDAVMERVAASTVIVKAAAVADYCPKSRAAGKIKKSADAMVLELEKNPDILAEVGRVKGDRVLVGFAAETSDLVENARKKLTGKNLDLVVANDIGQPGAGFNVDTNIAKLLHRDGRVEELPLMGKDEMATIILDRAAGLRKQGMRGEE

SEQ ID NO: 17053 - protein, 1216 aa, Geobacter metallireducens
MGWYADLKIRNKLLLGYGTVIAFSSLIGYFGVTGLTEMKSHLDAMHDHLIPGIETAAMIDRHHQQHRRTFLNYLEENRLHRKELELKLHHEAIDIQESLKRYAKLSIYPAERRLLDDVITASKEYMDETARLKSAADSGADYETLTVDNAHLRTLFGDVENRAKLLTQYSLKEGDEHLDQSTAGYFNIRSWLISLLLGAIAIALAMAFFITRSVADPIRVVLDAVRRMEESGTEKARLAEAIAAGDLTQDVAVSERLRIDPETVARDEGGMMLRAVAGMSGIQASLDAAFSRMTDSLRRNRQEEQARDWLKSGANELGAILRGDRRLEEMVEKSLSFLCEYLGAGVGVLYLYNDRTRDLEIAATYALARREDMKKRFALGEGLVGEAAKERRIIRLADVPPGYLPISSAIGEAKPLNIAAVPLLHDNLLVGVVEIGSFREFTARELEFLSRAQEGLSIGINVNRSRKLVDELLEQTQAQTEELRVQQEELQQTNEELEERAQMLEQQREQIRAKNREVEETSRALKLKADELERISTYKSEFLANMSHELRTPLNSLLILSSLLKENREHNLTDKQVEYAATINSSGNDLLTLINDILDLSKIESGRLEFNYEQIPLRALFDQLRTMFSPLAEQKGLDFDAIIEEGVPEEITTDGQRTQQILKNLVSNACKFTREGRVAVRAHLPNSEENPLPAPAIAIQVSDTGIGISPDKHDLVFQAFQQADGTTSRKFGGTGLGLSISRQLARGLHGDVLLESEEGKGSSFTLYLPLDHAAHGEESQTAVPPPAPRLPPVTVPRGKEVSGREADVQLPTPVLADDREKLRPGERSILIIEDDLSFAAILMDMVRDRGFPAMVAGDGESGIALADHYLPSAIVLDVMLPHIDGWGVMKCLKDSLRTRHIPVHFLTCLEDRQKALTMGAIGFVTKPVNSAQLDEVFSTIEHSLAKSVRKLLIVEDDRNEAKSMEALLGVRDVAITVTATGSEAMGLLAVEPFDCIVLDLGLSDMSGFEVLEKIQSLDESRRIPVIIHSGRDLSREDEQRLRNYAESIIIKGAKSPERLLNEVSLFLHLVESGMGPEKKRMIRAALDDEALLEGKKVLIVDDDMRNIFSLSSVLAEKKMIVLEAENGREALERLNGEPGIDVVLMDIMMPEMDGFAATRAIRKDPRFARLPIIALTAKAMKGDRDECLKAGASDYIQKPVDADKLLSLLRVWLYGS

SEQ ID NO: 17054 - protein, 914 aa, Geobacter metallireducens
  unsure (1)..(914): unsure at all Xaa locations
MPEPGTTPTFDAFHRSAEGLLRAMNLETWRIRNWRLFTKIFLMSTVAVFVIIAGLLGFFLPLLESKLIHERTDNASHIVDAARSIAAHYHSLQLRGELSEPEARRLAVNTLRALRYNVNGYVWVHDLENRMVMHPLQPELEGHYLTRLADARGKPLFLTMNNLVRREGKGEVDYLWPRPGEQEPSRKVSYVSLFEPWQWVLGSGVYLDDVQDEISMLEARVITGALVTLLLSVVFSAYAAYRINRPLRQALFCAAAAMGHDTSVVEDKSHDETHQVLHTIERMVNDLKRSRDEAESASRMKGEFLANMSHEIRTPMNAIIGMTELTLETPLSPSQRENLEIIGSSAESLLGLLNDILDFSRIEAGRLLLEKVPFDLRNTVEGALDVVAPQAHGKGLELILDVARDLPEAFIGDPXXXXXXXXXXXXXXXXXGSGVYLDDVQDEISMLEARVITGALVTLLLSVVFSAYAAYRINRPLRQALFCAAAAMGHDTSVVEDKSHDETHQVLHTIERMVNDLKRSRDEAESASRMKGEFLANMSHEIRTPMNAIIGMTELTLETPLSPSQRENLEIIGSSAESLLGLLNDILDFSRIEAGRLLLEKVPFDLRNTVEGALDVVAPQAHGKGLELILDVARDLPEAFIGDPTRLRQVLINLLSNAVKFTAKGEVGLKVERAPSSGTDDGVMLLFTVSDTGIGIPADKLSLIFESFTQADGSTTRKYGGSGLGLAICRALVSMMGGDISVKSAVGVGSTFRFTARLGTCALQNREIRQAGIPRFGREVKILLAEDNPMNLKVSRLLLEMMGCQVVAVENGGDVVSAMKGERFDVVLMDIQMPVLDGLEATRVIRSGSERGIDQTTPVIAMTAHALKGYEKVCHEAGMNDFISKPVRAGELYNVILRNLPPAPGGGGVTPSAL

SEQ ID NO: 17055 - protein, 710 aa, Geobacter metallireducens
MSSPNHRICLVVGWGGAVLLFLGLVGTFVAYRIHNASIFGVLPHVLVFLMLCFIFMAVSYRRMKSEEALAHVKELMQVQRELDKTARRYRSLMEGAGTAIFVFNADTGMLVEVNRRGTELFGYDKEEMIPLRGKDLVLEEDQEKFISLVHRVARRGRGRSDGITFRRKGGECFLGQVDARLIDLGDEKVVHAVVRDITFKHRAEREVRQRNRELSTLVGIITRANQETELETVLDVTLRETIEAFGANGGGIHLGNQDGKLRPTASINVPEQLRFLLARRDEAGPLERIADSGTSLSLANLETECRFGSSPAVQGWKGFVGVPLSARNRVTGVMYLLCRKERRFGDDEVALLLSIAGQVGIVIDNARLFDELKWKSDELMGSLRLLERSSHELSFSQHRLRTNLMLVERANQELERIDRMKSNFLGMISHEFRTPLTSIISGTEFLLSSPSFQIGSDARRVLDMINQGGERLSEIVSDILKVAKLEANSTPVTRSTLHISQVFEEVLEALEPLRAERDLTISFADLERLPHCNGDRECFKDIFTELLENSIKFTPDGGTIMVDARIVDRDRLSPRGDILNRFNSRFLAQSGGGCYLEVEVRDSGIGVSHDEQVKIFDKFYEVGDIRHHSSGKNKFQGKGTGLGLAIVKGMVEAHGGMVWVESPGESSDGRLGSAFFVLLPLEESACQPQLPLSGAGMSRSHDDLPDEGGG

SEQ ID NO: 17056 - protein, 279 aa, Geobacter metallireducens
MTMNLPVVADSFTLYLAEIRKFPVLTPEEEHLYAVKFYEEKDLEAAHRLITANLRFVVKVAAEYKSYGMKMLDLIQEGNIGLMMAVRKFDPHKGIRLISYAVWWIRAYIQNYIISAWSLLKIGTTQAQKKLFFKLNQAKNAIRRLTGGDDTEATALSLHVKESEVIEMDQRMRGDYSLDAELVDGEGLTMLDTLVDERQNQEEALAEQQEASRLHGQVTQALERLNEKERYVVENRVTADEPLTLQEIADHFAISRERVRQIEEGALKKIKAYLTPITV

SEQ ID NO: 17057 - protein, 263 aa, Geobacter metallireducens
MHTEEGNPMGLERFSLKGKTAIVTGASQGLGEAMALGLAEAGANLVLASRNEASMAKVASEVTSKGVQCLTVKTDMLKADDIQAMVDKGIAQFGTIDILVNNAGINLVKPFVNLTEEDWDSVVDTNLKGYFLCSQVVGREMIKNKNGCVINNASVFGLRGFPNIASYIASKGGVVQLTRGLAVEWARHNIRVNCIAPGYIVTEMAKRDIETNPKILEQNLLKIPMKRGGQPREVADVVVFLASEASSYMTGQIVSMDGGWSAF

SEQ ID NO: 17058 - protein, 254 aa, Geobacter metallireducens
MSLDIFNLEGKVAIVTGGSRGFGKAIALGLAQAGADVVVASRTQADLDAVAEEIRALGRKSLAVATDMLDRGSIENLAAKTMEAFGKIDILVNNAGQGWTVPFLKWTDEQWDQILDVNLKGYFLCTQIVGQHMFKAKAGRVINISSAMGSYPLPYMVPYAASKGGINAMTKCLAQEWATRGITVNAIAPSYFSTDINKDAMEDEATTKLIMSKTPVNRWGNVEELVGLVIYLSSNASSFMTGAVLPLDGGWSAG

SEQ ID NO: 17059 - protein, 257 aa, Geobacter metallireducens
MHVSELFSLKGKTAIITGGSRGLGLMMAEGFAEAGASLVLCSRNLEQCEDAAANIRKLGVECDALRCDIGEQDEVKAVVAHTMNRFGKIDILVNNAGISWGGELQDTPLKKWDQLYSTNVRGNYFFTTEVVSPMIAGGGGNIINIVSIGGVRSTDPKVVTFPAYASTKGAIIALTKHLSRNWAKHNIRVNAIAPGIFPTEISKTLMVGPQKAVMEAAVPLGRLGEKDDFKGAALFLAADASRYVTGSVLWVDGGMLA

SEQ ID NO: 17060 - protein, 582 aa, Geobacter metallireducens
MNLMAKKSSDEVKQQLVDIGKEKGFLTYDEVNDVLPPDFSTEQIDDVMSMFGEMDIDLVDSSQKVKIPKMKLDLEEEEEMEGEQEEMEYEPGVLGRTSDPVRMYLREMGSVSLLTREGEVEIAKRIEEGERDIARVILTTPITVKEIIALGDKLRKFQISAAEISKEVEEEELEEDEEDVQANRVLSIIDEIRDLDVRMEAIAEELDAEGAAAKRQKELHAEQHEIREKFADLVKSLRLKDRHITKIAQRLKELSGKVEAILTEIAAVETEAGINGERLKEIVAKGDEKAKGLKVNLEDAQKLDKKIRAAEKKLKKLEHESGFKAQELSDALHAIDRGEAKAKLAKSELVEANLRLVVSIAKKYTNRGLQFLDLIQEGNIGLMKAVDKFEYQRGYKFSTYATWWIRQAITRAIADQARTIRIPVHMIETINKLIRTSRQLVQEIGREPSPEEIAERMNLPLDKVRKVLKIAKEPISLETPIGEEEDSHLGDFIEDKGVVSPLEAVIKANLSEQTSRVLSTLTPREEKVLRMRFGIGEKSDHTLEEVGQDFEVTRERIRQIEAKALRKLRHPSRAKKLKSFVE

SEQ ID NO: 17061 - protein, 519 aa, Geobacter metallireducens
MRKVRIVMRNGHMTGTSVRHLTTTQPSPDTVPGTGLPMDHQLRMLILEDSEDDLLLLLRELRRGGIDPVYERTETDAGMRALLDEREWDVIIADYNMPRFGAMVGLEIVKERELDIPFIIVSGKIGEDLAVAAMKAGAHDYLMKGNLSRLVPAIEREVREAGERRRRRQAEAAMRNQFNQISTIFDSLNALVYVVDMDSYRLLYLNKYGAQLFGENWEGRPCHEVIQGGKTLPCDFCTNDKLLLDGKALPPYIWEYKNMTTGRWYQCIDKAIRWTDDRLVRMEIAIDITERKEMERMKDEMISAVSHEMHTPLTAMIGFTEFLLENEVDREQQKNCLQTIHKETERLSELINNFLQLQRLKASMVKFRIMPVSVGLLLADAAALYTAASRKHTIVVECPPDLPPVRGNEEQLYQVAGNLISNAIKYSPAGGTVTLGGRADDDMVVFWVKDNGVGISPEFQERVFERFFRVDNSDRRKVGGAGLGLTLVREIVAAHGGRVWVESTPDAGSTFFVSLPRMK

SEQ ID NO: 17062 - protein, 684 aa, Geobacter metallireducens
MEQYAVYFALACAVAAVAYGLVSAQWILGLPQGNDRMRQIAAAIQEGAGAYMKRQYTIIAVVGVIMFIALFATLGMKTAIGFAIGALFSGLTGFIGMFVSVRANIRTTEAAKSGIHKALNVAFKGGAITGMLVVGLGLLGVAGYYFILQQVMPGAPVKEVVSQLVGLGFGGSLISIFARLGGGIFTKGADVGADLVGKVEAGIPEDDPRNPAVIADNVGDNVGDCAGMAADLFETYAVTLIAAMLLGAIAFTGNVAAVNYPLILGGISIVASIIGTFFVKLGGNQKIMPALYKGLIASGVLACIAFYVVTAQMFPQGLTTAAGVTYSATNLFISAIVGLVVTGAIFWITEYYTATEYGPVKHIAQASTTGHATNIIAGLGVSMKSTAMPVIVIAAGIIVAFQCAGVYGIAIAAVSMLSLTGIVVAMDAYGPITDNAGGIAEMAELDDSVRAVTDPLDAVGNTTKAVTKGYAIGSAGLAAVILFTSYVDELKLAGKIIDFNLADPYIIVGLFLGGMLPYYFAALCMEAVGKAGGSVVEEVRRQFREIKGIMEGTGKPDYASCVDIVTRTALKEMVIPGIIPIAAPIIIGFTLGPKALGGVIVGTIVTGIFVAISMTTGGGAWDNAKKYIEDGYHGGKGGDAHKAAVTGDTVGDPYKDTAGPAVNPMIKIINIVSLLIVPLLAKLG

SEQ ID NO: 17063 - protein, 649 aa, Geobacter metallireducens
MVNHAPTQPMKESVMYKLLDTITGPADLKNIPREELPGLADEIRRFLIETVSQTGGHLASNLGAVELSVALHYCFDSPADKLIWDVGHQAYTHKILTGRRESFHTQRQYKGISGFPKRSESPHDAFGAGHSSTSISAGLGMAAAQDLKGSGSRAIAVIGDGSLTGGMAYEALNQAGHLKKNLIVVLNDNEMSISQNVGAFSSFVSRKMTGSDFRKLKKEMQGLLENIPAIGKDILHFARRAENSLKGFLTPGMLFEALGFDYIGPIPGHDLPQLLEVFENVKGLEGPVLVHVMTTKGKGYQPAEENPAAFHGVGPFDVATGKTTGGKPGAASYTGVFGATLVKLAEEDEKIIAITAAMPDGTGLTPFAKRFPERFFDVGIAEQHALTFAAGLAADGFRPVTAIYSTFLQRAYDQVFHDVCLQKLPVTMALDRGGLVGDDGPTHHGTFDLSYLRHLPEMTLMAPKDENELQHMLKTAIYAGRPVALRYPRGAGYGLPLDQTIQSLEIGRGELLTEGDDVAIVAIGSTVYPAQEAAKLLEARGIRATVVNARFVKPLDRELILGAARRTGCIVTVEENALQGGFGSAVLELLADEGMTDVRAKRIGIPDRFIEQGPQPQLRKDLGLDGAGIAATVEAFLTAKGQAALSLVK

SEQ ID NO: 17064 - protein, 384 aa, Geobacter metallireducens
MKKLTILGSTGSIGTSTLEIVAAHPDRFQVIALTAGSNLELLKQQVEVFRPRLVSVLTADLARQLDRMLSDPKPEIHHGIPGLIAAATAGEADVVVAAIVGAAGLVPTAAAIKAGKDVALANKETLVTAGRIMMDLVRENGVRLYPVDSEHSAVFQSLEGQSGKDVKRIILTASGGPFLNLPLDRLSRVSVADALNHPNWSMGQKITIDSATMMNKGLEVIEARWLFDTPAERIAVNIHPQSIIHSMVEYVDGCVMAQLGVPDMKAPIAYALTYPERIPTGVKPLDLTALSGLTFLAPDYQRFPALKLAYDALAAGESMPAVMNAANEVAVEAFLKGKIGFTGIATSIARTMDAHEPHTLATIEDVLSSDLWAREKSRELIGLS

SEQ ID NO: 17065 - protein, 525 aa, Geobacter metallireducens
MVPPHGGSLPLFAPLLQPEGGVPGRLPPHPQAARGRGIPDRGAPAVHQAGPPPLLASRFSQGSTHPLPLALPARGEGGVTAFKENAMERHEQKTATAATWGTQVRTRTMATHRYKQISVLTMNTFAFTVCFAVWVMFSIIGIPIKGALGLNETQFGILAATPILSGSLIRLPLGMWTDKYGGRIVFFILMLCTIVPIYLVSAATAYWHFLLLGLFIGLAGGAFSVGISYTARWFTKARQGFAMGIFGAGNAGAAVTKFLAPSLVVAYGWQMVPKVYAVAMLVTAILFWAFTFTEHSHKVSSTVTIKDQLAALRDPKVWRYCQYYAIVFGGYVGLSLWMTKYYINEYGFDIRTAALVAAIFVLPSGVIRALGGWLSDRFGAHTVTCWVMWVSGGCLLLLSIPHFDVVVTTVNGPVARHVGLNVWVFTSLLFVVGIAWGFGKASVFKHISDEYPHNIGVISGIVGLIGGLGGFVLPIMFGALVDLTGVRSTAFMLLYGSTCVSLFWMYLALKKENVHRKLKTADILE

SEQ ID NO: 17066 - protein, 331 aa, Geobacter metallireducens
MLLQIERFLFTMPQLNMVQAINLALREEMARDDRVVLLGEDVGRDGGVFRITEGLFEEFGPKRVIDTPLSESAIVGAAVGMAAYGLRPVAEIQFMGFIYAAFDQLFAHAVRIRTRSRGRFTAPLVVRTPYGAGIKAPELHEESTEAFFCHMPGVKVVVPSGPYNAKGLLMAAIRDPDPVLFLEPTRLYRMVKEEVPEGEYTIPLGKARIARPGNAVTVVAWGSMLQRVMKAVEGYDAEVIDPMTLSPFDWEALLASVEKTGRLVVAHEAPLTCGLGAEIAATVAQEAILHLRGPVIRVAGPDTPVPLAKLIDHYLPSPERIRAALDDVLQY

SEQ ID NO: 17067 - protein, 476 aa, Geobacter metallireducens
MSTTSTPTATTAAFTDCHVRDLSLAAWGRKEMVIAETEMPGLMAIREEYAASQPLKGARIAGSLHMTIQTAMLIETLTALGAEVRWASCNIFSTQDHAAAAIAAAGIPVFAYKGESLEEYWEFTHRIFEWHDGGTPNMILDDGGDATLLLHLGSDAEKDPSVVANPTCEEEQFLFAAIKKRLAEKPEWYSKTAAAIKGVTEETTTGVHRLYQMHEKGRLKFPAINVNDSVTKSKFDNIYGCRESLVDGIKRATDVMVAGKVAVICGYGEVGKGCAQAMRGLQAQVWVTEIDPICALQAAMEGYKVVTMEWAADKADIFVTTTGNINVITHDHMKAMKHNAIVCNIGHFDNEIEVAALKQYQWENIKPQVDHIIFPDGKRIILLAEGRLVNLGCATGHPSYVMSSSFANQTLAQMELFCNPGKYPVGVYMLPKELDEKVARLQLKTLGAMLTELTEEQAAYIGVPKAGPYKTDHYRY

SEQ ID NO: 17068 - protein, 134 aa, Geobacter metallireducens
MSANKELYVGHMSYEATEDDLRRLFTVAGTVTSVHLITDRDTGEFKGCGYVRMATIEEAKEAVETLDGALLRNRAITVTLARPQKQTTRPGGRGGKGGPGPRTGGSRGKGGPAAGSGGPRGKSGPGTRPARGKK

SEQ ID NO: 17069 - protein, 309 aa, Geobacter metallireducens
MTHTRESAPMPQGKVTAILVFTTVLWGGSFLFNKIGMREIPPIQFFFFRFALAALLMGIICIPRLSRLNRDIVRRGAMVGVALAAVNLTFVLGVSGTTISRAGYLNNLFVLFIPLISFLIWRERLDRITFAGVFLAVAGLWELASGGAEGFNRGDLLSTVCAVFIAIHIITVSRVLRDEDVYLVTFVQFSTVALAGAAITLAMPWPAFTIGAAGGWSLAYCAIFPTVICFTLQNAFQRFTTPTKAGLIYTLDPVWSMLAGVFILGERLTPRELVGCMLILVAVAGPLLGRLYLEQRHRRLYHLDDVEEA

SEQ ID NO: 17070 - protein, 300 aa, Geobacter metallireducens
MHRYAKWWLLVLRSSWRLARARFCRVWSRGLTKECPRRMLKTRQELRPSGSRETMSLEGKVAIVTGASRGIGRAIALKLAREGASVVVTATTLESARKTAAEIEALGHKALSLAVDVADSSAVEAMFVSAVGAFGKVDILVNNAGITKDGLLLRMKDADWDAVIDVNLKGAFNCIREAAKLMVKARSGRIVNISSVVGEMGNAGQINYCASKAGMIGLTKSAARELAKRGITVNAVTPGFIETNMTSVLSDKVREGLLQQIPLERLGTSDDVANAVFFLVSSMGDYITGHVLSVNGGMYM

SEQ ID NO: 17071 - protein, 463 aa, Pseudomonas fluorescens PfO-1
MAFGELRNSDQFVVHLRVAVLVQAQFDDALDRQAELGHVDFGRVAGDDAAGLEFGHALGDGGGGEVHFAGEVGVGRATVFEQGAEQHAVVFVQGRTPEMPDFRNRGLSRRSPCFQKCTGAINRFCNLFLAVGLSRITHPLSLTFELPMSALRRFSLPLIAAFFALYVIWGSTYLVIRIGVEYWPPLMLGGVRFVIAGTLMYAFLRWRGAPAPTWAQWKAAGIIGILLLSFGNGAVTLAEHSGVASGVAALAVATVPLFTLLCGYLWGTRNTRLEWAGVVMGIIGIAMLNMGSNLQSSPLGAALLIFAAASWAFGSVWSKHLPLPQGAMASAVEMLVGGAVLLIGSAASGEHLQAMPPLEGWLALAYLIFFGSIIAFNAYMYLLKNVRPAAATSYAYVNPAVAVLLGIVFVGETIGIEEALAMLVIIGAVVLISLPQWRRPARPPVVSEPAAAAKVIATEQRAN

SEQ ID NO: 17072 - protein, 415 aa, Pseudomonas fluorescens PfO-1
MDAFNYRGGELFAEGVALSAIADRFGTPTYVYSRAHIEAQYLAYADALAGMPHLVCFAVKANSNLGVLNVLARIGAGFDIVSRGELERVLAAGGSPDKIVFSGVGKTRDDMRRALEVGVHCFNVESTDELERLQVVAAELGVRAPISLRVNPDVDAGTHPYISTGLKENKFGIAIADAEDVYVRAAHLPNLEVVGVDCHIGSQLTTLPPFLDALDRLLDLVDRLGDCGIHLRHIDLGGGLGVRYRDEEPPLAADYIKAVRERLVGRDLALVFEPGRFIVANAGVLLTQVEYLKHTEHKDFAIVDAAMNDLIRPALYQAWMDVTPVKPRETAARTYDVVGPICETGDFLAKERELALEEGDLLAVHSAGAYGFVMSSNYNTRGRAAEVLVDGDQAFEVRRRETVAELFAGESLLPE

SEQ ID NO: 17073 - protein, 336 aa, Pseudomonas fluorescens PfO-1
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 17074 - protein, 242 aa, Pseudomonas fluorescens PfO-1
MTESILVTGSSRGIGRAIALRLASAGHDIVLHCRSGVTEAQAVKAEVEALGRTARILQFDVADRETCKAILEADVEAHGAYYGVVLNAGLTRDGAFPALSDDDWDVVLRTNLDGFYNVLHPVMMPMIRRRAAGRIVCITSVSGLIGNRGQVNYSASKAGVIGAAKALAIELAKRKITVNCVAPGLIDTAMLDENVPVEELLKMIPAQRMGTPEEVAGAVNFLMSAEASYITRQVLAVNGGLC

SEQ ID NO: 17075 - protein, 87 aa, Pseudomonas fluorescens PfO-1
MKLVTAIIKPFKLDDVRESLSEIGVQGITVTEVKGFGRQKGHTELYRGAEYVVDFLPQGENRRCHRRQGSGSGYRGDNQGCQHRQDR

SEQ ID NO: 17076 - protein, 467 aa, Pseudomonas fluorescens PfO-1
MNAMQRPVRTELWAILRLAGPLIASQLAHMLMVLTDTLMMARLSPEALAGGGLGAASYSFVSIFCIGVIAAVGTLVAIRQGAGDIIGAARLTQAGLWLAWLMALGAGLLLWNLKPVLLLFGQTETNVNAAGQFLIALPFALPGYLSFMALRGFTSAIGRATPVMVISLAGTVANFLLNYALITGMFGLPKLGLTGIGLVTAIVANCMALALAWHIRRHPAYDAYPLREGLSRPNRQYLKELWRLGLPIGGTYAVEVGLFAFAALCMGTMGSTQLAAHQIALQIVSVAFMVPAGMSYAITMRVGQHYGAGQLSDARMSGRVGIVFGAVVMLGFAMVFWLLPNQLVGLFLDHNDPAFAEVIRLAVSLLAVAAWFELFDGTQTIAMGCIRGLKDAKTTFLVGLVCYWLIGAPAAWLMAFHLHWGPTGVWWGLALGLACAAVSLTLAFEWKMKRMIRLEPQSQGFKIAQPE

SEQ ID NO: 17077 - protein, 297 aa, Pseudomonas fluorescens PfO-1
MQYAFPLLAIFIWAGNTVINKLAVGAIFPAEIGFYRWLLAGLLFTPFMLKKVIAHWPQIRPNLGKIFILGVLGMAVYQSLAYFAATLTSATNMGIILSLMPLMSLAMAIISLGQQLTAGALVGAVLSFAGVLVVVSSGSLGALLQHGVNLGDAMMLIATLAYAIYSTLLKKWQLRLPPLVLLYLQVLVAVVVLFPLYAASPKTGLTLQNIPLVLYACLLASMLAPLAWMQAVQRLGPSRTTLFFNLLPLITALIAAVVLKEQLALYHLVGGLLTLGGVILSERWTTVLGRSRTPSAA

SEQ ID NO: 17078 - protein, 272 aa, Pseudomonas fluorescens PfO-1
MAEPLSLPPVPEPPKGERLKNKVVLLTGAAQGIGEAIVATFASQQAKLVISDIQAEKVEKVAAHWREQGADVQAIKADVSRQQDLHAMAKLAIELHGRIDVLVNCAGVNVFRDPLEMTEEDWKRCFAIDLDGAWYGCKAVLPQMIEQGIGSIINIASTHSTNIIPGCFPYPVAKHGLLGLTRALGIEYAPKGIRVNAIAPGYIETQLNVDYWNGFADPHAERQRAFDLHPPKRIGQPIEVAMTAVFLASDEAPFINASCITIDGGRSVMYHD

SEQ ID NO: 17079 - protein, 393 aa, Pseudomonas fluorescens PfO-1
MLSVQDRAIVKSTVPLLESGGEALITHFYRMMLSEYPEVRPLFNQAHQASGDQPRALANGVLMYARHIDQLDQLGDLVAKIINKHVALQILPEHYPIVGTCLLRAISEVLGEEIATPEVMSAWGAAYGQLAEILIGAETAIYDQKEQAVGGWRGAREFIVAAKVEESAEIISFYFEPADKGPILAAEPGQYIGMKLVLDGEEIRRNYSLSALANKGQYRISVKREPGGRASNYLHDQLHVGASIQLFPPSGEFTLTASDKPLVLISGGVGITPTLAMLEAALETERPVYFIHSARNGSVHAFRDWIDGLAARHPQLKRFYCYAEDDGVSPAADKVGLLSEEQLGEWLPAERDVDAYFLGPKGFMGAIKRHLKALGVPEKQSRYEFFGPAAALE

SEQ ID NO: 17080 - protein, 490 aa, Pseudomonas fluorescens PfO-1
MDEGGGPMMNFPTTLDGLYINGQWSAGREHLRVINPATEALLTTVNGGDESAVHQAVTAATEAFKAWSKTTGAERASILRNIANGVRNGREHLMNLQSSNNGKPQFEAGIDVDDVIATFEYYAELAEGLDAKLDSNVPLPSDDFSARLRREPCGVVGLIVPWNFPMVTTAWKLAPALAAGCCVVLKPSEVTPLPELELATIIAESGLPKGVFNLVCGTGLAVGAPLSADPRIAKVSFTGSNAVGVQVMQRAAETVKGVSLELGGKSSLLILEDADLDLAVELACGGGFFNAGQMCSATSRVLVADELADEFLIRLKAHAEKIRVADPFDPEVEMGALVNQAQYQRVLGHIDRGLSAGAKLICGGNRPADLPRGYFLQPTIFTEVPLDSALWCEEIFGPVICVRSFATEAEAIALANDSQFGLVASVVTRNAETADRVANALQAGLVWLNAPQVIFPQTAWGGYKQSSIGRELGPWGLAAFQEIKHVIRAL

SEQ ID NO: 17081 - protein, 469 aa, Pseudomonas fluorescens PfO-1
MNSVTDRPAAVSLNRPARVRLELKNLLGLALPIMIAQLATTAMGFVDAVMAGRVGPKDLAAVALGNSIWVPVFLLMTGTLLATTPKVAQRFGAGTHSEIGPIVRQALWLALVVGLMATTMLFSAEPILHLMKVDPELIGPCMQYLHGIASGLPAVAFYHVLRCTSDGLGRTRPAMVLGLCGLALNIPLNYVFIYGHFGVPAMGGVGCGWATAIVMWVMALGLAGYERWAPAYKSSELFSRFDWPQWAVIKRLLAIGLPIGVAVFAESSIFAVIALLIGSLGATVVAGHQIALNVSSLVFMIPYSLGMAVTVRVGQALGREEPREARFAAGVGMGTALAYACLSASMMLLMREHIAAIYTSDPMVIHIAAMLIVYSALFQFSDAIQVTAAGALRGYQDTRVTMILTLFAYWGIGLPVGYALGLTDWLGEPRGPSGLWEGLIVGLSCAALMLSIRLTRSARKRIRISRSMG

SEQ ID NO: 17082 - protein, 227 aa, Pseudomonas fluorescens PfO-1
MAPTAAVHPERRHHPAESTMQAIKLYNFPRSGHAHRVELMLSLLQLPTELIFVDLAKGEHKQPGYLAINSFGQVPAIDDNGVVLADSNAILVYLAQKYGNGRWLPSDPVGAAHVQRWLSAAAGPIAFGPAAARLITVFGAKFNAEEVITRAHNFLKVMDLELGKTPYLAGTEPTIADVSAYSYIAHAPEGNVSLDDYANVRAWLSRIEALPGFVGMPRTVAGLQTTV

SEQ ID NO: 17083 - protein, 428 aa, Pseudomonas fluorescens PfO-1
MVRPWRRPTVLVLTPSRDSLQLRCAMNKSFWKSGHTPTLFAAFLYFDLSFMVWYLLGPLAVQIAGDLHLTTQQRGLVVATPILAGAVLRFAMGMLADRLSPKTAGLIGQVIVICALFGAWKLGIHSYEQALLLGLFLGMAGASFAVALPLASQWYPPEHQGKAMGIAGAGNSGTVFAALIAPVLAAAFGWSNVFGFALIPLILTLVLFAWLAKNAPERPRAKAMADYFKALGDRDSWWFMFFYSVTFGGFIGLASALPGYFNDQYGLSPVTAGYYTAACVFGGSLMRPLGGALADRFGGIRTLLAMYTVAAVCIAAVGFNLPSSYAALALFVCTMLGLGAGNGAVFQLVPQRFRREIGVMTGLIGMAGGIGGFALAAGMGAIKQSTGSYQLALWLFASLGVLAWFGLHGVKRRWRTTWGSAAVTAARV

SEQ ID NO: 17084 - protein, 787 aa, Pseudomonas fluorescens PfO-1
MLEQRRETEVVQHPMDIKFTHRLSYKQARLTVLVGFILGTLLSLLQIGIDYASEDASINREILSLLEISHNPASRIAYNIDAELAQELTLGLLRSPAIISARLTDNNQTVLASVKRPELQSGYRMISDFLFGAKRQFEDRLYLDHLPNESLGTLSLEVDTFAFGSRFLRRAEVTLLNGFARSLILTGILLALFYVMLTKPLVRVIRELSGRDPRSAEPTTLECPGGHANDEIGVLVKVANQQFENIATEIQQRRNAENRLTDYLAQLEDIVSARTAELKAINARLSQSNQELEVARSTALDMAEARSAFLANMSHEIRTPLNGLLGMIALSLDGPLNAEQQQQLSIAHDSGKVLVELLNDILDLSKFDAGQLELEHIPFDLGSLIEDTANLLSQNAAPSVELTCLIDPHFPALVLGDPTRVRQIVSNLLSNALKFTRFGRVDVRLSTWKDGVRIEVCDTGIGIAQEAQVKIFQPFTQAGAGITRQYGGTGLGLALTYNLCEAMQGRLTISSEVGFGSQFCAELPLPCHTRAVIPPPLHGKVLAITNAVSGLAELLESLLPVWGLTYEQRTLDDPLLGLSPDVIITDCPECLFGLRPAVTAPILLVTAYGSFMPGEEATALAPLQQQARPLARNALYQNLRRTLQPDLTTIDRARLESVPSQRRGRVLLVEDNPVNQLVAKGMLGKLGCDVVVAAHGVEALDQLEHDEFDLVLMDCNMPVMDGYEASRQIRQSGRWPHLPIVALTANAMSEERERCRAAGMSDYLAKPFRREELAALLDQWIPTTTVL

SEQ ID NO: 17085 - protein, 1218 aa, Pseudomonas fluorescens PfO-1
MRVNMSSRLMSFLIAWSACLGFCTSSTAASPASQDFTLLGRSADRSVQALFDPSQVAWAHTRNELILGTSAPDYPPFDMTASGHDYEGFTADYAVLVGQAIGLPIRVKRFASREAAIRALIDGHIDMLGTANGFEAENADIVLSRPYAIDQPVLVTREGETRTLTEGLAGMRLSMLYHYLPLDDVKAMYPKALITSYPSYQNAINAVAFDQADVFLGDTISTHYMISKGYLNNIRMANFGKHEAHGFSFAVHRNNPQLLAIIDTVLKAVPGSERENIAKRWSVGSDTLLTDQKLQLTKREEQWLKKHSVVSVVVNEAFAPLTFFDSDGNFRGISADLLELIRLRTGLRFEIRRSRSDAEMIKQVEHHQADLIAALLPTAQREETLNFSRPYLENSYVLLTRKAADSPTHLGQLKRKRLAIAQGNPMIEYLRSEFPRIQLIETPDTFSAVALLDEGQVEGAVNSLVIANYFIASRTFEHPLQITTTIGTRQAAFSLATARDNTELSSIIDKSLMSITPEELGIINGRWRGYSSVSQGTWRQYQRFFYQVIGGACLLLLLSLLWNAYMRRQIKQRKAAERALNDQLEFMGSLVNGTPHPIYVRDRQGLLQSCNDSYLQAFNARREDVIGKSVMQGALNNAFEAQTYQADYQRVMAEGRPLVLDRPLQIGNRQLTIYHWILPYRDSSGEVQGIIGGWIDISERRELLDELRAAKERADDANRAKSTFLATMSHEIRTPMNAVIGMLELTLKRMDQTHPDRSGIETAYHSAKDLLGLIGDILDIARIESGRLSLTPERINLIDTVGSVVRIFEGLARQKQLSLAVSVSPPELNVDVHLDPLRFKQVLSNLISNAIKFTEAGHIRITLDVLPTDDPERSMVQLTVQDSGIGITTQDQSRLFEPFAQAANGGQRTFSGAGLGLVISRNLCEMMGGKLRLSSLPGIGTQVSVSLPVVILPAQVARAEDEPEIQASLIPLTVLVVDDHPANRLLMCQQLEYLGHRFCIAEDGQQGLEQWKNGEFDLVIADCNMPVMNGYDLTRAIRKHETLTRRPACTVLGFTANAQPEEILRCKQAGMNDCLFKTLSLNSLSEWVNSVQPLFRAPVFNLQGLTLLTGGNPSQTHRLLAELLNSSRLDRQELQALSLTRDPPALAIIAHKIKGAARIVQASRLIDSCEALEQACQQALPGDEIERRCQASRLAILELEQALEQQLNRISQSKVTRA

SEQ ID NO: 17086 - protein, 256 aa, Pseudomonas fluorescens PfO-1
MHPYFSLQGRTALVTGGTRGIGKMIAKAYVEAGARVYVCSRDAEACHQTAEELSALGTCLGIAANLATEEGVKELAARLGEQITHLDILVNNAGTTWGAPLESYPVKGWEKVMQLNVTSVFSCIQQFLPLLRKSGSAANPARIINIGSVAGISSFGEQAYAYGPSKAALHQLSRILARELVSQHINVNVIAPGRFPSKMTQHIGSDQQALADDTALIPMKRWGREEEMAALAISLASTAGAYMTGNIIPLDGGFSL

SEQ ID NO: 17087 - protein, 494 aa, Pseudomonas fluorescens PfO-1
MSALPDLSAAVADSDAEQLRQLGYTSNFNRSMSLWENFALGFTYLSPVVGVYTLFGLCLAAGGPPMFWAYLLVGCGQLLVCLIFGEVVSQFPISGGVYPWARRLVGKKWAWMVGWIYSIALCVTIAAVAVGAGPYLAAMLGFEPSNNTNIVIALVLTLFATLVNLSGTKVLARIAMFGFLCELVGAVIVGVYLLIFERHQPISVLFNTFDISVDGSYLPAFLTASLAGMFLYYGFEACGDVAEETPNPSAKIPVAMRMTIYIGGIAAMFACLALILAVPDMQAVINGTDKDPVTTILNNAFGPVGSKVVMGVVMISFISCVISLQAAASRLLYSYARDEMVIGSRLLKKISPTTQVPVAALFVSGVLPGLIIALGFFLQDAVATIVSFAAIGIYLAFQMIVLAALYARSKGWKPSGKFTLGAWGWPVNIGALVYGVGAIINMAWPRTPDAAWYINYAMVLSTAIVIGLGLVYMWIGKPYDHGKAPAGDAWKVGR

SEQ ID NO: 17088 - protein, 677 aa, Pseudomonas fluorescens PfO-1
MFFSRTAWSICAMSSASLIKTPPEKVTVNGWVFYTSTALILLLTAILIIAPQEAGRMLGVAQAWLSRSFGWYYMVVIAAYLVFVVGLAFSSYGKLKLGSKDDTPDFSYGAWAGMLFSSGIGISLLYFGASEPLDHYFNPPEGASATNMAARQAVQLTFLHWGLHGWAIYALVGLAVAYFAYRHNQPLALRSALYPLVGERWVKGAAGHAVDGFGMFVTLLGLVTNLGIGSLQVSSGLENLFGMEHSNTNLLIVIIVMSTVATIAAVSGVENGIRRLSNLNIILFSGLLIFVLLFGPTLHLLNGFVQNIGDYLNGVVLKTFDLYVYEGDSEKSDRWLGLWTLFYWAWWISWAPFVGMFIARISRGRTVRELVAGVLLIPLGFTLAWLSIFGNSALDLVMNQGAVELGKTALEQPSMAIYQLLEHYPASKVVIGVSIFVGFVLFLTPADSGAVMMANLSCKGGNVDEDAPHWLRIFWSVVITLVTIGLLFAGNFEAMQTMVVLAGLPFSVVLVCFMFGLHKAMRQDMQIEQEQAQLAERGRRGFSERLTQLDLQPSQSVVQRFMDKHVSPALEDAAAQMRAQGLEVQTLLGKSKRCMGVRVEMEEGNPFVYEVSLDGYLATPSESVQSDEARQRFYRAEVYLHNGSQDYDLMGFTQDQITRDVLDQFESHRQLLGRVYS

SEQ ID NO: 17089 - protein, 289 aa, Pseudomonas fluorescens PfO-1
MAFESIFRADLFSGQTVIVTGGGSGIGRCTAHELAALGANVVLVGRKPEKLQTVAAEIAEDGGRAHWQACDIRDEEAVKALVSELIREHGPIHGLVNNAGGQYPSPLASINQKGFETVLRTNLVGGFLMAREVFNQSMSKHGGNIVNMLADMWGGMPGMGHSGAARSGMDNFTKTAAFEWGYAGVRVNAVAPGWIASSGMDTYEGAFKAVIPTLREHVPLKRIGTESEVSAAIVFLLSPAAAFISGSTLRIDGAASLGNRAWPLHKATHSESFNGFHRAYMPDVLKDKE

SEQ ID NO: 17090 - protein, 287 aa, Pseudomonas fluorescens PfO-1
MSVGRFSKCAGGRSADNRHCPLLKLGRARYAAEPFNQIRAAALSTPPGMSLITDPMMNAPLKAFGPIKAVIFDMDGLLLDTEGIYTEVTSLIAERYGRTFDWSIKQNIIGRGAGDLARYVVEALDLPITAEEFLVIREPLMRERFPTAQAMPGAEELIRHLKAHNIPIAVGTSSSRQSFGQKTTLHRDWFALFDFIVTADDPEVGAAKPAPDIFLTAARRLGVAPEDCLVFEDSPFGVTAAKAAGMTAIAIPDAAMADEKYAHADGILRTLKAFTPSACGLPALDWA

SEQ ID NO: 17091 - protein, 158 aa, Pseudomonas fluorescens PfO-1
MINASLMQMVINASNDGIVVAEREGKDDNILIYVNPAFERLTGYTSEEILYQDCRFLQSGDRDQENLALIRDALRNNGSCREILRNYRKDGTPFWNELSLSTVKNVDDGQTYFVGVQKDVTVQVKAQQRVAQLEAQVAALEAELAALKATNGANKTAN

SEQ ID NO: 17092 - protein, 1060 aa, Pseudomonas fluorescens PfO-1
MYQPQDQLSQIISRQNATSRQASFQNSECRPGRSDTFIDGTQNVTLAPHRAHFALGVADRLEFAANLADVHIKAAIVGRITALKNVLIKEGLAQHFLVVAIEGFQQAVFAAGQAGGLVEVEHLALLVVETQPADRHHRSDGRRATIEGDPAQDRFNAHMQLSHAEGFGQIVVGAKAEPADTVGLGTEGRHQQHRGGMALTQLGQDIQSVEPRQQNVHQHHIERLAPGDTQAFAAVLAPGDLKAAAAQMFMDIGTEDGVVFDGKNAGLANGDRSHDYLQIILSWAIIQDCPAPGNPSLTCRTDDRSPSEGRRHHFSQDCPQANRYTAPIPRAGRTCESTISGMQEKGVLKKLGIKGRVLLLTLLPTSLMALVLGGYFTWTQQSDLQTQLMQRGEMIAEQLAPLVAPAMGHGDAELLERIATQSLEQPDVRAVTFLAPDRSPLAHAGPTMLNQAPSGDSAHLLRRSGNDATRYLLPVFGKHRNLAGELIPQESDRLLGWVELELSHNGMLLRGYRSLFASLLLIGAGLAGAALLALRMGRTINRPLSQIKQAVAQLKDGHLETRLPPLGSQELDELASGINRMAGTLQNAREELQHSVDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDHIPFNLRDLLQDTLTILAPAAHAKQLELVSLVYRDTPLSLVGDPLRLKQILTNLVSNAIKFTREGTIVARAMLEEENDDSVQLRISIQDTGIGLSNQDVRALFQAFSQADNSLSRQPGGTGLGLVISKRLIEQMGGEIGVDSTPGEGSEFWISLNLPKTRDDAEDLPAAPLLGRRVAVLENHELARQALQHQLEDCGLDVTPFNTLESLTNGVTGAHQTDQAIDLAVLGITSNDMPPERLNQHIWDLEHLGCRVLVLCPTTELTLYHLSVPNPHSQLQSKPACTRKLRRALSDMVNPRQSRSEPGEPLSSRAPKVLCVDDNPANLLLVQTLLEDMGAKVLAVESGYAAVKAVQSESFDLV

SEQ ID NO: 17093 - protein, 633 aa, Pseudomonas fluorescens PfO-1
MIFRRWDINTRTQLISLGPALLLTLLLISFFTFVRIQDLRQELNHTGQLIANQLAPATEYGVISGNNEVLESLLKATLATPNVRFLEVQDSANRILSYVEQPADAHNRPHQVEVFQAPVRLQRIALHNDFFQDGKSSPGVASEDYLGRVIVGLSNDAFSQRQQEILLKAGILALFALLFTFVLARRLAGSLSQPIRDIGNAVKAIQDGDYKTPLPIVDDTELGALSQHINNLAQALEQASREQHQAMAQLIQTREEAEKANNAKSDFLAMMSHELRTPMNGVLGMLQLLETTDMTEEQVEYAALASESTEHLLKVINDILDFSRIERSELELEHIPFNLAEVIGACAQSFQHSAAQRGLALQLRIPEDLRDLQVQGDPTRIRQILVNLVGNALKFTEQGRVSIEAQWQSLDHELLWFTCAVRDSGIGISPESLELMFNAFQQADSSISRRYGGTGLGLPIARTLAERMGGTLRAQSEEGRGSVFTLEIPLALYKQALPALAAPRTLNGASHGEGRNVLLVEDNPVNQTVIEAMLRSLGFTVSVATDGVQAVRSAGDNRFEAILMDCRLPLIDGYEATRRIRQLPGCGQVPIIALTANALQGDRENCLAAGMNDYLAKPFKHNDLQQILQRWVQ

SEQ ID NO: 17094 - protein, 253 aa, Pseudomonas fluorescens PfO-1
MSMTFSGQVAVVTGAANGIGRATAQAFAAEGLKVVVADLDAAGGEGTVALIRTAGGEATFVRCNVTVESEVKNLMDEVINTYGRLDYAFNNAGIEIEKGKLAEGSMDEFDAIMGVNVKGVWLCMKYQLPLLLAQGGGAIVNTASVAGLGAAPKMSIYAASKHAVIGLTKSAAIEYAKKKIRVNAVCPAVIDTDMFRRAYEADPKKGEFANAMHPVGRIGKVEEIASAVLYLCSDGAAFTTGHSLAVDGGVTAF

SEQ ID NO: 17095 - protein, 259 aa, Pseudomonas fluorescens PfO-1
MYRNLFSSSICRNVIRTCSTISRRPCPVTCVVMSAASDPAYAACPFTGKEADMLKIWGRKNSSNVRKPLWAAEELGLAYEAIDAGGAFGVVDTPEYRAMNPNGRVPVIQDDGFVLWESNAIVRYLLAKHAADTSWYPADPQTRATADKWMDWTTSSFAGPFRTVFWGVLRTPADKQDWPAIHAAIKECDSLLAMADQALKHQPYLSGSEIGMGDIPLGSFIYAWFEMPIERAPQPNLEAWYARLKQRPAYQKAVMTALT

SEQ ID NO: 17096 - protein, 466 aa, Pseudomonas fluorescens PfO-1
MKVMGIKVLLVEDDRSLREALADTLLLAGHDYHAVGSAEEALNAVEREAFSLVVSDVNMPGMDGHQLLGLLRARQPQLPVLLMTAHGAVERAVDAMRQGAADYLVKPFEPKALLDLVARHALGSLVASDAEGPVAVEPASAQLLDLAARVARSDSTVLISGESGTGKEVLARYIHQQSHRASQPFIAINCAAIPDNMLEATLFGHEKGSFTGAIAAQAGKFEQADGGTILLDEISEMPLGLQAKLLRVLQEREVERVGARKPITLDIRVVATTNRDLAGEVAAGRFREDLYYRLSVFPLAWRPLRERTADILPLAERLLAKHVNKMKHAMAKFSSEAQACLIGYPWPGNVRELDNAVQRALILQQGGLIQPQDFCLSGPALFAPLPAVVPVAPVIREVEIEVDSAGALGDDLRRREFQMIIDTLRTERGRRKEAAEKLGISPRTLRYKLAQMRDAGMDVEGYLFAT

SEQ ID NO: 17097 - protein, 543 aa, Pseudomonas fluorescens PfO-1
MQTAYTVLILLMLVSVSRLVGRVIPLPLPLVQIAAGALLAWPTLGLHVALDPELFLFLFLPPLLFSDGWRMPKRELWRLRGPVLTLAVGLVLFTVVGAGYFIHWLLPTIPLPVAFALAAVLSPTDAVAVSAISQNRLPTPLMHMLQGEALMNDASGLVTFKFALVAAVTGAFSLANASLTFVLVAVGGLAVGVALSWLVGRLRAWMIARGWDDPATHVVFMLLLPFAAYVLAERLGASGILSAVAAGMMQSWLDLLPRQTSTRLLNRSVWSLLEFAFNGLIFLLLGLQLPDIVKAVVSHETSLWPTLFYRCLDVVAIFLALVLLRFIWVQSIWRLSVLLRRLRGKGDLTQVPTARSCWLLTVGGVRGAVTLAGVMSVPMLMGSEAFPERDLLIFIAAGVILLSLVAACIALPLLLRGIEKSPDDKRRQEVRDAWRKTAEAAIHALETEEVNPQDAAQAALAAELKARIMSEYRHQLEVFNDSAEAQALAFQMDLLERRLRLKALRAQRLELYSLSRQHQIGDDVLREVLGELDLSEANLGSVK

SEQ ID NO: 17098 - protein, 401 aa, Pseudomonas fluorescens PfO-1
MDGGIVSRPQQITVLGATGSIGLSTLDVIARHPDRYQAFALSGFTRLSELFALCVRHLPEYAVVPEAGAARNLQDDLRAAGLSTQVLVGEEGLCQVAAAPEVDAVMAAIVGAAGLRPTLAAVEAGKKILLANKEALVMSGALFMQAVRKSGSVLLPIDSEHNAIFQCMPQDFARGLSNVGVRRILLTASGGPFRQTPMAELAHVSPDQACAHPNWSMGRKISVDSASMMNKGLELIEACWLFDAKPSQVEVVIHPQSVIHSLVDYVDGSVLAQLGNPDMRTPIANALAWPERIDSGVAPLDLFAVARLDFEAPDEERFPCLRLARQAAEAGNSAPAMLNAANEVAVAAFLDGRVRYLEIASIIEEVLNLEPVVALDNLDAVFAADATARTLAGQWLSRNGR

SEQ ID NO: 17099 - protein, 433 aa, Pseudomonas fluorescens PfO-1
MFTTMAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRG

SEQ ID NO: 17100 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 17101 - protein, 335 aa, Pseudomonas fluorescens PfO-1
MALSKEVPEFDIDDEVLLMETGIDSDSMSNDEGAAPPSVRAKSKHSASLKQHKYIDYTRALDATQLYLNEIGFSPLLSPEEEVHFARLSQSGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVGEVKRMLGLNERVSSVDVSLGPDSDKTLLDTLTDDRPTDPCELLQDDDLSQSIDQWLSELTDKQREVVVRRFGLRGHESSTLEDVGLEIGLTRERVRQIQVEGLKRLREILEKNGLSSESLFQ

SEQ ID NO: 17102 - protein, 407 aa, Pseudomonas fluorescens PfO-1
MKGRPMQRLYRKRIVLGVGGGIAAYKSADLVRRLIDQGAEVRVVMTRGGSEFITPLTMQALSGHPVHLDLLDPAAEAAMGHIELAKWADLVLIAPATADLLARLAQGIANDLLTTLVLATDAIVAVAPAMNQAMWRDPATQANLQLLESRGLKTFGPASGSQACGDVGMGRMMEATDLAQCAADCFQRQALTGKHVVITAGPTQENIDPVRYITNHSSGKMGFALAEAAVEAGARVTLISGPVHLPTPDRVTRIDVVSARDMLAACESAIPCDVFIASAAVADYRPEVVAPQKLKKDPTSGDGFVLQMVRNPDILATIATRPDRPFSVGFAAETEHLLDYAARKLKDKNLDLIVANDVANPSIGFNSEENACSVIDRELHATVFAQTSKSKIARQLVTFIAERLNQV

SEQ ID NO: 17103 - protein, 296 aa, Pseudomonas fluorescens PfO-1
MDTQPLIIRPRAEDVEGQPILRPLPSAKCRSVGPFVFFDHMLETVYPAGKGMNIRQHPHIGLSTLTYLFDGQIQHKDSLGSDQVVSAGDVSWMTAGTAIAHVERTPEPLWEQCFKMHGLQIWLASPRDHEQGPGHYSHHPASTLPVSDNLGVQIRMIAGSGFCLESPVPVLSPTLYAELKMQTATTLLIPTEHEERALYVLSGDVQLNGEAVEPHALVVLPAGEEMSLFAESDSHAVLFGGAPLDGPRRINWNFVASDPAAIDEARRKWAAGDWPTVPGEVERIELPKSRSEPTPL

SEQ ID NO: 17104 - protein, 432 aa, Pseudomonas fluorescens PfO-1
MSFHPPSKGPRMLELVAAFICLTTLLTFVNFRFIGLPPTIGVMVTALMFSLLLQGLSLLGYPGLEERVQQLIGQIDFGDLLMNWMLSFLLFAGALHVNLNDLRSYRWPIGLLATFGVLIATAVIGSLAYYIFALFGWHVSFLYCLLFGALISPTDPIAVLGVLRTANASKPLKTTIVGESLFNDGTAVVVFTVLLGIAQLGETPTVGATAMLFAHEAIGGVLFGGLIGYLVYLMIKSIEQHQIEVMLTLALVIGGSAMATELHVSAPIAMVVAGLIIGNLGRNLAMNDMTRKYLDGFWELLDDMLNALLFALIGMELLLLPFNWLHVAAASLLALAILLSRLLTVAPAIVLLRRWRTVPRGTIRILTWGGLRGGVSVALALALPLGPERDLLLSITYIVVLSSILLQGLTIGKLVKHATRDEPASAAEPAHH

SEQ ID NO: 17105 - protein, 473 aa, Pseudomonas fluorescens PfO-1
MEALMSAVITPADFNDYKVADISLAAWGRRETIIAESEMPALMGLRRKYASEQPLKGAKILGCIHMTIQTAVLIETLVALGAEVRWSSCNIFSTQDQAAASIAAAGIPVFAWKGETEEEYEWCLEQTILKDGQPWDANMILDDGGDLTELLHKKYPQVLDRVHGVTEETTTGVHRLLDMLAKGELKIPAINVNDSVTKSKNDNKYGCRHSLNDAIKRGTDHLLSGKQALVIGYGDVGKGSAQSLRQEGMIVKVSEVDPICAMQACMDGFELVSPFIDGINDGTEASIDKALLGKIDLIVTTTGNVNVCDANMLKALKKRAVVCNIGHFDNEIDTAFMRKNWAWEEVKPQVHKIHRTGAGSFDPQNDDYLILLAEGRLVNLGNATGHPSRIMDGSFANQVLAQIFLFGQKYADLSPAQKAERLTVEVLPKKLDEEVALEMVRGFGGVVTQLTKQQADYIGVTVEGPFKPHAYRY

SEQ ID NO: 17106 - protein, 311 aa, Pseudomonas fluorescens PfO-1
MLMPKMLHTGQVIIDLVMAVDALPQIGGDVLAQSASFEAGGGFNVMAAAARNGLPVVYLGRHGNGRFGDLARQAMNAEGICIGIDQPAEHDTGICVALTDASAERSFISYIGAEGEVTTAELNSVTAEEGDYVYVSGYSLLHSGKAQALLDWTLALPKTINVVFDPGPLVESPDSPMMQALLPRIDVWTSNSVEALRFTGATDIETALDRLAVHLPQEVLMVVRDGPQGCWIHQCGERQHVPGFKVQAVDSNGAGDAHAGVFVAGLAQGLAAHEAARRANAAAALAVTRWGPATAPGTAEVDVLISKKCTD

SEQ ID NO: 17107 - protein, 240 aa, Pseudomonas fluorescens PfO-1
MLTLRKASDRGLANHGWLKSFHTFSFASYRDPREQGFSDLLVINDDRVAAGKGFGQHPHRDMEIFSYVLEGALEHKDTLGTGSVIRPGDVQLMSAGSGVAHSEFNHSATKPVHFLQIWIVPDVSGAKPRYQQEHFSEQKKRGRLQLIISPEGSHGSLKVRQDARVYAGLFDGQESATLELPANRYAYVHVARGSVELNGMQLKEGDGVRVREEQALTLSNGQDAEVLVFDLRPQELPEMP

SEQ ID NO: 17108 - protein, 277 aa, Pseudomonas fluorescens PfO-1
MQHIVNRQGLNLPKLGLGTWPMLGDECTRAVEQALELGYRHIDTAAAYNNEDAVGQALANTPTPREQIHVTTKVWWDQLQPDAMRHSLDRSLKALRSEYVDLFMIHWPTTDWDLPHTLETLASFKEQGLARNIGVANFPLPLLRKVVEEYGIPLSAIQIEYHVLLGQNALLDYARQHDLALTAYTPLARNKVSEIPQIQQIAEKHGVLPTQVALKWLLDQDNVAAIPKASSKTNQLANLASLQVELDDDDRALIAALSKRERQVSPDFAPVWDAFDR

SEQ ID NO: 17109 - protein, 194 aa, Pseudomonas fluorescens PfO-1
MHALIVVDHDDPRSLTHALAQQIANGLSASDPSNTFEIADLHAEEFDPRFGVADWAVHHRESAPPADVLAEQARIDRADALVLVYPVFWWSMPALLKGWIDRVFSNGWAYDFDGDKTLKKLGRLRVHLVALGGADARTYERHGYGAAMKAQIDHGIFDYCGATVTSSALLLESESSDPAMQLQAARELGLGLFR

SEQ ID NO: 17110 - protein, 666 aa, Pseudomonas fluorescens PfO-1
MSASSTPASGLVRMNPPVFWFAATVILLFGLTVIAMPEQAGAWLLEAQNWAANTVGWYYMLAMTLYLVFVVVTALSGYGKIKLGADHDEPEFSYLSWAGMLFAAGISITLFFFCVSEPLTHMLQPPQGEAGTPEAARQAMQILFLHWGLHGWGVFAFVGMALAYFAYRHNLPLALRSALYPLIGKRINGPIGYAVDGFGIIATVFGLGADMGFGVLHLNSGLDYLFGIAHTQWIQVGLITLMMGAAIIVAVSGVDKGVRVMSDINMLLACALLLFVLFAGPTQHLLNTLIQNLGDYLGALPMKSFDLYAYDKPSDWLGGWTVFYWAWWIAWSPFVGLFIARISRGRTIREFVFGVLLIPLGFTLAWMSIFGNSAIDQVLNHGMSALGMSALDNPSMTLYLLLETYPWSKTVIAVTVFISFVFFVTSADSGTVVLSTLSAKGGNPDEDGPKWLRVFWGAMTALVTSALLFSGSIDALKSAVVLTSLPFSLILLLMMWGLHKAFYLESQKQIAQLHSLAPVSGSRRGKGGWRQRLSQAVHFPSRDEVYRFMDTTVKPAIEEVTAVFAEKGLNVVTQPDPAHDSVSLEIGHGEQHPFIYQVQMRGYFTPSFARGGMGSKQLNNRRYYRAEVHLSEGSQDYDLVGYTKEQIINDILDQYERHMQFLHLVR

SEQ ID NO: 17111 - protein, 308 aa, Pseudomonas fluorescens PfO-1
MSERSSHWQLQTIVSQLRTARDQWRAQNGRASGEQGGRELPSRDAMAQILEALCGALFPMRLGPVDLREESEDFYVGHTLDVALNALLTQARLELRYVARHSAQADTEVEAQAIRIIQDFALALPGLRSLLDTDVLAAYHGDPAARSVDEVLLCYPGILAVIHHRLAHHLYRAGLPLLARISSEIAHSATGIDIHPGAQIGRSFFIDHGTGVVIGETAIIGERVRIYQAVTLGAKRFPADEDGQLQKGHPRHPIVEDDVVIYAGATILGRITIGKGSTIGGNVWLTRSVPAGCNLTQANLQHDDGTQK

SEQ ID NO: 17112 - protein, 193 aa, Pseudomonas fluorescens PfO-1
MIMGKRILLILGHPSNESFCAALAGRYALSARAAGHEVREIVLGQLDFDPILREGYRQVQTLEPDLLQAQADLLWAEHLTLVYPIWWGGIPALLKGFFDRVLLPGFAFKYRAGKAFPDKLLHGRSAHLLVTMDTPPWYYRWIYRMPGLHEVRRNTLAFCGIEPRRTLTFGPVLGASDHQRESWLKQAGSIARH

SEQ ID NO: 17113 - protein, 387 aa, Pseudomonas fluorescens PfO-1
MSIQVEDYFARETFQKMKAFADKQETPFVVIDTAMIAQAYDDLRAGFEFAKVYYAVKANPAVEIIDLLKEKGSSFDIASIYELDKVLSRGVSADQISYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIHLKLINMGGGFPANYITRTNSLETYAEEIIRFLKEDFGDDLPEIILEPGRSLIANAGILVSEVVLVARKSRTAVERWVYTDVGKFSGLIETMDEAIKFPIWTEKKGEMEEVVIAGPTCDSADIMYENYKYGLPLNLAIGDRLYWLSTGAYTTSYSAVEFNGFPPLKSFYV

SEQ ID NO: 17114 - protein, 615 aa, Pseudomonas fluorescens PfO-1
MSGKAQQQSRIIELIKLGREQKYLTYAEVNDHLPEDISDPEQVEDIIRMINDMGIPVHESAPDADALMLADADTDEAAAEEAAAALAAVETDIGRTTDPVRMYMREMGTVELLTREGEIEIAKRIEEGIREVMSAIAHFPGTVDHILSEYTRVTTEGGRLSDVLSGYIDPDDGITPPAAEVPPPIDAKAAKADDDSEDDDAEASDDEEEAESGPDPVIAAQRFGAVADQMEITRKALKKHGRHNKAAIAELLALAELFMPIKLVPKQFEALVERVRSALDRLRQQERAIMQLCVRDARMPRADFLRQFPGNEVDESWSDALAKGKSKYAEAIARVQPDIIRCQQKLTALETETGLTIAEIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATREVLSGLTAREAKVLRMRFGIDMNTDHTLEEVGKQFDVTRERIRQIEAKALRKLRHPTRSEHLRSFLDE

SEQ ID NO: 17115 - protein, 632 aa, Pseudomonas fluorescens PfO-1
MPTTFHEIPRKRPTTPLLDRANTPDGLRRLGEAELETLADELRLELLYTVGQTGGHFGAGLGVIELTIALHYVFDTPDDRLVWDVGHQAYPHKILTGRRERMETLRQKDGIAAFPRRSESEYDTFGVGHSSTSISAALGMAIAARLQNSDRKAIAVIGDGALTAGMAFEALNHAPEVDANMLVILNDNDMSISRNVGGLSNYLAKILSSRTYASMREGSKKVLSRLPGAWEIARRTEEYAKGMLVPGTLFEELGWNYIGPIDGHDLPTLIATLRNMRDLKGPQFLHIVTKKGKGFAPAEVDPIGYHAITKLEPLDAPAAAPKKAGGPKYSGVFGEWLCDMAAADPRLVGITPAMKEGSDLVAFSERFPLRYFDVAIAEQHAVTLAAGMACEGAKPVVAIYSTFLQRGYDQLVHDVAVQNLDVLFAIDRAGLVGEDGPTHAGSFDLSFLRCIPGMVIMTPSDENELRKMLTTGHLYNGPAAVRYPRGTGPNATIEKDLEPIEIGKGVVRRQGSKVALLVFGVQMAEALKVAETLDATVVDMRFVKPMDEALVREIANSHDLLVTIEENAIMGGAGGAVSEFLARENILKSVLHLGLPDVYVEHAKPAQMLAECGLDEVGIEAAVRERLELLNR

SEQ ID NO: 17116 - protein, 617 aa, Pseudomonas fluorescens PfO-1
MTLWSSTAYLEDQPVRLYVLGVIYGVLLGMLVYNLFIYLSVRDTSYLYYIFYIASFGLYQLSVNGAAVEYFWPDNPWWANAATPFFIGCAGLFGSQFARSFLQTRNHSRWLDRLLIALIAFGAMVIGLSLMTSYGLALRLATTLALTFTVVIFAAGILAWWRGLRVARYFIIAWSAFLIGGIVNTMMVLGLLPNVFLTMYASQIGSAIEVALLSLALADRINAMREQQAQTLFDAGQKLEVLNQQLAHSNKLKDEFLATLTHELRTPMNGVIGSLELMQTVELDPELEQYQQTAAGSARDMMRMVNGILTLTELQAGKLKATPGSFSLRGVVEALRMQFDGNASSKSLDFKVDVLPTLPDRLHGDSAKLAQCLECLLDNAIKFTRVGGLALRVTGKPSTDNRLALSFAVIDTGIGFTDLGEATLYQRFFQLDGSMTREYGGLGVGLAICRQLVELLGGKLTHRSEPGSGSRFQLDVEFELPEVEAVPAFSRDTVRAPQDCTVLLVDDNSVNQLVMRGMLLKLGFRVRTADHGAAALDCLQRERFDAVLIDCQLPPLDGASLCCQIRDLPGCAHLPVFMIALGADREHCASGGSIDYLSKPVKFEDLQVAMQRRVLSC

SEQ ID NO: 17117 - protein, 295 aa, Pseudomonas fluorescens PfO-1
MGNLTKADLTPLRDSRPVADDSASPAPTRLIPTRSKTLENIMTDFKNSTPNEVAGKVALVTGAASGIGKAIALLLHARGAQVIAEDINPEVEALARPGLVPLVADITQDGAAERAVALAVEQFGRLDILVNNAGIIINKLVIDMTREDWERIQAVNATAAFLHSREAVKAMMPNKSGSIVNIASYASYFAFPTIAAYTASKGALAQLTRTLALEVIGHGIRVNAVGVGDVVTNILNNVVDDGPAFLAQHGEAAPIGRAAQPEEIAEVVAFIASDRASFMVGSVVMADGGMTVTAG

SEQ ID NO: 17118 - protein, 925 aa, Pseudomonas fluorescens PfO-1
MRWLRIAIGFTVTLLTLLCMLPAQAAQGSGWSVLLDDQGNLQLSDIRSARYTNQFSPIELDRLTAAEPDGALWLRFRLAPGKHEQVLRIFAPDLSHLNLYVLDGDRLIEQRDTGTAQPQAERPLPSSDFMLPLPQSDKPLDVYLRLVSDHQLRPYITLQAAVMAAANHNQTLIYGLLFGCLAMLILHNLIRYAYTRSRSSLWLAVCEGLLSLSLLLLLNLAGPWLPNWHAIQTPGAYLALLLTAPAGLMFAYRFFAPLGPHPLNKLLIGDILFIVICSLLLLFVNTLPLNIITYALVALAGLSMLLVGFYHWQKGYRPARLFVAAMVVFNIGTLIILPALLGLTLVAPQGLIMTLMGFICISGLLMSIALGERQRSITESRFSISRDLAASNAEINAKAEFLAKISHEIRTPMNGVLGMTELLLGTPLSVKQRDYVQTIHSAGNELLTLINEILDISRLESGQIELDDVQFDLNALIDDCLSIYRAKAEQQNVELISFIQPQVPRVISGDPTRLRQTLLSLLENALKKTEEGEVLVVVALDERSAGPRLRIAVQDSGQPMDQEERDALMHAELHSKHFLSANRLGGNLGLVIARQLIRLMQGEFGIKSGASQGSTLWLTLPLDPDRLEHPTSDLDSPLQGARVLVVDDNDTCRKVLVQQCSAWGLNVSAVPSGKEALALLRTKAHLRDYFDVVLLDQNMPGMTGMQLAAKIKEDPSLNHDILLIMLTGISNAPSKIIARNSGIKRILAKPVAGYTLKTTLADELNQRNRGQVVFQPQVASPAAPVKVPSDFRILVAEDNTISTKVIRGMLGKLNLQPDTASNGEEALQAMKAQRYDLVLMDCEMPILDGFSATQQLRAWEVGNQRIRTPIVALTAHILAEHKERARQAGMDGHMAKPVELSQLRELIEHWVAQRDQQNRATTQPS

SEQ ID NO: 17119 - protein, 459 aa, Pseudomonas fluorescens PfO-1
MDTGNFSAADRLERLPVSGYHRIIFIIIALAFFFDSMDLAMMTFLLGSIKAEFGLSSAQAGLLASSSFFGMVLGASLSGLLADRFGRKPVFQWSIVLWGLASYLCSTAQTVESLTLFRILLGIGMGMEFPIAQSMLSELIPAQRRGRYIALMDGFWPLGFVAAGVLSYFLLPLIGWRDIFLVLAVPAVFVLAIRFFIPESPRWLEQAGKHDEADKVLRGIEARVQASLGGAALPEPVRLPRSVTPPGHFLSALKQIWSPLYRQRTTMIWSLWFFALLGFYGLTSWLSALLQQSGFAVTQSVYYTVLISLGGIPGFLMAAWLVERWGRKPVCIVTLLGGGVMAFLYGQSAVFGGNVALLIGTGLLMQFFLFGMWAVLYTYTPELYPTSARATGSGFASAIGRVGSLLGPLVTGLVFPITGQGGVFALGALCFTIAAGVVWLFGMETRGKTLEELTEAVVR

SEQ ID NO: 17120 - protein, 1069 aa, Pseudomonas fluorescens PfO-1
MIWPLRFVLLSILMLASTVHATEAQRLEIVSRTRLEGVQIQLDEQDRQWLRAHPVLRIGASWPDYPPFELTRKRHELEGLTADYADAIAQILNIDVEVWCHANRASAMAALKAGEVDLLGTSNNFEIADPELMLSRAYAEDQPMWVTRLNEALPDDLAGKRIAMVDDYLPASTIEEAYPKASLQRYRSILDALGAVAFGRDDLYLGDFISASYLINTHFQNDLQLAGPSGLDANPFGFALARSNIRLKRLVDKALLAIPMEQRLAMELRWSAGRADIAAQSRVSLSDSEQQWLDQHPVVRVGAVDDFAPLTFFDTDGRFSGLVAQLLNLISQRSGLTFEVVRGQSLDRQVEQLRNGELDLLPVMTPSRERETQMLFTRSYANSPFVLITESKAQAPRSLEEMAGKRLALYRGNPLRDYLLEHVPQINLIELPSPADGTRALFDGRADATLSSLLVARYQIDHQYRERLRIASTLGDQPARIAMATAPDAPQLQSILNKALLGIAPQEIDGLVARWSRNVVLQDSYWQRHREQILRGFAVAAGLLLLALGWIAFQRRQIRQRQQWLQQLQEAKDAADEANRAKSTFLATMSHEIRTPMNALIGMLELALKRADEGVTDRQAIEVASSAGQQLLALIGDILDIARIESGHLSLAPKRANLREVVASVCRIFEGLARQKQLLLHVELDERSDVEVMLDPLRFKQVVSNLLSNAIKFTEAGEVSLCLRVFGEHGGLIEVGVAIEDSGRGISAEDQQRLFSPFVQVGDHRSVAHGGSGLGLVISRNLCRLMGGDLWMNSELNRGTQVMLRLELPVLAPRVQKEEAAPAVAMTNSLAVLVVDDHPVNRLLLCRQLSELGHRPVDTDGGERALALWRGQSFDALITDINMQGLNGYELTRAVRQEEAATGRAPCLILGFTANAQIEERQRCRAAGMNDCLFKPVLLRELSQALMAAGAETQVESLDESAVSEFDLSALLQLAGADNPLIEQLREEVRNSLRIDLQRLEASGLDRDVLRDLAHHVTGGAHMIGAERVVSACRVLEQACRDDQPAAALTAAIDSLRVAMHDLAQQLQA

SEQ ID NO: 17121 - protein, 303 aa, Pseudomonas fluorescens PfO-1
MIRAFQSTVLCPDSGFSRGIRRGYSCPYPLQPWSSCMSVPAFGLGTFRLQGQVVIDSVSTALELGYRVIDTAQIYENEADVGEAIAASGIARDKLFITSKIWIANFAKDRLIESLKASLQKLQTDYLDLTLIHWPSPEDQVPVEEFMGALLEAKRLGLTRQIGVSNFTIDLMKQAIAAVGAENIATNQIELHPYLQNRKVVEFAQSQGIQITSYMTLAYGEVLKDPLIVQIAERLQATPAQVTLAWAMQSGYAVIPSSTKRANLQGNLGAMALTLSDADMALIATLDRGHRLTSPKGIAPQWD

SEQ ID NO: 17122 - protein, 297 aa, Pseudomonas fluorescens PfO-1
MINLISEPTMKKLIGIYTSPRGHWVGDGFPVRTLFSYDNLGKHISPFLLLDHAGPAHFTPTIERRGVGQHPHRGFETVTIVYEGEVQHRDSTGSGGTIGPGDVQWMTAASGILHEEFHSENFARTGGNLEMVQLWVNLPAKDKMAAPGYQTILDSDIPQIALNDGAGSLRLIAGEFDGHKGPSRTFTPIDVWDLRLNAGKLLTLDLHEGRNTALVVLKGSVQINGGESMREGQLALFERDGDRITLEASADAVVLLLSGEPIDEPIVGHGPFVMNTEQEIHQAFADFQSGRFGQMHS

SEQ ID NO: 17123 - protein, 253 aa, Pseudomonas fluorescens PfO-1
MNNRFANKVALVTGAAQGIGRRVCERFLEEGAQVIAVDRSGLVHELQGEGVLSLTADLEQYADCARVMSAAVDTFGRLDVLVNNVGGTIWAKPFEHYEVEQIEAEVRRSLFPTLWCCHAALPYMLKQDRGAIVNVSSIATRSLNRVPYGAAKGGINALTACLAFENAERGIRVNATAPGGTEAPPRRIPRNAAEQSAQEQAWYQEIVAQTLDSSLMKRYGTIDEQVGAILFLASDDASYITGVTLPVGGGDLG

SEQ ID NO: 17124 - protein, 572 aa, Pseudomonas fluorescens PfO-1
MPSTTSRRTFVKGLAAGSLLGGLGLWRTPVWALNSPGQVNELSGTDFELFIGETPVNFTGQPRTALTINGSLPGPLLRWREGDTVTLRVRNRLKDSTSIHWHGILLPANMDGVPGLSFKGIEPGGVYVYQFKVRQHGTYWYHSHSGLQEQAGVYGPLVIDAREPEPFQYDRDYVVMLSDWTDEDPASLMKTLKKQSDYYNFHKRTVGDFVHDVGEKGWGATVADRTMWAQMKMNPTDIADVSGATYTFLMNGHAPDDNWTGLFRPGEKLRLRLINGSAMSYFDVRIPGLKMTVVAADGLHVKPVSVDELRIAVAETYDVIVEPAADAYTLFAQAMDRTGYARGTLAARAGLSAPVPALDPRPLVTMDDMGMGGMGSGGMNHGSMDMSGMDHSSMNMGPMQSHPDSEKDNPLVDMQAMTTAAKLDDPGLGLRNNGRRVLTYADLRSTFEDPDGRDPSRTLELHLTGHMEKFAWSFNGIKFSDAEPLLLKYGERIRLVLVNDTMMTHPIHLHGMWSDLEDENGNFQVRKHTIDMPPGTRRTYRVTADALGHWAYHCHLLYHMEMGMFREVRVEE

SEQ ID NO: 17125 - protein, 273 aa, Pseudomonas fluorescens PfO-1
MRTLELAGVQVPVIGQGTWRMGEDRSAHKREVAALRSGIELGMTLIDTAEMYGEGGAETVVGEAIAGLRDQVFLVSKVYPHNASRQGIPQACERSLRRLDTDYIDLYLLHWRGQYPLEETVEAFERLREDGKIGRWGVSNFDVDDLEELSHSACATNQVLYNLEERGIEFDLLPWCQQQRMPLMAYCPIGQGGAMLAEPVLKQIAARHGVTPAQVSLAWILRQDGLIAIPKAVRPEHVQLNAQAAQLPLDGGDLAALDQVFHAPQRKQRLAMV

SEQ ID NO: 17126 - protein, 255 aa, Pseudomonas fluorescens PfO-1
MSKTQLFDLDGKIAFVSGASRGIGEAIAKLLAQQGAHVIVSSRKLEGCQHVADAIIAAGGKATAIACHIGEMEQISQVFAGIKEQFGRLDILVNNAATNPQFCNVLDTDLGAFQKTVDVNIRGYFFMSVEAGKLMRENGGGSIINVASINGISPGVFQGIYSVTKAAVINMTKVFAKECAQFGIRCNALLPGLTDTKFASALVKNDAILKQALTQIPLKRVADPSEMAGAVLYLASDASSYTTGVSLNVDGGFLS

SEQ ID NO: 17127 - protein, 259 aa, Pseudomonas fluorescens PfO-1
MMFERLREDIQSVFHRDPAARNAFEVLTCYPGMHAIWIHRLAGMLWRNDLKWLARLVSNFGRWLTGIEIHPGAKVGRRFFIDHGMGIVIGETAEIGDDVTIYQGVTLGGTSWNKGKRHPTLGDGVVVGAGAKVLGPFTVGAGAKVGSNAVVTKEVPPGATVVGIPGRIIVKSDDEADAKRKAMAEKIGFDAYGVSEDMPDPVARAIGQLLDHLQAVDGRLEGMCGALKDLGSNYCAKDLPELREEDFACVKGKGESKLH

SEQ ID NO: 17128 - protein, 506 aa, Pseudomonas fluorescens PfO-1
MSEYNGALPFSRSGAPAMLRISQEALTFDDILLVPGYSEVLPNEVSLKTRLTRGIELNIPLVSAAMDTVTEARLAIAMAQEGGIGIIHKNMTIEQQAAEVRKVKKFEAGVVKDPITIEADATVRDLFELTRMHNISGVPVLHDGDLVGIVTSRDVRFETRLDATVREVMTPKERLVTVREGADKNEVRELLHKHRLEKVLIVDDKFALKGMMTVKDIEKAKAYPLASKDDQGRLRVGAAVGTGKDTGDRVAALVNAGVDVVVVDTAHGHSKGVIDRVRWVKENFPEVQVIGGNIATGAAAKALAEAGADAVKVGIGPGSICTTRIVAGVGVPQISAIANVAAALEGTGVPLIADGGIRFSGDLSKAIVAGASCVMMGSMFAGTEEAPGEIELFQGRSYKAYRGMGSLGAMSQAQGSSDRYFQDSSAGAEKLVPEGIEGRVPYKGTLSAIIHQLMGGLRSSMGYTGSANIEEMRTKPEFVRITGAGMAESHVHDVQITKEAPNYRVG

SEQ ID NO: 17129 - protein, 494 aa, Pseudomonas fluorescens PfO-1
MRPSAAPPLLFPRRRCIVFAFCGRPGPRLIREVVVSISFTRRQILGGLAGLAVVGAGAGGATRYWLGKVADANAGHDYELIAAPLDVELVPGHKTEAWAFGPSAPGTELRVRQGEWLRVRFINHLPVATTIHWHGIRLPLEMDGVPYVSQLPVLPGEYFDYKFRVPDAGSYWYHPHVSSSEELGRGLVGPLIVEEREPTGFKYEKTLSLKNWHIDDEGNFVEFSIPREAARGGTAGRLSTINGVPTPVIELPAGQITRVRLLNLDNTLTYRINIPGVEAQIYALDGNPVEPRPLGKEYWLGPGMRICLAIKAPPAGEELSLRNGPVRLGTLRSVANTDAPTDWPKALPANPVAEPDLANAEKLNFNFEWVGSVSVNVDNGKPPSLWQINGKAWDITDKTCADRPIASLKLGQSYIFELKNMTQYQHPIHLHGMSFKVIASNRHKIVPYFTDTYLLGKNERAQVALVADNPGVWMFHCHVIDHMETGLMAAIEVK

SEQ ID NO: 17130 - protein, 364 aa, Pseudomonas fluorescens PfO-1
MSAVTRAAVEAVLSQYTDPYLNQDPVSAGCVRNIEITGDRVSVQLEIGYAAGLFKSGWAQLLQLAIENLDGVVTARVEVNSVIAAHKAQAQIPGLANVKNVVAVASGKGGVGKSTTAANLALALAREGAKVGILDADIYGPSQGIMFGIPEGTRPQVKDQKWFVPLQAHGVEVMSMAFLTDDNTPMVWRGPMVSGALLQLVTQTAWGDLDYLVIDMPPGTGDIQLTLAQKVPVAGAVIVTTPQDLALLDARKGVEMFRKVNIPVLGVVENMAVHICSNCGHAEHLFGEGGGEKLATQFGVELLASLPLSMLIREQADGGKPTVISEPDSQIAMVYQELARHVGARIVLQEAASPAMPNITISDD

SEQ ID NO: 17131 - protein, 789 aa, Pseudomonas fluorescens PfO-1
MPHANALLEKLANSSQRLNKGLLILGALALLLLGISYLGVQRMVEEQRDTLQFHFARLMENVREQEAFLGDISRAGASGEYLPVTVASPMVQKLLPEEGPNIYQGRGLPFSLPFSVKIDPQRIAPDQYPKVFALGSYLAAYYSAFWAASHYQSPQVILLNGPDNFDIAVPATGRLRGAGPTQVGRFVKLMTQMNMQRHSQTSEQVLWAPYPFEQDNDGTPSLLAYVRMNLSKPTLRIEGANTWVVLGSLLKLSQVNNIERLMEWSIYDNFTLITPNGTVLIGALKPNQMLDDGANLTRDGLVFKLTSAGDQRWTAIYVISVQSFLDYALWPLLCLLALVLALLGSGRALNRWYTDRVILPAQSAHASIAESEAFCRAVIDTAPTGLCVISRRNHQVLLENQLAQQWHDSGELISLLDQQAATGHGHAELEIDSRHLHVAFVATRYQGQDAWLCALHDVTRHVEDSAALEVARQAADSANQAKSRFLATISHEIRTPLYGVLGTLELLGLTALAPRQQEYLETIQRSSASLFKLISDVLDVSKIEAGQMNLELQPFCPLELTEDVVRSYGAFARGKGLQLYACIDAALPDHLLGDAQRIRQILNNLLSNAIKFTDNGRVVVRVRVLQNSGGQARVQWQVSDSGVGISQAQQQQLFDPFYQVNEADSHAGAGLGLAICKWLCELMHGQLNVVSEPGLGSCFNLQLMLECASDSLADCPAFGADSPAVYVRAPVAELAQHLMAWLNRFGLDCRLVTNELPPPSALLVDLAPLASATAFAGQRIVAMPLPQPV

SEQ ID NO: 17132 - protein, 945 aa, Pseudomonas fluorescens PfO-1
MPGPPYCAGMRLKNYLHQISPVLSTPHAARRLLRIFALVLLAGILGGVYSFLLFTFNNEISQRRSYMSSAIAEAHTFFTGREALLESLSLSATRQTALSAPLSEEEIRLLLGHPPGKQWSIWLTQRMRDFLQARKLNLLYVSSGADAQVWRLYNTTPMADDFPHEMLDRLETLKCDNNGALKEIWLTHNWQGHSQLYIFIRLDERDLDSGWLGLEMDDREVSNALSDHSAGEFTMFNSQGMPLFSNSHKPPPGQNLPLLRQQDFFGFVGDGWLPEQLVLRKQLKSSDRQLTYSIDLLAVLWALWPQLLGALAFCLASISLVWLLIRRLEHRFITPTLQRIQALVESELFSRDVIQTAPVALCVLRRSDARVVLENTLARHWLGECGQQLGPGWIRAAFADKSPCLTDYFETADGRHLYLSCAPTRYKGEDVLLCAFSDISARRQIEAALERARQSADAANEAKTLFLATMSHEIRTPLYGVLGTLELLARTQLDTQQKSYLRAIEGSSATLLQLICDVLDVSKIEAGQLALELSDFSIVALAQEVVQGYAAAAQSKGLQLYACFDPQLPDSLIGDISRVRQILNNLLSNAVKFTDSGRVVLRVNVLSREGERVCVQWQVSDTGRGIAHDDQAFIFEPFYQTRGNSHVIAGTGLGLPICLRLTNLMNGTLRMVSEPGLGSSFSLTLPLEQRSGNTPPDIQPKLAGDIIYVVSPVRELADSLAGWLRRWGARPQVGAPASQVPADGGVLLELYPTPMDQRSELRWSGPRVLASGAGACEPQCTVDGWIANLNDLAAIRQALRQAQGGAVIEHQQTQTQALAPLHLHILVAEDNAINQLILRDQLQELGCTVALASDGEEALSLWQANTFDVVLSDVNMPRLNGYELAKTLRRLGCTTPIIGATANALRGEEALCLAAGMNHCLIKPFTLRALSIVLAPYQRVAHEVP

SEQ ID NO: 17133 - protein, 253 aa, Pseudomonas fluorescens PfO-1
MKNRFENKVALVTGAAQGIGRRVCEQLRAEGARVVAVDRSELVHELKQDDVLTLVADLEMHTECMSVMAAAVEAFGSLHILINNVGGTIWTKPFERYEAAQIESEVRRSLFPTLWCCHAALPYMLEQGHGAIVNVSSIATRGVNRVPYGAAKGGVNALTACLAFENAERGIRVNAIATGGTEAPPRRIPRNTAQPTEEEKVWYQQIVDQTIQSSLMKRYGTIDEQVAAILFLASDDASYITGVTLPVSGGDLG

SEQ ID NO: 17134 - protein, 436 aa, Pseudomonas fluorescens PfO-1
MDMSLLAQRTSAIINAEVHELRPALNGFVLFVCLFAGYFMLRPIRESMGITAGVDNLQWLFTATFFVMLAAVPLFAWLSARVPRLHFVDWVYGFFCANLLLFAALFLGEESPWLARVFYVWISVYNLFVVSVAWSLMADVFDSAQAKRLFAFIAAGASVGGLSGPALSALLIGPLGESGLMLLAAVLLGAAMLFKRQLMRWRNRGGAGRPGAAPSESPRRPLPGNPFSGMTAILKSPYLFGICGFVVLLATVTTFLYFEQARVVADHFPDRESQVRVFGIIDFVVQAGALLCQLFITGRVAQKLGVGVLLAMVPLVMCAGFIGLIFAPGFGLIAALMIVRRIGEYALVRPGREMLFAPLDAESKYKAKNVIDTVVYRAGDAISAWAKSALDALGQGAGMAALVGALCALLWGLLGWRLGERADRRSSVSAARQTPA

SEQ ID NO: 17135 - protein, 321 aa, Pseudomonas fluorescens PfO-1
MVCRAGAASEFSPMTRANVRVLDGGMGRELKRIGAPFRQPEWSALALIEAPEYVLQAHQAFVTAGARIITTNSYAVVPFHIGDERFAEQGRALAERAGRLARQAAGESTDPVTVAGSLPPALGSYRPDLFDHQGSVAIHRELIAGLQAHVDVWLAETHSSIAEVRAVVEALGTDPAPLWVSFTLLDEEGREPRLRSNEAVADAVRVAAELGAKAVLFNCSQPEVMAAALIEARAVIENLDHPVELGVYANAFPPVSAKAEANSDLLEIRRDLGPESYLDWSKSWVAAGASIVGGCCGIGPEHIAQLHLHLHYQKGEEAAHE

SEQ ID NO: 17136 - protein, 285 aa, Pseudomonas fluorescens PfO-1
MLARFRRKGPVTRRARQRDSFRGVLMTQDFIQNFSLAGRTVLITGASSGIGAHLARVAGHAGARVVLTARRVERLAQVAKDIEWDCGQALSVELDVTDRNSVEAAFDAAEAHFGVVDVVLNNAGIGNGQRPLEISEEQWREMLSTNLDGVWRVAQVAAQRLAKAGRKGSIVNVASILGLRVSTGYSHYCAAKAGVVQLTKSLALELARYNIRVNAIAPGYFKTEMNEAFFEGDKGNSYIRDRVPMRRLGQLHELAGPFLLLASDAGAFMTGSVLTVDGGHLVSSM

SEQ ID NO: 17137 - protein, 249 aa, Pseudomonas fluorescens PfO-1
MLLQGKVAIITGAASARGIGRATATTFAQHGAWVVILDLDASAARDAAASLGEGHLGLAANVADESQVQQAVATVIEHFGRIDILVNNAGITQPLKTLDIRPGDYDKVLDVSLRGTLQMSQAVIPLMRQQASGSIVCMSSVSAQRGGGIFGGPHYSAAKAGVLGLAKAMARELGPDNVRVNSIAPGLIHTDITGGLMQDERRHAIIDGIPLGRLGEAQDVANAALFLASDLSSYLTGITLDVNGGMLIH

SEQ ID NO: 17138 - protein, 340 aa, Pseudomonas fluorescens PfO-1
MSNAANTPTSTGEPIKKRLTTSAMIASIASEGQATRSAPFGHALAALADQRPDIVGLSADLSKYTDLHIFAKAHPDRFYQMGMAEQLLMSAAAGMAREGFVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRALEAAKALQTDGVDVAVLHVPTIKPLDEQTILAEARKSGRLVVTAENSSIIGGLGEAVAGVLLRNGVTPTFRQIALPDAFLDAGALPTLHDRYGISTDAVCAQIKSWL

SEQ ID NO: 17139 - protein, 730 aa, Pseudomonas fluorescens PfO-1
MSSPSSVDEQRFRKLLSRNVSLPLGVGVISAVFFVSLITYLLSVIQWVEHTDRVINNANEAVKLTVDLETGMRGYLLSGDEHFLDPYETAKPRIAVALNTLLELTADNPAQTDRLRRLQALQTEWATYAQSMIDLQRASGDYKSAVKAGKGKRLTDEIRKQFEDVIETEQLLRASRNEDVRRTTIWSISLYLLFVAGISGLLAYVGRRDLVNLSQSYGATLAAQEASAKRLEQQAWLRNGQTQLAEQVLGQLTVNLLGRNILQFCAQYLGSAVAALYVREEHGGLKRVATYGFSREQEQQNQSIYSEEGLVGQVAQQARLIRLDSVPSDYFKVSSGLGEGLPRSVLVVPTSDDERVNGVIELGFLRPLTDRDVALLELIAGNIGTSIEAARYRQRLQEVLAETQQLNEELQVQQEELKTANEELEEQSRILKESQAHLETQQVELEQTNEQLAEQAQTLAEQRDAMDQKNTELNQAQVQLEERAEELQRSSKYKSEFLANMSHELRTPLNSSLILAKLLAENPQENLSAEQVKFAESIYSAGNDLLNLINDILDISKVEAGKLEVMPENTSVARLADGLRGMFEPLAAVKQLAFSVQLQPDAPSTLFTDRQRLEQVIKNLLSNAVKFTEHGTVSLTIAGQPDDRIAFIVRDSGIGIAADQQESIFEAFRQADGTTNRKYGGTGLGLSISRDLATLLGGSISVSSAPGQAVSSPWCCRSTTANRATRLSRR

SEQ ID NO: 17140 - protein, 245 aa, Alcaligenes sp. SH-69
MSQKVAYVTGGMGGIGTAICQRLHKEGFKVIAGCGPTRDHAKCWPSKRPWATRFMHPSVTWVIGIPPVEAFGKTKAEHGTIDVLVNNAGITRDRMFLKMSREDWDAVIETNLNSMFNVTKQVVSDMVEKGWGRIINISSVNGEKGQAGQTNYSAAKAGMHGFSMALAQELATKGVTVNTVSPGYIGTDMVKAIRPDVLEKIVATVPVKALGEPSEIASIIAWLASEENGYATGADFSVNGGLHMG

SEQ ID NO: 17141 - protein, 531 aa, Aspergillus parasiticus
MAVLHSGVVCLDGWFYLRLLHRYVNFPVGYLPCFVLTFTSGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLVVGALSSIVPMYQSESAPRQVRGAMVSAFQLFVASVFSSLISSTSVPNPSTVPLPGVSLWDMCAWPLILGVGTLFLPESPRYAYRNGRVEEAREVMCKLYGVGPNHRCIAQEMKDMKDKLDEEKAAGQAWHFEVFTGPRMFYRVAGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIGGFATTWGPIVWAICGEMYPARYRAVCIGLATAANWSLNFLISFFNPIHLQRYRLCYGYVFAGCCFAAVLVVFFFVNETQGRTLEEVDTMYVLHVKPWKSASWTPRRVSSVISTDPPLPPSRRVGLSTASPPPRSASKWYHV

SEQ ID NO: 17142 - protein, 268 aa, Solanum tuberosum
MAEQKKHHFGGLFHHHKNEEEDTPVEKTTYEETTYGESEKTRTYGEKTSYGDDTYGEKTTTFGDDNKYGEKTSYGDDTYGEKPTSYGGDNTYGEKTSYGEGDDNKYGEKTSYGEGDDNQYGEKTSYGDSGYGEKPSYGGGDDNKYGEKTSYGNEEGGYGGGVGETTNYEENESETKTSEDYKEEKKHHKHLEEIGGLGAVAAGAFALHEKHKAEKDPENAHKHKIEEGIAAAAAIGAGGFAFHEHHEKKEAKEEEEEAEGKKKHHFFN

SEQ ID NO: 17143 - protein, 295 aa, Homo sapiens
MDSLQDTVALDHGGCCPALSRLAPRGFGTEMWTLFALSGPLFLFQVLTFMIYIVSTVFCGHLGKVELASVTLAVAFVNVCGVSVGVGLSSACGTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMEHAQCGGSLCPGCHL

SEQ ID NO: 17144 - protein, 489 aa, Oceanobacillus iheyensis HTE831
MREDKFAKEGLTFDDVLLLPAKSEVLPNQVDLSVELTSTLKLKSPFISAGMDTVTEAEMAIAMARQGGFGVIHKNMSIEDQAEQVDKVKRSESGVITNPFFLTPEHQVYDAEHLMGKFRISGVPIVNNIEEQKLVGILTNRDLRFIQDYSISISEVMTSENLVTAPVGTTLQEAEKLLQQYKIEKLPLVDDRNILKGLITIKDIEKVIEFPNSAKDAQGRLIVGAAVGVTGDAMKRIEKLVSVGVDAIVIDTAHGHSQGVLEQLKKVRQAYPDLQIIAGNVATPEGTKALIEAGVSVVKVGIGPGSICTTRVVAGVGVPQITAVHDCALAAAEYGVPVIADGGIKYSGDIVKALAAGAHAVMIGSMFAGVSESPGETEIFQGRQYKVYRGMGSVGAMAAGSKDRYFQSESQNKKLVPEGIEGRVAYKGPLSDTFHQLVGGLRSGMGYCGTKSIEALRNDGKFIRITNAGLRESHPHDVQITKEAPNYTL

SEQ ID NO: 17145 - protein, 166 aa, Oceanobacillus iheyensis HTE831
MKDELSVSQDELFMAAAIREARRAWILNEVPIGAVIVHDGEIVGKGFNLRESMQATLTHAELLAMQEANNEIGSWRLEDCTLYVTLEPCPMCAGAIVQSRMKRVVYGAPDPKAGCAGTIMNLLNEPRFNHQVEVTSGVLEQQCSTILKEFFKELREKKSKDISTND

SEQ ID NO: 17146 - protein, 226 aa, Oceanobacillus iheyensis HTE831
MGIFKMMKEDMDVVFEQDPAARTYVEVMLTYSGLHAVWSHRVAHWFYNKRLLFIARVISQISRFITGIEIHPGAKIGQRLFIDHGMGVVIGETCEIGNNVTIFQGVTLGGTGKEKGKRHPTLKDNALIATGAKVLGAITIGENSKVGGGSVVLKDVPDNSTVVGVPGQVVVQDGKRVGRDLDHHKLPDPVFDKCAQLQTQIDELKAEMASMKEEKRRVLENDHTNI

SEQ ID NO: 17147 - protein, 352 aa, Oceanobacillus iheyensis HTE831
MLTKERVVELLSSVQDPFLHITLEETGGINSVTIKEDKKHVSVKIGISKTNTAEQMELQQEIVGILKREGANTVGLRFEALPDEVIQKYQPAAEKAKEASLMGGSSNTKFIAVASGKGGVGKSTVTVNLAVSLMRLGKKVGIIDADIYGFSVPDMMGVEKRPVVRGEKIIPVERFGVKVISMGFFVEDNSPIIWRGPMLGKMINSFFSEVEWGELDYLLLDLPPGTGDIAMDVHELLPTCKEVIVTTPHPTAAFVAARAGQMALKTDHEILGVVENMAYFESKTTGEKEYVFGKGGGKKLADVLKTKVLGQLPLQQPYEEEDVFAPSVYQEDHPIGKEYHKIAAKVIAKMEE

SEQ ID NO: 17148 - protein, 406 aa, Oceanobacillus iheyensis HTE831
MSNTTVLLDKKTTEIIKATVPVLKEHGEAITKHFYKILLENNPELKNVFNQTNQRKGAQSKALANTVYAAAANIEKLEEILPHVKQIAHKHVSLNIKPEQYPIVGKYLLIAIKEVLGDAATDEIIEAWEKAYFVIADIFISVEKEMYNEKKNQIGGWTGFRDFKVIKKVKESKEITSFYLKPDDNLPITTFIPGQYITIKAQIESEAYVHLRQYSLSTAPGKDYYRISVKREASNQPIGVVSNYLHTSVEVGSVLPISAPAGDFILDERDHRPLVLISGGVGLTPIMSMLESVVEHQPNRNVVFIHAAKSIDHQAMRKRVSEIAKSKEQVKQYVVYSNPTNRTDGDKQGYIDYEWLKEVIPTKDAAFYLCGPKPFMSAINNDLQNMNIAQNDIHMELFGPLEPIAK

SEQ ID NO: 17149 - protein, 244 aa, Oceanobacillus iheyensis HTE831
MGRLENKVAIITGGARGMGASHVRLFAKEGAKVVFTDLNEEGGLALANELGENVKFVKQDVTNADDWETVISETEEAFGPVNVLVNNAGISLSIPLMEMTEEQYRKIIDINQVSVFLGMKAVVPSMQKAGSGSIVNISSMNGIVAGAVGYTDSKFAVRGATKAAAVQLGGLGIRVNSVHPGVIETPMVTKGDAVEQIKEFAKQIPSKRMAQPEEVSNMVLFLASDEASYSTGSEFVIDGGLTAM

SEQ ID NO: 17150 - protein, 256 aa, Oceanobacillus iheyensis HTE831
MKKCRIKEMLETSKVDECNMNILIVEDDKTIATGLEYSLKQEGYDVVVCHKVQEAQRKINNDLDDISLCLFDLSLPDGSGYELCEMVKRKADIPVIFLTVVDDEVNVVMGLDMGADDYITKPFRIRELISRIKTVLRRYEKSKPNKEQLSSVISIGSINIHTLEGKVYKETEEILLTALEYRLLMIFVNHRGQVLSRKQLLQLIWDIAGDFVNDNTLTVYIKRLRKKIEEDAQHPTVIETVRGMGYRMVDTHDKKQ

SEQ ID NO: 17151 - protein, 280 aa, Oceanobacillus iheyensis HTE831
MVNQIPNVTLHDGLTIPKVGFGTYRLNGNDGVQAINNAIDHGYRLIDTAYNYENEGTVGEAVRRSSTPREQLLITSKLPGRYHHYDKAVTTIQESLYRANLDYYDLYLIHWPNPIQDIYVEAWQALIEAKRRGYIRSIGVCNFLPEHLERLKQETGELPTINQIELHPFFNQEDQRKWHQEHQIATESWSPLARTNDVLDHPVLQKLASNHNRTVSQIILRWHYQLDAIAIPKSATPSRQLENISIFDFELSDEEMSIINQLSKVDGRMKDQDPAVYEEF

SEQ ID NO: 17152 - protein, 505 aa, Oceanobacillus iheyensis HTE831
MKKVTNVFYFAVILVGIMVALGAIFPVKFEQISQSVQAWVSSTFGWYYLLLMSVLVAVALFIAVSPYGNIRLGKDSDRPDFSNISWVAMLFAAGIGIGLVFYGASEPLAHFMIDAPLSEPGTAQAFKEALSHSFFHWGIHGWSMYGLVALAIAYFQFRKDEPGLISVTLKPLFGDRMNGGFGKAIDALAIFATVVGVATSLGLGAIQINAGLSHLFDLPVNIGVQATIILIVTVLFIISAWSGLNKGIKTLSNINLILALILFIFVLAVGPTLLIFNMFSESIGLYFQNFIQMSFRSAPLASDNRAWLDIWTIFYWAWWISWAPFVGIFVARISRGRTIRQFIFGVIIVPVLVISAWFTVFGTTAGDMQQQGIVDLTQFPTELVLFNMFDYLPLSTIISLLAIFLLVIFFITSADSATFVLGMQSTGGSLSPPNSVKVALGLSISAVALILLYVGGLSSLQNTVIVAALPFSFVIILMVISLYKALKEDAYIKKRKTSLKKNEEA

SEQ ID NO: 17153 - protein, 516 aa, Oceanobacillus iheyensis HTE831
MRSQDKKELDWPVFYISGGFLILFIILSLLSKDKVGEWVNTLFTYSSDWFGAYWQILLLLNFLIGLGLAVSKYGKVRLGKMDKPKYSYFGWVSMILVTLLASGGVFWAAAEPMYHYMDTPPLFGGGEFNYLDGAMAQAFVHWGFLAWAILGTLAVVVMMYVHYHKGYPLKPRGLLYPIFGERIFEKSVVGTLADSFSIIATVAGTLGPLGFLGLQISYGLNHLFGVPNTLVISMLVVLGLVAVAAISAATGVDRGIYHLSNWNVQFTILLALIVFLVGPTTFILDAFIGGTGVHLQNFFTMNLFRGDEGWLSGWTIFFWGWFIGYAPMLIVFISRISRGRTIRELIIAVSVVAPLVTNFWFSVVGGTGIFFENENSGSVSNALTEGGMPAAVMAITDQLPMGIIFGVGFLLVSIIFVATTTDTMSYTVAATLSGHDNPKRWLRVFWAIIFGATTAVILTIGEDSITSIQNSIVITAVPVSFLLLPPLWNAPKIAKKMALEQGLIWQREMNKKVDKD

SEQ ID NO: 17154 - protein, 274 aa, Oceanobacillus iheyensis HTE831
MEYVTLNNGLKMPQLGFGVWKVPNEEVVSPVEHALKVGYRSIDTAKVYGNEVGVGEAISNSGIPREQLFITTKVWNSDHGYDNTLKAFDESLERLGLDYVDLYLIHWPTPEFDQYVETYKALETLYKDGKVKAIGVCNFDIEYLERILNECEIVPVLNQVECHPYLQQKELRDFCEKHNIYLESYSPLMNGKEVLQSEELQNLAERKGKTVAQTILRWHLQSGMIVIPKSVTPNRIEENLDVFDFELTDTEMQEINELDRNLRSGAVPSEMNVR

SEQ ID NO: 17155 - protein, 264 aa, Oceanobacillus iheyensis HTE831
MELDSRKRMHLLEKALNYTRVGIIVTDPSIEDNPIVIANKGFLELTGYEEHEIIGKNCRFLQGKDTDNISIKQLRDAIQNKEPITIQIYNYKKDGTGFWNELSIDHMWDEQEGKYFFVGVQKDITNEKQNELLYEKSLKEIEKISTPIVPIMKDVSILPLIGTMNDTRIEALITSLSDYLENSDQHYLIIDLSGLFEMDTYTVSRFLKIHQFVSMMGKDLLVAGIRPDMAMKTLTIQDTWQGMRTFKDVKMAVEYIKQKEPEIN

SEQ ID NO: 17156 - protein, 263 aa, Oceanobacillus iheyensis HTE831
MTTKSQPHNKGGDEVYQWIEYLQKDPTNEEIQEKIVLKYQDLVGSIARKYSKNSAIHEDLVQVGMIGLLAAVRRYDPTYGKSFESFAIPTIIGEIKRFIRDKTWSVHVPRRIKELGPKIRKGVDELTTDNQKSPTVAEIAKYIGTSEEEVLETMEMGQSYKALSVDRKIEADSDGSTVAILDLVGNSEDGYDNVEQRMMLEKILPILSEREQQILECTYFKNMSQKETGELLGISQMHVSRLQRRSLRKLREAIQSESTEVLD

SEQ ID NO: 17157 - protein, 516 aa, Oceanobacillus iheyensis HTE831
MKNIKKQNQTIDKPVLFLSGGALLAFVILALINKEMVTDAVNTMFNWSVTYFGSIYQVLMVGTLIIALILGYSKFGKIRLGKLEKPEIGTFKWISIIMCTLLAAGGVFWAAAEPLSHFLTVPPHFTGIEAGTPEAIVPALVTSFVDWGFVSWAILGTLGTIVLMYSHYHRNAPLKPRSLLYPIFGDKIMKKSALGTFVDAFSIVSVAAGTIGPIGFLGLQAGYGLTALFGLPNNLLMQCIIVAVIVLAAGISAATGIHKGIQILSSYNIILAVGLMIGVLILGPALFIFDNYVQSFGMYVQDFLTLNTFRSDGAWLGLWTIFFFAWFIGYGPMMAMFVSRISRGRTIRELVTAVAVIAPVVTTFWFTVVGGTGIFSEMNSPGSVSDALNSAGPPAAMIAIAEQLPFGTIFGFLFLLATIIFVLTTTDSMSLTISMAITGHGDPAKYLRVIWAILMGVVAIVLITLGEDSVGSLQSFIVVTAVPVSLLMLTTFWTAPRVSRELAKEQKIDEKQSYTK

SEQ ID NO: 17158 - protein, 254 aa, Oceanobacillus iheyensis HTE831
MTNRFSGKVALITGGSRGIGKAIASLFAEEGAKVAIIDVNEEALSQSAKEFTEKGYTVYSKVADVVNAEEVELAVKEINDAFGSIDILVNNAGVIRDNLLFKMTDNDWQQVMDVHLKGAFHATRAVQQYMVEQKYGRIINISSTSALGNRGQANYATAKAGLQGLTKTLSIELGKFGITANAVAPGFIETDMTKATAARVGIPFDDFVKGSVSQIPVGRSGKPEDIANAVAFFADEKSSFVSGQVIYVAGGPKA

SEQ ID NO: 17159 - protein, 257 aa, Oceanobacillus iheyensis HTE831
MHVKELFNLKGKTAIVTGGGRGLGEQIAEGFAEAGANVVVCSRKEENCKEVSEKLEEIGVQTLALKCDITNPEDIKQVVAQTVEKFGGIDILVNNSGATWGAPVDDMPLEAFQKVINVNVIGTFLMSQAVGKVMKDQEYGKIINIASVAGLKGSDPELMDAIGYNTSKGGVITFTKDLAVKWGPSGIYVNAIAPGFFPTKMSKVLIERSKDKFLSRTPLRKFGTDTDLKGVALFLASSASDFVTGETIVVDGGSAAM

SEQ ID NO: 17160 - protein, 531 aa, Oceanobacillus iheyensis HTE831
MNKRLIDWPTFIGALLILLTVVIPLILFPKAGSEVINSANRFVTGNFGILYLILGLSALIFILFVAFSRNGRIKLGGRDVKKEFGTFSWAAMLFSAGIGSSILYWAMIEWAFYYQGPPFGITPESEEAINWAASYGIFHWGPIAWALYTLPALPIAYFYYVRKKPVLKISEASRPVIGKYADGPLGVIIDILFIFGLLGGAGTTLALGTPMIAEGINHLTGIPVTLPLQAIIMIICTVIFAISSFSGINKGIKRLSDLNLWLAIFILAFVFIFGPTLFLSEMTFTSLGVIVNNFFSMATWLEPKANVPGVEGTNFPESWTVFYWAWWLVYAPFVGLFVARISRGRTIKEMILGTLIYGTLGCVLFFGILGNYGLYLQLSGSFDVIGYINEYSAPATIIAILDQLPLAWLVIPIFTVLAIVFLATTFDSASYILAAVAQKQVTKGEPLRWHRLFWAFTLMILPMTLMFIGGLETLQTASIVAGFPVIFIMILLAWSFMRASTNDLNQTKQSKSSSAIIVDVDRDQNRKEKNK

SEQ ID NO: 17161 - protein, 253 aa, Oceanobacillus iheyensis HTE831
MKLKDKVAIVTGAASGMGKAIATLYASEGAKVIVADLNEEGAQSVVEEITSNNGVATAIKVNIAQKEDIDKMIDTAVDTYGTLDILVNNAGIMDGFEAVGDVEDDRWDLIFDINTKGVMRAMRKAIPIFLEKESGVIVNTASTGGLNGAHAGAAYGASKHAVIGLTKNTGYMYANSGIRCNAIAPGGVATNITSSLKGFNEFGFGRTKAVQGVMPRVGQPEEIAQVALFLASDDASFVNGTVVTADGGWTAAF

SEQ ID NO: 17162 - protein, 113 aa, Oceanobacillus iheyensis HTE831
MKKLEAIIRPEKFQSLRDELSSIGIGGLTVTEVAGTGKQKGQTGVYRSTEFQIQLLSKLKVEMVIEESQLEEIVDIIIKSCKTGNIGDGKIFVSPVEEVIRIRTGERGMEAVL

SEQ ID NO: 17163 - protein, 496 aa, Oceanobacillus iheyensis HTE831
MKSVTSVFWYSLALCIIVVLWGSFAPSNLEGFTSNVTTFISDTFGWYYLIIVMLMLIFCVYLIFSKYGKIKLGKENDKPEFSLLSWFAMLFSAGMGMGLVFWTTAEPISHAFTSSPGAELGSEQAINDGLKYSFFHWGVHAWAVYGIVALVLAYFKFYKDTPGLISATLVPLFGRNSMQGPAGKIIDTLAVFATVVGVAATLGFGSAQISGGLSYLFGTPGTFWMQLLILVIATILFICSAWSGIGRGIKYLSNINMGLAFILLLMLFLVGPTLYILNMFTHTLGSYVSDFFDMSLRLAPQDGEQRTWINNWTVFYWAWWISWSPFVGIFIARISKGRTIKEFMLGVLLVPAIVCFIFFAVFGVSALNLEQNGIATISEFALETSTFGVLNEYPLGMIMSIITLFVVAIFFITSADSATFVLGMLSTGGTINPKNAVKIMWGLMQSAVAAIIVYFGGTQGLQNMLIIAALPFSIVIILMGVSFFKSARKDQRHWRK

SEQ ID NO: 17164 - protein, 327 aa, Oceanobacillus iheyensis HTE831
MENVFDYEDIQLIPAKCVVNSRSECDTSVTLGNRTFKLPVVPANMQTIIDEKIAKYLAEKNYFYIMHRFEPEKRIDFIQDMQEYNLFTSISVGVKEEEYTFIEDLAAKQLIPDYITIDIAHGHSDAVIKMIKHIKNNLPSSFVIAGNVGTPEAVRELENAGADATKVGIGPGKVCITKIKTGFGTGGWQLAALRWCAKAASKPIIADGGIRTHGDIAKSIRFGASMVMIGSLFAGHEESPGETIEQDGKKIKEYFGSASEFQKGEKKNVEGKKMYVEHKGPLQDTLTEMEQDLQSSISYAGGKQLDAIRNVDYVVVKNSIFNGDKVF

SEQ ID NO: 17165 - protein, 236 aa, Oceanobacillus iheyensis HTE831
MMDANEIIQFISDSKKSTPVKVYVKGELDKLSASNTIKTFVDSKSGTIFGEWKDIQAYLEENKSLIEDYIIENDRRNSAIPMLDLKNINARIEPGAIIRDQVEIGDGAVIMMGASINIGSVIGEGTMIDMNAVLGGRATVGKNCHIGAGSVLAGVIEPPSAKPVIVEDDVVIGANVVILEGITVGKGSIVAAGSIVTKDVAPNTLVGGTPAKVLKEIDEQTKSKTEIKQELRKLDN

SEQ ID NO: 17166 - protein, 325 aa, Oceanobacillus iheyensis HTE831
MAQMTMIQAITDAMRVELKNDENVLVFGEDVGQNGGVFRATEGLQDEFGEDRVFDTPLAESGIGGLAIGLALEGFRPVPEIQFFGFVYEVMDSISGQMARMRYRSGGHYNAPITVRAPFGGGVHTPELHADSLEGLMAQQPGLKVVIPSTPYEAKGLLISAIRDNDPVVFLEHMKLYRSFRGEVPEEDYTVEIGKADVKREGSDVTLVSYGAMVHSSLKAAEELEKDGIQAEVIDLRTVSPIDYETILASVKKTNRVVVVQEAQRQAGVAGQVISEIQERAILDLEAPILRVSAPDTVYSFSDAEETWLPNHNDIVEKVNEVINF

SEQ ID NO: 17167 - protein, 260 aa, Oceanobacillus iheyensis HTE831
MTRHKVEICGVDTSKLPVLKNEEMKKLFVRMQEDGDITAREELVNGNLRLVLSVIQRFNNRGEYVDDLFQVGCIGLMKSIDNFDLSHNVRFSTYAVPMIIGEIRRYLRDNNPIRVSRSLRDIAYKALQVREKLISKTSKEPSPAEIAKEMDIPQTDVVFALDAIQDPVSLFEPIYNDGGDPIFVMDQISDEKDKDSSWVDKLSLKEGMHQLNEREKMILNKRFFQGKTQMEVADEIGISQAQVSRLEKAAISQMNKQMFE

SEQ ID NO: 17168 - protein, 246 aa, Oceanobacillus iheyensis HTE831
MLQGKNAIVTGASRGIGRSIALELAKQGANVVVNYAGSEDKAEEVVQEAISLGVRSFKFQANISNESEVKEMMKSVTNEFGTIDILVNNAGITKDNLLMRMKEDEFDQVVQTNLKGTFLCTKAVTRQMMKQKSGRIINVASIVGVSGNPGQANYVAAKAGVIGLTKTSAKELASRNILVNAVAPGFISTDMTDQLSKEQQDSLLSLVPLERFGKPEDVARVVRFLATEDANYITGQTIHIDGGMVM

SEQ ID NO: 17169 - protein, 376 aa, Oceanobacillus iheyensis HTE831
MKKIGITCYPTVGGSGVIATELGKLLAEKGHEIHFITSSVPFRLDKVYPKVYYHQVEMSHYPVFQYPPYDLTLAAKMAEVIDREKLDILHVHYAMPHAICAILARDIAKHPVKIVTTLHGTDITVLAIDNAFTSIIRHGIEHSDAVTAVSNSLVQQTNEMLDIEKPIEVIHNFINEQQYYPKKIHNLKYQFGIEEDTKVLIHISNFRKVKRVQDVIYTFEEVQKDVKSQLLLIGDGPEYGDMLRLVDELGLQDKVQFLGKQNNISDILSMADLMLLMSEKESFGLVLLEGMACGVPSIGTNIGGIPEVLKHEETGYIVNLGDSYNAAKYAIDLLTDDEKWQMFSDNSLQHVRDYFASKTIVNQYEALYDTLLQENN

SEQ ID NO: 17170 - protein, 435 aa, Oceanobacillus iheyensis HTE831
MIIDTHPFTVNEKGHLEIGGLDTLDLAKKYGTPLYVYDVALIRNNARAFVQAFTEKGVKGKVAYASKAFSSIAMLQVAKQEGLCLDVISEGELYTALQAEFPTERIHMHGNNKSIEEIRMAVDYEIGCIVIDNFHDIDLLEKVLEEKQKQMDVLIRVTPGVESKTHQYIMTGNEDSKFGFDLQNGQAEQAFKRLHNHQQIRFQGLHCHIGSQIFETSGFQVATDLLFSELEKWNNKYDYQPNVLNLGGGFGIRYTKDDQPLPLDKYIKSMADAVQTHVKQLSMEMPEIWIEPGRSIVGNAGITLYTIGSNKQIPGIREYYSIDGGMTDNIRPALYNAAYEAVIANHPKNPIEKEVSIAGKCCESGDMLIWDLPVPEINSGDVLAVFSTGAYSYSMASHYNRLPNAAVVFVENGRDQLVVRRETYQDVVRNDLSYE

SEQ ID NO: 17171 - protein, 250 aa, Oceanobacillus iheyensis HTE831
MNVNKTREREQLSDEQVKELIRLSQQGDQSARDRLVEKNIRLVWSVVQRFINRGYDPDDLFQIGSIGLIKSIDKFDLSYDVKFSTYAVPMIIGEIQRFIRDDGSIKVSRSLKEIGNKIRRKKDEMTKQYGRSPTVNELAEALELQPEEVVHAQEAAKSPQSIYETVFENDGDPITLLDQIADQDSKWFEKLSLQEAIRSLTERERLIIYLRYYKDKTQTEVAERLGISQVQVSRLEKKILEDMKKNMDTS

SEQ ID NO: 17172 - protein, 327 aa, Oceanobacillus iheyensis HTE831
MPVMSYIQAITTAMKEEMRRDKDVFVLGEDVGKKGGVFKATDGLYEEFGEDRVLDTPLAESAIAGVAIGAAMYGKRPIAEMQFADFIMPAVNQIISEAAKIRYRSNNDWSAPLTVRAPYGGGVHGALYHSQSVEAVFANQPGLKIVMPSTPYDAKGLLKAAIRDNDPVLFFEHKRAYRLLKEEVPEDDYVLPIGKADVKREGEDITVITYGLCVHFALQAAEKLAEEGIDVHILDLRTVYPLDKEAIREAASKTGKVLLITEDNKEGSIIGEVAAIISESCLFDLDAPIQRLAGPDIPAMPYAPTMEKYFMVNPDKVEKAMRELAEY

SEQ ID NO: 17173 - protein, 380 aa, Oceanobacillus iheyensis HTE831
MAEQKPSHMKEEVTEVTETTEVTTLEQAKNRLLEIGKKRGSLAYEEVADGLSNFELEPEQMDEFYEYLEEQGVDVIGESEDDPEMQKIAKEEEFNLNDLSVPLGIKINDPVRMYLKEIGRVNLLSAAEEIDLASSIEEGDEEAKRRLAEANLRLVVSIAKRYVGRGMLFLDLIQEGNMGLIKAVEKFDYRKGFKFSTYATWWIRQAITRAIADQARTIRIPVHMVETINKLIRVQRSLLQDLGREPTPEEIGEEMELGPDKVRDILKIAQEPVSLETPIGEEDDSHLGDFIEDQEAISPSDHAAYELLKEQLEDVLDTLTDREENVLRLRFGLDDGRTRTLEEVGKVFGVTRERIRQIEAKALRKLRHPSRSKRLKDFLD

SEQ ID NO: 17174 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 17175 - protein, 496 aa, Oceanobacillus iheyensis HTE831
MNKHKFLNPVFFVSSIFILILVVIGAISPGRFEAVANKLFNFTTINFAWFYLLAVFVFILFLIWLAFGKYGKLKLGPADSKPEYSFFAWVGMLFSTGFGSSLVFWGVAEPMTHFFSTPFPGLEAQSEEAARVAMGYSFFNWGISQWAVFALVGLVIAYLQFRKDKNGLISTAIEPVVGKNRFTANTVNSLAVIATVMGVATSLGFGIMQMNGGLNSVFGLSNSIWVQIGIAVAMLLVYLISSATGLKKGMKWLSTLNLTLCLALLLFVFIMGPTVFILESFVLGIGDYITNFVQYSLRMTPYTGESWVTEWTVFYWAWAISWSPFVGAFVARVSRGRTIRQFIFGVTAVSPIIACLWIAVFGGTALFSDLNNGTMIAEAVDEDLAVALFETFGTLPLSTIMSLLAIFLIFTFLVTSADSATYILGSMTSKGSLNPALVTKIVWGLLITAIAIVLLLAGGLEALQTAALTSALPFTIIIIILMISFLKIIKKDRSSK

SEQ ID NO: 17176 - protein, 571 aa, Oceanobacillus iheyensis HTE831
MAKKIEGIAASSGIAIAKAYELKTPELSFERSNIDDPTSEINRLDKALEISKQELEKIKAHTLKEIGEEHAEIFSAHLLVLSDPELIGPMKDKINEEKINAEAALDEVATMFIEMFKAMDNEYMRERAADIQDVTKRVMSHLLGVTFPDPALIDEQVVVIAEDLTPSDTAQLNREFVKGFATDIGGRTSHSAIMARSLEIPAVVGTKNITSSVQKDDVIIVDGLDGNIIINPSEEEIQAYKQKQADFAKKQEEWAKLKDEPSFTKDGEQVELAANIGTPEDVEGVLNNGGEGVGLYRTEFLYMGKSELPSEDEQFDAYKTVLEKMKGKPVVVRTLDVGGDKEISYLDLPKELNPFLGYRAIRFCLENEHVFRPQLRALLRASAYGNLKIMFPMIATIEEFRQAKALLMEEKDSLKNDGIEVSDDIEIGIMVEIPSTAVIAKQFAKEVDFFSIGTNDLIQYTMAADRMNEQVSYLYQPYNPAILNLINTVIEAAHAEDKWVGMCGEMAGDSIAIPLLVGLGLDEFSMSATSILPARTQLLSLNKKELVKAKEQFLAMSTSEEVVAFVKEITE

SEQ ID NO: 17177 - protein, 429 aa, Oceanobacillus iheyensis HTE831
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 17178 - protein, 506 aa, Oceanobacillus iheyensis HTE831
MRYANPNKQDAIVNFEKRYDNFIGGKYQPPINGNYFENVSPVTGEVFCEIARSTKEDVDAAIDAAHAAKDAWGKTSVAERAVILNKIADRIEENLEKLAVAETWDNGKAVRETLAADIPLAVDHFRYFAGVIRAQEGTLSQIDEDTVAYHFHEPLGVVGQIIPWNFPILMATWKLAPALAAGNCVVLKPAEQTPASIHVLLDLIKDLLPDGVLNVVNGFGVEAGKPLASNSRIAKIAFTGETTTGRLIMQYASENIIPVTLELGGKSPNIFFEDVMDKDDAFVDKAIEGMVMFALNQGEVCTCPSRALVHESIYDRFMEKVIQRVNQIKIGHPLDTDTMMGAQASQEQMEKIKSYLDIGKQEGAEVLTGGNVNALEGELAAGYYVEPTIFKGNNKMRIFQEEIFGPVLSVTTFKDKDEAMEVANDTLYGLGAGIWTRDINTAYRFGRGIEAGRVWTNCYHQYPAHAAFGGYKKSGIGRENHLMMLGHYQQTKNLLISYGEGTAGLF

SEQ ID NO: 17179 - protein, 275 aa, Oceanobacillus iheyensis HTE831
MIKGLQDTFTLNNGVEMPGFGLGVYKVEDGSVAEESVRIALENGYRSIDTASFYDNEKGVGEGIKNSGVPREDIFLTSKVWNDEQGYTSTKQAFQRSLDKLGTDYLDLYLIHWPVKDTFVETWRAMEELYRDGKVKAIGVSNFHVQHLEKLFVNAEVIPAVNQVEFHPHLTQEGLRAFCRQHNIQLEAWSPLKRGQLLEEDIIQTIAKKYGKSAAQVILRWDVQHEVITIPKSITKERIIANADIFDFSLTEEEMNQIDAMNQNDRSGSNPDSFD

SEQ ID NO: 17180 - protein, 209 aa, Oceanobacillus iheyensis HTE831
MNKQEIIQRILIVFTTTLAVACIGIYMGQYIPKQWMLPLMIIEIIMLIAAALLRRRSRVGYIFLFSFVVISGITMFPAIYFYVSEIGAVVVLFVFLLTLMIFTILGMVGWVLQKDLSFMGSTLFIILIVLIAFSIFTWFIPQSDTVLVIVACVSAGLFSVYIVYDFNQIKHRALTAKDVPSAVLSLYLDVVNLFLHLLRIISYVFKNRG

SEQ ID NO: 17181 - protein, 530 aa, Oceanobacillus iheyensis HTE831
MSIDKSSKKGLIDYKIFLPALIIIVGISIPLSLYEEESLAILNSIFNGVVDSFSWGYIWYGIILLVAGLYFSFSKYGKVVLGDPMEKPRFTLFEYASILVAMGLGSTIMRTAMIEWGNVAVNPPFGAEAGSDAAILWGSAYSMFLWGFQVFAVFVMAAPAMGYILHVKKRPMMRISEACRILFGDRFTDGIGGIVLDVLFLISILSGAAVTLGLGAPIVTYNLAELLNIELSFGLTLIVTVIWVLLFSISAYLGIEKGIKRLSTLNMYLAGAFALFIMVIGPGVFILNYFTDTVGFLISNYADISLHTNALGSGEATHIESNTIFWFAYNATWAMLHSVFAAKISRGRTIKEMILTYLLAPTMISWIASGVLGGLGVYKYLNGEVAVLDIISNQDPMAAIPAILSSLPLGNLVLIVFIIIAMIFLTTTLDSTTYTIASYAGTENMSKAEPSRNLRIIIAAIITIVALILMRIGGLAPLEVVSGLMGLPIIFIQFLTIYAAKKMMDKDRAWITNVREEDKKYYNKSKGKRL

SEQ ID NO: 17182 - protein, 263 aa, Oceanobacillus iheyensis HTE831
MDLGLHGKSVIVAASSKGLGKATAKQFAAEGAKVIISSRSQEELEKAQEEIRSETGNNNVSYIVCDITNPASVKELVVKTIELNETIDVLVNNAGGPPAGNFDDVSDEEWTNAFELNLLSFVRLIREVLPYMRRQGSGHIVNIASSSIKQPIDNLILSNTFRAGIVGLAKSLSQELAPDNILINTIGPGRIGTDRVKHLDEFVAKQQDMRYEDVKSKAESSIPIGRYGKTEEFANLVVYLCSGANTYITGQSLLVDGGMVKAL

SEQ ID NO: 17183 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 17184 - protein, 374 aa, Oceanobacillus iheyensis HTE831
MQVKTAVLRTQGADSPYKESKPIKIETLELDAPQLGEVLIQIKAASLCHSDLSVINGSRPRPLPMALGHEASGVVVEVGEGVTYLEPGDHIVCVFVPSCGHCVPCKEGRPALCEPGADSNTAGTLISGGIRLHADGEAINHHLGVSAFSEFAVVSRNSLVKVKKDIPFEKLALFGCAVITGVGAVVNTANVKLGSTVAIVGLGGIGLSALLGAVAAGASRIIAVDINENKLKQAKELGATDVFNSTEETVIQQIKEATDGGVNYAFETAGAVPAMEVAYGITKRGGTTVTTGLPHPEHQFSFPYVTLTAEEKTLKGSYVGSCVPDRDIPRYMNLFKQDRLPVDKLMTDFISLDEINEGFDKLAKGDSSRIIIKM

SEQ ID NO: 17185 - protein, 251 aa, Oceanobacillus iheyensis HTE831
MNELFNLTGKVAVITGGNRGIGKSIATGLASAGANIVVIARNVGEDVLEEIRQEGVDVIGINFDLSNFQEYESLVQKVIAEFGKVDILVNNAGVQIRHPSVEFPKNDWDTVIDINTNAVFFLCQAFGKHMLEQKSGKIINLASMLSFEGGYLVPAYAASKGAVKQFTQSLSNEWAKFGINVNCIAPGYFETEMNTAIIEDEKRYNSILERIPAGRWGKPEDLKGAAIFLASSASDYMNGFTIAVDGGYLGR

SEQ ID NO: 17186 - protein, 526 aa, Oceanobacillus iheyensis HTE831
MALVMVFIIWGAFFPANVEHVLGIVDTYISNTFGWFYLLVTTAFVLVALFLIFGPYGKIKLGKPDDKPDYSYFTWFAFLFTAGMGVGLVFYGVTEPVTHYYSPPSAEPETIAAAEESMQYTLFHWGLHPWATYAVLALALAYFKFRHRAPALISSTFAPLFGDRVKGPLGIAIDTLAVFATVFGIATSLGLGATQITAGLSFTFDGIENTLTTNLIVILIVTVLFILSATTGINKGIRYLSWANVVLAIALMLFVFVLGSSVQMIESFTTTIGNYIQNLPSMTLNMNAFTGEREFLNAWTLFYWAWWIGWSPFVGTFIARVSRGRTIREFVIGVTAVPVVFSALWFSIFGVAGLEMDAAQGGIIHQLMNELGNEVALFAFLESQPMAAVVIGVAVLLIASFFITSADSGTFVLSMLTTGGKLNPGIGIKAVWGIILASIAAVLLWSGGLTALQMAMLISAFPFAILMVLMCVSLIKALRSEHGIITIEKRQRQHDPQFREKQQKELKKMREGFKETLPDATEDRDL

SEQ ID NO: 17187 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 17188 - protein, 507 aa, Oceanobacillus iheyensis HTE831
MSGNQEVDVLSGKHEELANKLDDIKLYINGEFMDAEDRGTFDNISPFSNEKINSVASGQAADIDKAVQSAKKAFKGEWGNLKQVERLEYVYKIGDLIEQHTDEIAILESLDTGLPISQTRKQVSRSANNFRFYADTVKSQMYGEVYQVDDEFINYTVRSAVGVAGLITPWNAPFMLETWKIAPALATGNTVILKPAEWSPLTANRMAEIIDQAGLPDGVFNIVHGFGETAGDALVKHPDVQLISFTGETTTGSTIMRNGADALKRFSMELGGKSPIIVFEDADLERALDAATWGIFSFNGERCTANSRLYLHESIADEFIEKLKQRVWNIRVGDPLENNTQIGPLIKTEHYNNVKKYLKIAEEEGCEIISGVIPKELNRGNYVAPTILLNASNEMRVVQEEIFGPVIAVMTFNDETEVIEKANDVRYGLAGYVWTNDMKRGHRVAHAIDSGMLWVNSQNVRDLRTPFGGSKDSGIGREGGHYAFEFYTEQKIIHVAIGDHHIPQFGK

SEQ ID NO: 17189 - protein, 331 aa, Oceanobacillus iheyensis HTE831
MITITKTKQLTLIQAITDGMRTMLHEREEVVVLGEDVGKNGGVFRATDGLQEEFGEKRVFDTPLSEAGIIGSSIGMAINGLLPVAEIQFSGFIYPAYEQIMTHATRMRYRTKGVFTVPLVIRAPYGAGVRAPEIHSDSMEALFTHMPGIKVVCPSSPYDAKGLLISAIEDPDPVLFLEPLKLYRAVRGEVPEEKYEIEIGKGKYLREGDDVTVIAWGAMVPVAMKAAEQAAEKGITCEVIDLRTLYPIDRAIIAESVQKTGRCVVVHEAPATGGLGNDIISIVNDTSFLYMKSPIERVTGADVHVPFWALEEHNIPTPARVMDAINQVINF

SEQ ID NO: 17190 - protein, 325 aa, Oceanobacillus iheyensis HTE831
MFEMERSLSMELVRVTEAAALQSARWMGRGVKDEADDAATTAMRTVFDTIPMEGTVVIGEGEMDEAPMLYIGEKLGTGDGPGVDVAVDPLEGTEIVAQGTWNALAVIAIADRGTLLHAPDMYMEKIAVGPDAIGKIDINAPVVDNLKAVAKAKNKSIEDVVATVLDRPRHQKLIDKIRASGARIKLIPNGDVAAAINTAFDDTGVDILLGSGGAPEGVLAAAALKCLGGELQGKLVPSNDDEIKRCHDMGITDLNKVFYMNDFCSGDDAIFAATGVTDGELLKGVQFKGKKATTSTLVMRARSGTVRFIDGTHSLQKKPDLVIKP

SEQ ID NO: 17191 - protein, 190 aa, Oceanobacillus iheyensis HTE831
MKVLTIVAHPREESLTMKVTNRFIEGLQDAGHTVEFIDLYRHEFEAALPVADEPIWDAEEQHFSPEVTKEIERMKSADALAFIFPLWWWSMPGIMKGYIDRVWNFGFAYGNSNLHHEHVLWLGLAAADKKKLEKRKYNTMMEHYFNVGLADYCGIPSSTFHLLTETNKVNSQQLDNWLMQAYELGRNYEK

SEQ ID NO: 17192 - protein, 244 aa, Oceanobacillus iheyensis HTE831
MKLQDKVAVITGGVSGIGAATAKLFASEGAKLILVDMNEEKGASIEAELKSQGSEAIFIKADVTNEEQVKNIYTTAIDTFGKVDILFNNAGIGAVKPTEELTYAEWRKTVEVDLDGVFLVAQAAIKEFLKAGSGVIVNTASMYGWVGSPGSAAYNAAKAGVVNLTRSLGLEYAARNIRVNALCPGFIDTAILGDSDREALINTTPMNRLGKSEEMAKAVLFMASDDSSFMTGNSLIVDGGYTAQ

SEQ ID NO: 17193 - protein, 248 aa, Oceanobacillus iheyensis HTE831
MPDLNNQVILVTGANRGQGKAIAQHLASLGAIVGVAARKDEDAQEVAEMIGEAHAFPVQLDVTKELEWKTAVDEIINKFGRLDVLVNNAGALKRKPFKETTLDDYQQLINVNQLGVFMGMQAVIPQMEKQQKGSIINNVSISAFAPISQSSAYAATKSSVVAMSKAAAIELGPAGIRVNMVHPGGIKTDMVTQTEDVPAYYNSVPLKRIGQPVEIAKAIAFLASDESSYCTGTELVVDGGMTLGTADQ

SEQ ID NO: 17194 - protein, 848 aa, Azotobacter vinelandii
MALSNSGSADSKSLSGKASPRATRLQEQGASANGSIRQLLHRRSNQCVLSAGCISSRPGSAVHLRVDLLSHDGAADGADRPTCRKRAVSPYHHRRRSHRPGLRHMDDALHWHAGIRVAHACPLLDRLDPAVLAAGLRRFVARPAYAGPPRGRRPATGHERHIGRPGHRRHALQRHGCHADSAADVLRTGHLHPIHRCSDQSGRPRTVGKDGSLMPIRLAVGRVDLPDEVLFVGFVTDITDRYTLEASLRETAERAEQAAAAKSTFLANMSHEIRTPMNSIIGFTELLLQSNLSPVQRNHLNTIRQSSRSLLGLLNDILDTTKMEKGGLELERTDFSLKGLAMQIESSLYLGAQSKRLTLATHYPRDMPEHFQGDPLRLLQVLTNLVGNAIKFTERGRVDVVFSHEEDMVHVQVRDTGIGMTPQQAASIFAPFTQADASISRRFGGTGLGTTIAHQLVELMGGRIGVESELGRGSTFHVYLPLPPGRPPAPVDFGSEHPVLPALRILIADDVLQNLELLALTLESGGHRIEMAHDGDEAIEKFIANRFDVVLMDVHMPGTDGLQATQLIRQHERTHGLSRTPIIALTASVMADDRHAARQAGMDGFAVKPLDALRLFEEIARVLNIQSPSGLPDEASITANDSRRLIDWARGIALWGSEARLTTALSQFLNNVAEKYPLPDETTDDVDWKTTLSSLHGIHGAAGNLALSSVAELAGTLENLVRAGHRERLRERIADLLALLAAARRELPSNGYQHADATPAISPASPSPAPSELLPAMQALLDVLGHNELDDAILETVCSGLEIQNERAHAQALRAAVEAFEFQQAHALVQRLIAERSADVPSWGKDMA

SEQ ID NO: 17195 - protein, 481 aa, Azotobacter vinelandii
MMLSKERYKAAYVYWLCCIATLGGVMFGFSTGVISGSVELIQQYFHLSPAETGWIVSSIFVGCVLGALAAGKLADRIGRKSTLLLSTLAFAISAYGTTFADSFAIFSSARIVAGIGIGLASTVVPLYMGEIAPRDIRGKASGIWDLSLLGSQTLVFLVNFLIGKGMTEAWLVEVGWRWMMGAQFVPVALMLVCTLILPESPTWCIDTRRVERAIKVLSKIYPDLNHEEARQFFSARETAGGSLGLGVILRTPVLRYGLIVGCAIGVLQQFTGAAIVMYYAPVILQTGDMSKDALLFQTIFIGLFTGIASFVGMTLFDRFGRRPVMKFGTIGSIVGLLLISYSMYTHHSGYLSIFAALFFMAMFGISWSAGCWVLLSEIFPPRIRSHATGLAVTLMWAFNFLVTQFFPMINEIPVLQESFNGAFTMWIFVAFNLFCLFFLIRYLPETRGVALDDMEALIESHRRKLSRKTGETRTSIAVSDI

SEQ ID NO: 17196 - protein, 1027 aa, Azotobacter vinelandii
MGRHRRRPGRRPGLPALRHRHALPDRLPGRARRAGHDPILTLAGDCPMIRVARSPYERTLDGEAQRHAIDCLLNCYLREYALPRGEASLDSRAPDLPMSLRHAEGRCVGIRLADGSRLALLADRASVLGRCRFVSPPYFKGHDQGWRPLDATELARLLLAPLNGPERHGELLEQIDNSLRITRAFLTHARAANQRSGRHAPALRAGPGLGPCPAPDAEKPRRRLRGRPAGLLAGGRRAVPAALVPCRSGADPPPGRRPARPARPDRRRRRPLPLPSLGGFPAAGRPAGPPGARPRPAGIPRSAGPGALPDLLGAHPLPPGIEPFPEVLDPCAADQLRAQERLVRTGQRGGPDRPARSADARTDRQPAGLRADARAGRQHSGPVRPRQRGGGPRGHRVLRHPLPAEPRCGQPRALPATGRHGPVHLDPGRHQRLPGAGRALRGATRRGPGRSRVALAARLRRTAARRLAALPVPSRRGARTAPAEHPARLRRARPALPRVGPRPGRHQAGPRALAGRAPRPPRRAHPRLALLRRRQGLETGRLLQPGQQPRRGRVPSGGRRCGAGGTPVARNRRSPRSPARTARRSAGAARAVRRRAPAEQGKLHDPPADEGRPRGRLHRPAQPADRHLPWRMPMNLPASVQQAIAGLRRFHSEPLCAYVYDLPALARHARALRAALPAGCELFYAAKANPEAPILRSLAPWVDGFEAASGGELRWLHECHPDKPLIFGGPGKLDSELAAAMDCGISAFHVESIGELRRLAVVAKAHGRPAPLLLRLNLKLDEAPDSRLVMGGKPTPFGLDEEALDEALALLAGEPWLELQGLHFHLLSHQLDSAAHLQLMRSYFRCFRQLNARHGLDLKLLNVGGGMGIDYRDHARSFDWPGFCAGLAALIAEEGMAGTRIRFEIGRFLAAACGYYLMEVLDIKRNHGQYFAVARGGTHHFRTPAAQGHDHPFVVLRGERPAELENQPVTLVGQLCTPKDVLARQQPVAALAVGDLLVFPLAGAYAWNISHQHFLMHEPPRMLFLEA

SEQ ID NO: 17197 - protein, 1030 aa, Azotobacter vinelandii
MDLPGKTTGTDAKIPGANVKLGKPSTLASLLAVLLLLFSSLNAVRTVLLAQERREVLQALAHGVGSPATTGDGRDPEAFQAGEDIARGKALERLAARLERLDGQVDSAMRIVAATLLPGLLLAAFALHGRHRRRSPRDQPRTPPEQAGSDESELQRVLFDSIPFPLFVKDREARYIRFNRAFLNNFRVRAEELTGKTILDFLELPAEERSRYQAASERLLREGGLFSTERRIRYADGREHPSIYTLAGYPGGDGRPAGLLGMLIDISAQKASERALAEAKELAEEATRMKSDFLANMSHEIRTPMNVIMGMTQLALDSGLDERQRNFVEKAHDAARSLLGIINDILDFSKIEAGKMRFEQVDFQLESVTDHLADLSVLKAQEKGLELLFDIATDVPTALIGDPLRLGQVLSNLLDNAIKFTSRGEITLRIRKECEDERGVRLRFEVRDTGIGLNETQRRKLFRAFTQADSSTSRQYGGTGLGLAICKHLVAMMDGEIGVDSSPGVGSTFHFDARFERQANQRELLADSADLLGMRVLVVDDNASALEIFAGMLSALRFAVTTADNAPQAIRLLERAQQEDNPYRLVIMDWLMPGMDGVQAVGAIRAAPRIAETPLFVMVTSYGRDELLERLGKVPVEGLLVKPVTPSSLLDGILDACSRRMRTAPNSRKALESEAEQAREALRGVHLLLVEDNPVNQEMAMELLATAGIRVDVANDGAEAVGKVMAHAYDGVLMDCQMPVMDGFEATRRIRRAGLVDLPILAMTASTMAGDRERCLAAGMHAYIAKPIDVAQLFVTLRHWVGSGRPLALPAPLAIGGSVPTASANTALERAGALRRLGGNRALLDRLLARFAATQADAAARLGAALAAGDREGARRIAHTLKGLAGNIGATELATQAATLEQCLGQNRQPPAETLDDLERTLGALCASIAAPAAGNPAPIVAETPQELSALDEGLRTLEALLRDDDADAVAQLRALGPRLAARGLGERAGELQALVARYDFEAALASLAAIRRNLAPRDAEAAGPQRPRR

SEQ ID NO: 17198 - protein, 387 aa, Azotobacter vinelandii
MSIKIEDYYPPATFQRMKAFADKQETPFVVIDTEIIANAYEELGDCFPFARIYYAVKANPAVEIIRLLRDKGSNFDIASRYELDKVMAEGVGPERVSYGNTIKKAKDIRYFYEKGVRLFATDSEADLRNIAKAAPGSKVYVRILTEGTASADWPLSRKFGCQPDMALDLMILARQLGLVPYGLSFHVGSQQRDIDVWDAVIAKVKVIFERLKQEDGIELKMINMGGGFPANYITKTNSLQTYAEEIIRFLKEDFGEELPEIILEPGRSLIANAGILVSEVVLVSRKSRTAVERWVYTDVGKFSGLIETMDEAIKYPIWTEKKGEMEEVVIAGPTCDSADIMYENYKYGLPLNLASGDRLYWLSTGAYTTSYSAVEFNGFPPLKSYYL

SEQ ID NO: 17199 - protein, 923 aa, Azotobacter vinelandii
MTRPGGGMGMVRIVWTLLLLLSCSASALAVQPAVLADREVRLSLGPYTLYVEDRDADLDAAQVLAMPESAFRPVEGDQANLGQSRSAWWFRVDLQNARDQSLGGFLEVNYPLLDDVRLTVLTPDGRQLQQESGDTRPPGMRPVPIRNLWFPLELPPGTSTLLVRVKSSSAITIPLYFGTSGASLAAHERQEGLNGVFYGVLLALFCCQLFLFLFLREPSQGWYLVYSLNSILLALGFDGYLFQWPPGLQHITVLLLIFSFWLTATQLTRHFLNIPQYFPLLDRILRLWMLGLGAVLLAAPLIGLSAWTTLAHFATLIGALLLPSCGAHVWRKNLRAGAYHLTAWALLLVSLGGQAFAELGLDLLGEHATMLAKIGIASNLLILAVGLADRFQQLRREGLYSHRAAEEALLQNQAKSRFLAKMSHEIRTPLNGVLGMLQLLKETRLDHSQRFYVDTIASSGSTLMAVINDILDYARIESGKLSLEHIEFDLEEMLSDTLNLFTAQAMEKRLRLHMSLDEGVPRHIQGDPTRLKQVLTNLLSNALKFTSEGQVRLDVSRRRKSDGSEHLYFGVSDSGIGIRQEAQARLFESFSQGDSSTTRRYGGSGLGLAISKELVEMMGGHIEVQSTPGLGSRFTFNLPLQRGGEMRDELFQLLAGRTALLASLDGFALDAIGRLLGRWGMNTERCRIPEKLPEQLASFDEPPLLLLIAPWPGSVEYWLDALYPHLAPGQRLLLICPPEQCRQLPASRSSLHMLGLPQPVGVAALRKKLVELHMEPSHALVPIEDHAGESHIPCILIAEDNPVNQLVVQELLKKRGYNVRLAGNGAEAVAEYHRAPSSIQMILMDCEMPEMDGFEATLQIRLLERLRKWPAVPIIALTAHTLDEHREYGLEVGMNDFLGKPVDKQLLHATVERYLSTRTLVDN

SEQ ID NO: 17200 - protein, 499 aa, Azotobacter vinelandii
MQASNDTRSNYAPDSSYGLFIDNQWVAGENGETITILNPANGKTLTGIPNATAVDVDRAVQAAQRAFEAWRSTTPIERANALLKIADLLEADAERFAALESLDVGKPIRESSSVDIPLAIDHFRYFAGVIRSHSDEAVMLDEQTLSIVLSEPLGVVGQVIPWNFPLLMAAWKIAPAIAIGNTVVIKPSELTPVSILELAKIFAQVLPAGVVNIVTGTGASAGQALLDHPDVRKLAFTGSTSVGHRVADAAAKKLIPATLELGGKSANIVFPDANWDKAVEGAALAILWNQGQVCESGARLFVHESIYERFLDEVKQKFEAVRVGDPLHPDTMMGAQVSKTQMERILGYVDIAKQEGAKVLLGGGRLTGADYDAGFFIQPTILVDVRNDMRVAYEEIFGPVLCVIPFKDEADVIAMANDSEYGLAGAVWTQDINRALRVARAVETGRMWVNTYHEIPAHAPFGGYKKSGLGRETHKSILEAYSQKKNIYVSLNEAPLGLF

SEQ ID NO: 17201 - protein, 423 aa, Azotobacter vinelandii
MLDLAAAFIALTTLFTYLNYRLIRLPPAIGVMIGALLLSLLAYGLSALGYPVLELEIQEMIRRIDFSDILMTWFLPALLFAGALHVNLDDLRSYKWPITFLATGGVLIATFVVAGLAHYTFALFGWQVSFIYCLLFGALISPTDPIAVMGILKSSGAPKPLQTTIVGESLFNDGTAVVMFSILLGVLMIGHTPTIGEVSLLFLKEAIGGIVFGLLLGYVVYLLLSKVNEFQPSVMLTLALVFGGASLAAKLHVSAPIVMVVAGLIIGNHGRHHAMSEESRRYVDGFWVLIDEILNALLFALIGLELLVLPFTWLHVVAAILLGGAVLLARVLTVGPGIILIRQLKSVQLQVAPGTVRILSWGGLRGGVSVALALALPLGPERDLLLTLTYIVVLVSILVQGLTIGPLVKSLYGSNPVEAEEAH

SEQ ID NO: 17202 - protein, 383 aa, Azotobacter vinelandii
MCVACGRLARRRSWRWPVLLLDESDRRFPVLSRRAAAASAPGGSSAGPHGGGIRRCARTRKNGSSLLRGGYARGRFPPRVRSGRIPSTCYSRCKVNVMTENEQTLPPQHQDRRPGKESAMHPRPAYRAEDYKAAGKLEGKVAVISGADSGIGRAVAVVFAKEGADVVVLYLDQPEDAEETRREVEKLGRRCLTLAGDVADADFCRQVVEKTMQQWGCLDVLVNNAGEQHPQERLEDIGEEQWEKTFRTNIFGMFQLTKAALPSMREGGAIINTTSVTAYKGHPKLIDYSSTKGAITAFTRSLSANLAPLGIRVNAVAPGPIWTPLIPSTFSEEEVAHFGASTPMKRPGQPEEVAPAYVYLACNDSSYVTGQVLHVNGGTVVNG

SEQ ID NO: 17203 - protein, 661 aa, Azotobacter vinelandii
MIEYPHIDQRQRLLQPPGQAEVRLARLGDAGRMVVGEDQRGGVVRQGALEHLARIDAGAVDGALEQHLESQHPMLGVEEQAAEDLVGLVAQARLQVIAHRLRALQRRIAAQALGQVPAGHFQHRLQLGELGRTEAEAAAERGPIGLEQGTQAAEIVQQVAGQIHRGLPGDPGAQEDRQKLGIAQRRRPLLQQFFPRPLRRRPVPNAHAASLSSRPATPGARLCYLSRHFVPGRDEEHIQAVRLPGSRGHAIMKTTQGRPMQRLYRKRIVLGVGGGIAAYKSAELVRRLRDQGAQVHVVMTRGGREFITPLTLQALSGHPVHLDLLDPAAEAAMGHIELAKWADLVLIAPATADLLARLAQGMADDLLTALVLATDAPVALAPAMNQAMWRDPATQANARTLAERGLRLFGPAEGSQACGDVGPGRMLEPAELAERAADCFAGGRLTGRHVLITAGPTREDIDPVRYISNHSSGKMGFALAEAAAEAGARVTLVSGPVHLPTPDRVERIDVISARDMLAACEAALPCDILIAAAAVADYRPQAVAPQKLKKSPDSDDGLILQLVRNPDILATLAQRADRPFSVGFAAETENLREYALRKLKTKNLDLIVANDVATPGIGFNSEENAVSVIDRAQRETRFARTGKGKIARQLIAFIADRFDQA

SEQ ID NO: 17204 - protein, 917 aa, Azotobacter vinelandii
MFHDFSIKTRIAMLTLLPSCLLALVLGSYFTWQQLAEMHGNLVGRGQLIVQQLAPLAAPALAQNYHNRLQRIANRVLDQTDIRAVSFLDSELGTIVHAGPSLNGPLPPQDPTQLTMVRDNSATHLLMPVLGYHQNLASGSNDRDDHLLGWIALEISHHNALLQGYRNLLASLLLILSVLLVSAFLALRVGRSISDPLRRIQQGVSQLRDGHLETRLPSLRSHELDELAAGINRMAEVMQHAQEEMQNSIDQATEDVRQNLETIEIQNIELDMVRREALEASRIKSEFLANMSHEIRTPLNGIIGFTNLLQKCELTPRQHDYLNTIQKSADSLLDIINEILDFSKIEAGKLVLEHTPFNLRELIQDTLTILAPAAHAKHLELVSLIYRDTPLALNGDPQRLRQVLTNLISNAIKFTNEGTIAVRAMVEDIGEEFAQLRISVHDTGIGLSQEDLNALFQAFSQADNSLTRQAGGTGLGLVISKRLIEQMGGEIGVNSVPGEGSEFWIRLSLPLDDHSEDEPPTALHGHRVALLEQHELARQSIQHQLEDCGLEVQPFAELDSLLAGVAAARQEERPVGLAVLGVTSRDTSAEELAQRIADLERLGCKCLVLCPTTEQMFYQEVLPEAQIQLQSKPAHRDKLQAALGELLTPQPTGSQTLGPLGNRAPRLLCVDDNPANLLLVQTLLGDMGAAVTVADSGHAAVEAAQRERFDLIFMDVQMPGMDGRQATRAIRQWEAGQPEQRHTPIIALTAHALANERRALLQSGMDDYMTKPINERQLAQVVHKWTRLHLRSPGAQQVHEVQPASIGHLSVLDSEEGLRLAAGKPDLAADMLSMLLASLDADRQAIHQARRDGDRAALIERVHRLHGATRYCGVPQLRAACQHSETLLKQHAPAADTALDELDAAILRLAGEAKFGA

SEQ ID NO: 17205 - protein, 459 aa, Azotobacter vinelandii
MPPEPRLRRLRRELRALADLALPIVVAQLAQIAMGFVDTLMAGRVGPEALAAVALGNSFWVPAYLLSTGILLATTPRVAHLRGAGRQPEIGPLVRQALWLALAAGSAAALLLWNVEPALHLMRVEASLIEPTMGYLRAVACGIPAVALYYVLRCFSDGLGHTRPSMLIGIAGLLLNIPANYVFIHGKLGLPAMGGVGCGWATALVMVFMLLAMLFWVRHAPHYRPSRLFERFDRPCWPELRRLLAVGLPIGVAVFAEASIFSVIALLIGGLGAQVVAGHQIALNFSGLVFMVPYSLGMAVTVRVGHALGRGSPRDARFSAGTGIIAALGFATLAAGLMLLLRERIPHIYSSDPAVIAIASSLLLYSALFQFSDAIQVTAAGALRGYQDTRAIMSITLLAYWGVGLPIGYGLGLGGWLDESSGPRGLWQGMVIGLSCAALLLGARLIRSARRHIHGPAAA

SEQ ID NO: 17206 - protein, 290 aa, Azotobacter vinelandii
MRPGQGAFRIEQALCQGHQYPQPGYPRGLRCGSCRAGLNKEMRMSLQGKVALVTGASRGIGQAIALELGRQGAVVIGTATSSSGAESIAETLKSNGIEGAGLVLDVSSDESVATTLEHIQQHLGQPAILVNNAGITRDNLMLRMKDEEWHDVINTNLNSLYRLSKAVLRGMTKARWGRIVNIGSVVGAMGNAGQVNYAAAKAGLEGFSRALAREVGSRGITVNAVAPGFIDTDMTRELPEAQRNALLGQIPLGRLGQAGEIAQVVAFLASDGASYVTGATIPVNGGMYMS

SEQ ID NO: 17207 - protein, 407 aa, Azotobacter vinelandii
MSNEIFLAIGMFTAIVLALVVIILAARARLVSSGDVSIEINGERSITVPAGGKLLQTLAANNIFLSSACGGGGTCAQCKCVVESGGGEMLPTEESHFTRRQAKEGWRLSCQTPVKQDMRIEVPEEVFGVKKWECTVESNPNVATFIKELTLRLPEGESVDFRAGGYVQLECPPHVVHYKDFDIQEEYRGDWDKFNMWRFVSKVDETTIRAYSMANYPEEKGIVKFNIRIASPPPNRDDIPPGKMSSFVFNLKPGDKVTVYGPFGEFFARDTDAEMVFIGGGAGMAPMRSHIFDQLKRLKSKRKMSFWYGARSLREAFYVEEYDQLQAENPNFRWHLALSDPQPEDNWTGLTGFIHNVLYENCLKDHPAPEDCEFYMCGPPMMNAAVIKMLLDLGVERENILLDDFGG

SEQ ID NO: 17208 - protein, 772 aa, Azotobacter vinelandii
MNIAPTNRLSYKQASLAVLAAFVLGTLLSLAKISLDYASQSASIEREINSLQQISLNPAARIAYNIDAELAQELLLGLLRSPAVIGAEIVGSDQRPLAAVSRPAMNSEYRVFSDMLFKPRRYFEAPLSIAHAPDEALGFLRLEIDTYAFGSAFLERSGLTLLTGFASSLLLALLLLVVFNRMLTRPLIGIIQRLSEHNPNESRPLPCPPRHESDEIGILVQAINQLLRKTGQEIEQRREAENRLTEYLGELENMVSARTAELEAANARLTQSNRDLEAARSTALEMAQARSAFLANMSHEIRTPLNGLLGMLSLSLDGPLSNEQRQQLSVAHASGKVLVRLLNDVLDLSKFESGQMELERIPFDLGALIEDATALLSQSAAPGVELTCLIDPGLPTQVIGDPTRVRQIASNLISNALKFTRFGRVDVCLQASSENVRLVIRDTGIGISREAQTRIFQPFAQATANITRQYGGTGLGLALTRKLCEAMQGQLTFFSKEGLGSTFTVELPLPCHTPATPRVPLHGRVIGMTPGSSGLAQLLEMHLPGWGLEYRRLDIGSGLAGVGTDLLITDCPQCLLGMRPAVSAPFLVVAAYGSFLPREETHALAPLQQLARPLSRAALYQAVVRALQAVEEPQPAALEAVQATPRQRQVLLVEDNPVNQMVAKGMLAKLGYEVAIAPHGAEALSYLEHGPVDLILMDCNMPVMDGYETSRRIRQDGRWSELPIIALTANVLPEERERCRTAGMNDYLAKPLRREDLANMLHTWLPGGANAT

SEQ ID NO: 17209 - protein, 327 aa, Azotobacter vinelandii
MSNKPKAVFDGVSHTPEVPAPRPVNWQLEQIVDELRAARADWRKNCGRTRELGSRELPSRQTVAEILAALSGALFPMRLGPSDLREESEDFYVGHTLDSALNALLGQVRLELHYVARQCGQREPDLETRAVQIVREFGAALPEMRRLLDSDVIAAYQGDPAARSLDEVLICYPGVQAVIHHRLAHLLYRSGVPLLARIVAEIAHSATGIDIHPGAQIGHSFFIDHGSGVVIGETAVIGNRVRIYQAVTLGAKRFTVDESGQLLKGQARHPIVEDDVVIYAGATILGRITIGKGSIIGGNVWLTRSVPPGSNVTQATLQHQPGNAGQP

SEQ ID NO: 17210 - protein, 265 aa, Azotobacter vinelandii
MEHRAMNVLLVYAHPESRSLNGSLKDFAIQRLERAGHTVRVSDLYAMNWKATLDADDNTARQPGARFDPSMDSRQAFENGTQSTDIAREQDKLRWADGVILQFPLWWFSMPAILKGWIERVYAYGFAYGVGEHSDTHWGDRYGEGMLAGKRAMLVVTAGGWASHYEPRGINGPIDDILFPIQHGILFYPGFDVLPSHVIYRTSRIDEAGFSKACDALGQRLDDLWTADPVPFRRQNAGDYLIPELTLKPGLAPGRSGFDIHVERD

SEQ ID NO: 17211 - protein, 665 aa, Azotobacter vinelandii
MPRSRSPASWRKRSWRCQSSSRALLSASLTGGKCCQGWRDSASRRAAPSTKRCSSKPSRPRSMPPRFSLVSSICLKIAWRLPSGESGSTPSQATRARAITPGRSGLKIMVRAGMAGEGRRLSSASPAIARSAALLGFAGAGGYNRADFPRPTPLWPFPPPFRGALQQACQRPVRLGRGVFRTHQRRPFAHYEWRLCMSAVMTPAAFTDYKVADISLADWGRKEIIIAESEMPALMGLRRKYAAEQPLAGAKILGCIHMTIQTAVLIETLIALGAEVRWSSCNIFSTQDQAAAAIAAAGIPVFAWKGETEAEYEWCIEQTILKDGKPWDANMVLDDGGDLTAILHRKYPQMLEKVHGITEETTTGVHRLYDMLKAGTLKVPAINVNDSVTKSKNDNKYGCRHSLNDAIKRGTDHLLSGKQALVIGYGDVGKGSAQSLRQEGMIVKVSEIDPICAMQACMDGFEVVSPYLNGENDGSEACIDKVLLGRIDLIVTTTGNVAVCDANMLKALKKRAVVCNIGHFDSEIDTAFMRANWAWEEVKPQVHKIHRTGPDGFDPHNDDYLILLAEGRLVNLGNATGHPSRVMDGSFANQVLAQIHLFGVRFADLPAAEKAGRIGVEVLPKKLDEEVALEMVKGFGGVVTRLTGQQAEYIGVGVDGPFKPDSYRY

SEQ ID NO: 17212 - protein, 831 aa, Azotobacter vinelandii
MMGPGIAGHPDPTLSLIFTGQARIVRKGSSSDFPTPSGEFILVEYVVSLDKLGVHDVERVGGKNASLGEMISNLSGAGVSVPGGFATTAQAYRDFLEQSGLNNRIHAALDVLDVDDVNALAKTGAQIRQWVMEADLPAQLDADVRKAFAEMAGGNEHLAVAVRSSATAEDLPDASFAGQQETFLNIRGVDNVIRAVKEVFASLFNDRAIAYRVHQGFDHKLVALSAGVQRMVRSETGTAGVMFTLDTESGFRDVVFVTGAYGLGETVVQGAVNPDEFYVHKSTLEAGRPAILRRNLGSKAIKMIYGEEARAGKSVKTVEVSGADRARFCISDVEVSELAKQALIIEKHYGRPMDIEWAKDGDDGRLYVVQARPETVKSRDSATVMERYLLKEKGNILVEGRAIGQRIGAGPVKVIHDIAEMDKVQPGDVLVSDMTDPDWEPIMKRASAIVTNRGGRTCHAAIIARELGIPAVVGCGNATTVLRDGQGVTVSCAEGDTGYIFEGELGFDIRKNSIDAMPHLPFKIMMNVGNPDRAFDFAQLPNEGVGLARLEFIINRMIGVHPKALLNFAGLPPEIKGSVEKRIAGYGDPVGFYVEKLVEGISTLAAAFWPKKVIVRMSDFKSNEYANLIGGKLYEPEEENPMLGFRGASRYISESFRDCFELECRAIKKVRNEMGLANVEIMIPFVRTPGEASQVIDLLGSHGLKRGENGLRVIMMCELPSNALLAEEFLEYFDGFSIGSNDLTQLTLGLDRDSGIVAHLFDERNAAVKKLLSSAIQACNKAGKYIGICGQGPSDHPDLAKWLMDQGIDSVSLNPDSVLDTWFFLAEGLGN

SEQ ID NO: 17213 - protein, 403 aa, Azotobacter vinelandii
MNTSFWKAGHTPTLFAAFLYFDLSFMVWYVLGPLGVQIATDLGLSTQQRALMVATPILSGAVLRFVMGMLADRTSPKSAGILGQAIVIAALGLAWSMGIHNYEQALLLGLFLGFAGASFAVALPLASQWYPPQHQGKAMGIAGAGNSGTVLAALFAPGLAGAFGWNNVFGLALIPLVLTLVIFAGVARNAPERPQPKAVADYLKALADRDSWWFMLFYSVTFGGFLGLASTLPGYFHDQYGFDPVKAGYYTAACVFAGSLLRPLGGALADRIGGIRTLLVMYTLAALCIAVVGFNLSSSSAALALFVVAMLSLGAGNGAVFQLVPQRFRKEIGVMTGLIGMAGGIGGFALTAGLGAIKQSTGDYQIGLWLFAALGVIAWIGLHGVKKRWRTTWGSAAVTAARV

SEQ ID NO: 17214 - protein, 776 aa, Azotobacter vinelandii
MEAPDNTTRRPRSARQLAPLLERRQRMLLATDLDGTFLAGDPQDRLSLYQTITAHPDIQLAYVTGRSLEAVLPLLADPTLPQPDYIVADVGASLYHGETLQPIQPLQHDIDARWPGESQIAGALAGLPDLQRQDVPQARRCSYFCTPERAADPALEVIAERLGCDLLYSAGRYLDFLPRGVNKGSSLLRLVEHLGLDPEQVLVAGDTLNDLSMLTCGLKGVCVGQAEESLLEHTRHCTRVLHADSPGCGGIIQAFAHFGFLGVHGFAAETRKATEPGHAELVIVYHRLPYEEYREHGQVQRRRPSSPNGIIPTLLSFFADGRKGSWVAWAEHEEGQGLFESHTTVDAERYPRLTAARVPLCKEDIDTFYKRFSKEAFWPTLHTFWERAVFNEDDWQVFLRVNRAFAERTALEAAEGATVWLHDYNLWMVPAYLRELRPDLKLAFFHHTHFPSADVFNVVPWRRQIVGSLLQCDYIGFHIPRQVENFVDVARGVAPLKVLGRQNCAPRFVTYGCAVGLERVTTAIDTGMRQVRLGAHPVGLDLDRVRNALASPSVQNQMEQLRRELNGVRLVLAVERLDYTKGVLEKLKAFERLLADNPELQGRITLATICVPAAREMTVYDELQGQIEQAVGRINGRFARVGWTPVQFFFRSLPFEEVVAWYAMADVMWITPLRDGLNLVAKEFVATQGLLDGSGVLVLSEFAGAAAELKGALLTNPHDIADLVQNCHLALNLPKSEARARLRELFDIVAFNDIRRWGDEFLGALEEPRTDIRAIA

SEQ ID NO: 17215 - protein, 503 aa, Azotobacter vinelandii
MPRAAPTPCASCAWATSSIERRGLRCNRANLRTGRATSTSAPRMPNNRSCSPRARPFQPLHRTRHTMSNPSTSIQHVAAREILDSRGNPTVEAVVTLAGGATGVASVPSGASTGSREALELRDGALRYQGKGVMKAVDNVNGAIRERVVGLDALDQRAVDQAMLERDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKAFDSRGFADYLAGLCERYPIVSIEDGLDESDWAGWAYLTEKLGDKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCSR

SEQ ID NO: 17216 - protein, 322 aa, Azotobacter vinelandii
MRGPFRPARPADSRPGWPGGSTPNDDRSSARAFSSCPCPDRPPLSRKRPPRQRPAPKPSTNSMNRSRKAHFSSTSLRTSLADGDTPSPHRRDSMITLRPADERGHANLGWLDSHHSFSFADYYDPRHMGVSQLRVINDDRVAPRSGFDAHPHRDMEIVTYMLEGTVEHKDSMGNSSRLRAGEVQVMSAGSGVVHSEYNPSASEPLHLLQIWIQPRESRVPPRYAQKDFSNLRGLGLLVSPDGREGSLPIRQDACLYLARLDDRQRTSQPARTGRTYYLHVASGSLQVNGVSLAAGDGATLVDEPAIELEARDKTEALLFDLP

SEQ ID NO: 17217 - protein, 284 aa, Azotobacter vinelandii
MPEMVMNNNNGNWLGLDSAVCVVTGAAGGIGREIAAALVGQGARVVLLDRDEAGCAHLAERLSVGAAEPVQVLACDIADPESVRRAAALVESRFGGCDVLVNNASVLQPGGIEDIDLEKWNRVLSVNLNGYLLCSQAFGRSMLARGRGRGRIVHIASIAAHAPQTWSGAYSAAKAGVCMLSRQIASEWGARGVRSNVVCPGLIRTPLSAAFYADPQIERQRCAMTANGRIGEPGDIADAVLFLASPRADYVNGAELTVDGGLESMPMALIPRPGFESPVTVRQD

SEQ ID NO: 17218 - protein, 364 aa, Azotobacter vinelandii
MSVTREAVETALRQYFDPHLKQDPVSAGCVRDITIRDGQVGVRLELGYAAGLFKDGWAQLLETGLKSLDGVREARVQVDSVIAPHKALEQVQGLQGVKNVIAVASGKGGVGKSTTAANLALALAREGARVGMLDADIYGPSQGIMFGIPEGSRPQVRDQKAFIPLQAHGVQLMSMAFLTDDDTPMVWRGPVVSGALMQLATQTDWDNLDYLVVDMPPGTGDIQLTLAQKVPVAGAVIVTTPQDLALLDARKGVEMFRKVNIPVLGVVENMAVHICSNCGHAEHLFGEGGGEKLAARYNVELLASLPLSMEIRSQADAGRPTVIADPDSPVTLIYQQMARSVGARIAQSGQIVAQSMPKIVISED

SEQ ID NO: 17219 - protein, 264 aa, Azotobacter vinelandii
MLIDLSGKTALVTGSTGGIGLAIARGLAEAGATVIVNGREQARVDAALAQLRDTKGGAAARGLACDLGTAAGCQALIAAEPEADILVNNLGIYGAREFFEITDEEWEEIFQVNVLSGIRLSRHYAKGMQARGWGRIQFISSESALNIPAEMVHYGVSKTALQGVSRGLAKVLAGSGVTVNSILPGPTRTEGVIAFIGEMARQEGVSPEEMERLFIQRHRPSSLLRRFAEPAEVASLCVYAASPQASATTGAALRVEGGIVESIA

SEQ ID NO: 17220 - protein, 957 aa, Azotobacter vinelandii
MLELNAAQIRMGRAAPDKLAALALLAEGLVDDGLVEPGYLTGMQAREAQGSTYLGQGIAIPHGTPETRDQVKRTGVRLIQFPDGVDWGDGQQVYLAIAVAARSDEHLHLLQLLTRALGEGDLSQALREAGEPEQLVALLQGAPRELALDSQLIGLGVAAEDFDELVWHGARLLKRAGCVASGFAGSLLQSQPLPLGEGLWWLNSEQAVEQPGLAFVTPARPLVLHGQPLTGLFCLASLGEAHRQLLERLCDLLIEGRGATFSQATCSRAVLEALGAELPEDWPSLRVTLANAHGLHARPAKALVEVAQSFDGEIRIRLAGESGRGVSAKSLSKLLALGARRGQALEFSAEPAIAADALPAIEAAVLAGLGESIEPLALPGETPPSEEPGTSTFVRPRAPAAGTRLQAVAAAPGIAIGPALVRTPLELDYPQRGQGMLVELQRLDSALAQVTADIQRLIDDSEEANVREIFITHQAMLRDPTLREDVNARLADGFSAEAAWSVETEAVAQQQEALHDALLAERAADLRDIGRRVLAHLCGVEAPREPDEPYILVMDEVAPSDVASLNRLRVAGILTARGGATAHSAIIARALGIPAIVGAGEAVLALAQGTPLLLDGDHGVLRVAPDAQTLEQARREREANRLRRERAHAERMLPAVTRDGHAVEVAANIGASGESAEAVELGAEGVGLLRTELVFMDHAQAPDRHAQEAEYRRVLDGLGGRPLVVRTLDVGGDKPLPYWPMPAEENPFLGVRGIRLSLQRPDILETQLRALLASADGRPLRIMFPMVGGVEEWRIARDLALRLREEIPVDDLQLGIMVEVPSAALLAPVLAREVDFFSIGTNDLTQYALAIDRGHPTLSAQADGLHPAVLRLIGMTVEAAHAEGKWVGVCGELAGDMLAVPLLVGLGVDELSVSARSIALVKARVRELDLAHSRALAQRALALESAGAVRDLVGETH

SEQ ID NO: 17221 - protein, 271 aa, Azotobacter vinelandii
MLLLRPRARPGEPTPSLKEKSMDLQLQNRNVLVTGGTRGIGRAIVEGFLREGARVAFCARDPQGVAQAERELGAQAFGQAVDVTDGAALEQWVKDAAARLGGIDIVVPNVSALAGGQNLSAWRQAFETDLLGTVGLVNAALPWLERSEAGAIVIISSVSGRQIDLFAEPYGALKAALIHYGKGLALRLAGQRIRVNVVSPGNVYFEDGVWGRIEREQPELFARCLAANPMGRMARPEEVANATLFLASAAASFTTGTSLLVDGGLTQAVQY

SEQ ID NO: 17222 - protein, 415 aa, Azotobacter vinelandii
MRAGAQEPPRYRHRYRYPRHPGHLRAGRAGLGAPGGLAEERGRRRGVHSRGRYPRRRTAQASAQLRGAESRRTRSQPQSGAGQAFRGAHGAQHVPRSGYRAGGLAEPSAARPHPCLLHQDQAQPAACRAAGFLSAVVRARQSRTGRRRNGMSLLTQWRDDIRCVFERDPAARTTFEVLTTYPGVHAIIGYRLANRLWRAGWRYPARLLSFVARMLSNVDIHPGATIGERFFIDHGACVVIGETAEIGNDVTLYHGVTLGGTSWNKGKRHPTLRDGVLVGAGAKILGPITVGAGARVGANSVVVQDVPDGCTVVGIPGKVVKVREAGRPNPYGIDLDHHLIPDPVGKAIACLLERIDALEKQVEAGGLVTVGSQQQFYQVCNSDNSICESDCAGGTTAQAQQSAGRRRAVPTPVAE

SEQ ID NO: 17223 - protein, 624 aa, Azotobacter vinelandii
MNGMHCKTSRRTFVKGLAAGGVLAGFGLWRPPVWALGGPARPALLSGSEFDLSIGEAPVNITGKPRIATVINGSLPGPTLRWREGDSVTLRVRNRLDEDTSLHWHGILLPANMDGVPGLSFDGIAPGGLYQYRFKVKQNGTYWYHSHSGFQEQTGVYGALVIDPREPEPFRYERDYVVMLSDWTDENPARVLKKLEKQSGYYNFHKRTLGDFIGDVGEHGWAATVAERRAWAAMNMTPTDLADVSGHTYTYLLNGRSPAGNWTGLFRPGERVRLRLINAAAMTYFDVRIPGLKMTVVAADGQYVEPVSVDELRIAVAETYDVIVEPRDAEAYTLFAQSLDRTGYARGTLALREGLEAPVPEPDPRPILSMADMGHGGMEHAAHGGRPAGADHAGHGSTAHAGHDGADMDHGGTSHGEMAGMHPMEMNHDDMAGMAHGAMEHAGTERAAPGMQAHPASETGNPLVDMQTMTPTAKLGDPGIGLRDNGRRVLTYADLRSAFADPDGREPGRTLELHLTGHMERFSWSFDGIPFADAEPLRLKYGERLRIVLVNDTMMTHPIHLHGMWSDLEDEQGNFLVRKHTLDMPPGSRRSYRVTADALGRWAYHCHLMFHMETGMFREVRVEE

SEQ ID NO: 17224 - protein, 933 aa, Azotobacter vinelandii
MRRPWNATTLIVSLLLVVLAALPTLAGSLLRSDEQFGPLGPGAPNGDWRILLDESASLTLKDVIERRDHFAPLGHRSLTLPANQAAWLRVSIAGHDTPRWIWVFAPRVDRVDFFLTNRGATERRIETGAMLPDGLSTSGQAHLFDLPTDQTTREVWLRLAPRQAAPAWFDYVDTAGLLDKNKLAYTLGALLSALALGMIYHLVRFGYNRVLCNLWLSAMQGTLLLSAIAHFGLLGAWLPQLGHYQIRVADITALLSFLFLLQFTRSFFDQEESPRLLDWLLRGEIAVLALAAVLDGASPHDMLRSGLILLASLSATGCALYHWLHGYRPARLALVGTLLFHLGFSAYLSMLLDFGQFGPCWQIFALFAFTAASGLLLVFALAERQCKIERDRAAWRTSEAASSAELRAKSEFLAKLSHEIRTPMNGVLGMTELLLGTPLTAKQYDYVQTINSSGNELLSLINDILDISRLESGQIELDDVQFDLNGLIEDCLGIFRAKAERRHVELISFIQPQVPRVINGDPTRLRQILLTLIENAFRQTDEGEILLKVSLETEGPRPNLHVAVQDSGEPMPESRREAMLNSRVQSSDLLSAAQIDGSLDLIIARQLITLMHGICGIDADPTRGTTLWLSLPLDPARLEHPVADLDSPLQDARLLVVDDNDTCRKVLLQQCGAWGMKVSAVSSGKEALALLRTKADLGEYFDAALLDQNMPGMSGLQLAQRIKEDPGLNHDILLVMLTGLSDAPGRVYARNAGITCSLAKPVAGYTLKTTLAEELGKRRAARPAASGLEENAPLEVPSDFRILVAEDNSISTKVIRGMLRKLNLQPDTASNGEEALQAMKAKQYDLVLMDCEMPVLDGFAATEQLRAWEASELRPHTPIVALTAHILSEHREHAQRVGMDGHLAKPVELSQLRALIEHWVERKEESYRHALHP

SEQ ID NO: 17225 - protein, 198 aa, Azotobacter vinelandii
NRARYHLSYLRCIPGMLVMTPSDENELRRLLTTGYLFEGPAAVRYPRGSGPNAPLEPGLEPLPIGKGVLRRRSGKSDGPRVALLVFGVQVAEALRVAGKLDATVADMRFVKPLDEELVRELAAGHELLVTVEENSIMGGAGSAVAEYLAEAGLLRPLLHLGLPDYYVEHARPAEMLAECGLDAAGIEAAVCERLNMLS

SEQ ID NO: 17226 - protein, 440 aa, Azotobacter vinelandii
MTHATPDDSLHAGTMARLNLKLIPFLMLLYLIAYIDKANISVAALQMNADLGLTARMYGIGVGLFFVTYILLEVPSNLILSRVGARRWIARIMITWGLVAAGMSLVRSADQLYVMRLLLGAAEAGFTPGIIYYLAQWYPRSDRARAMSFFYIGAALASVIGLPLSGAFLHLDGLLGIAGWRWLFLLEGLPAAVLGVVVLRYLPESPERTHWLDAAQKRWLTRTLAAERETTAISHHDAWHVAFRSRQVWLLSLFWLLQAFGTIGITLFLPLIVQSVSGQGAFTVSLLSALPFLFACLFMYLNGRRSDLSGERGLHLGGPLLGAGILLGTAVITDSQPLAYAMLVFTVALNWAATPVFWATTTEYLSGPAAAVSIALINAIANIAGLGLPPVMGWIKDTTHSYDYALLLVACALLAGGLLGLHLGGGQARRPVRDHVSRSH

SEQ ID NO: 17227 - protein, 393 aa, Azotobacter vinelandii
MLTEQQRAIVKATVPLLETGGEALTSHFYRIMLAEHPEVRPLFNQAHQASGEQPRALANAVLMYARHIDRLEALGPLVAQIVNKHVSLQVLPEHYPIVGACLLRAIREVLGAETATDAVLDAWGAAYGMLAELLIGAEEAAYAAGAAVPGGWRGARAFRVARRVVESEEIVSLHLRPEDGGALPAFRPGQYIGLRLVLDGEEVRRNYSLSAAPNGEEYRISVKRHATGRVSRHLHEQVREGDRLELFPPAGEFVLNDSDKPLVLIGAGVGVTPLLAMLEAALPGGRPIRFIHCARHAGVQAFRQQVEALAGRHPQLEAFFCYSAPRAGDRADANGRLDAQRLAAWLPAERDLDAYFLGPKSFMAQVKRQLRELGVPQEQCHYEFFGPAQALEA

SEQ ID NO: 17228 - protein, 504 aa, Azotobacter vinelandii
MPRAAPTPCASCAWATSSIERRGLRCNRANLRTGRATSTSAPRMPNNRSCSPRARPFRPLHRTRHTMSNPSTSIQHVAAREILDSRGNPTVEAVVTLAGGATGVASVPSGASTGSREALELRDGALRYQGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCRGR

SEQ ID NO: 17229 - protein, 337 aa, Azotobacter vinelandii
MSRVTLSRYLIEQTRSHNTPADLRFLIEVVARACKEISHAVSKGALGGVLGSMGTENVQGEVQKKLDVMSNEILLEANEWGGHLAGMASEEMDSAYQIPGKYPKGAYLLVFDPLDGSSNIDVNVSVGTIFSVLRCPDQYLTQNDSLNEQAFLQPGTQQVAAGYAIYGPQTMLMLTLGNGVKGFTLDRELGSFVLTHDNLCVPETTAEFAINMSNQRHWEPPVKRYVDELLAGKTGPLDKDYNMRWIASMVADVHRILTRGGIFMYPRDAREPSKPGKLRLMYEANPMSFIIEQAGGAATNGTQRILDIQPESLHQRVAVFLGSKAEVERITDYHLEG

SEQ ID NO: 17230 - protein, 280 aa, Azotobacter vinelandii
MKAYRASMIDEAPAMNILLVHAHPERTSVTHQLAGISSEVLKGQGHEVVQSDLYAMGWKAVFDEQDFPSRANRDRLSFIEESGHAFANGGQTADVEEEQRKLLAADAVILHFPLWWFSMPAIMKGWVDRVWAYGLAYGYRGAGNAHRYGEGGFAGKRALLAVAVGGPEIDYSPRGINGPLEQLLFPITHGTLFFPGMQVLPTFAVYGAAGLDDRGMAEASAAWRGRLDRLFEDAPIAFRPQNGGDYPDRHVLADHVAPGRTGLAAHIAEAGESRRVRPGD

SEQ ID NO: 17231 - protein, 277 aa, Azotobacter vinelandii
MQTIVTHDKLVLPKLGLGTWPMLGEECTQAVLSALELGYRHIDTAAAYENEAAVGLALERSPVPRESVHLTTKVWWDRLQPAAMRASLQRSLEALRTDRVDLFMIHWPGKDWDLPRSIETLVALREEGKARHIGVANFPLPLLRRTVEELGAPLSAIQVEYHVLLGQRRLLDYVRQHGMALIAYSPLARNRIAEVAEIRDIAARHQARPAQIALKWLLDQPAVAAIPKAASVANQRINLDAFKVTLNDRERALIDALPKNQRLVSPDFAPRWDPFDE

SEQ ID NO: 17232 - protein, 334 aa, Azotobacter vinelandii
MALNIKAKEAPEFDVDDDVLLMDADIVLEDVLDDEPDLPVAKSRQANLKQHKYIDYTRALDATQLYLNEIGFSPLLTPAEEVHFARLAQRGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSAEEIANLLEKPVAEVKRMLGLNERVTSVDVSLGPDSDKTLLDVLTDDRPSDPCDLLQDDDLSQSIDQWLFDLTEKQREVVVRRFGLRGHESCTLEEVGQEIGLTRERVRQIQVEALKRLREILEKNGLSSDALFQ

SEQ ID NO: 17233 - protein, 371 aa, Azotobacter vinelandii
MTIKSRAAVAFGPNQPLQVVEVDVAPPKKGEVLVRIVATGVCHTDAYTLSGQDSEGVFPCILGHEGGGIVEAVGEGVTSLQVGDHVIPLYTAECRECKFCKSGKTNLCQAVRATQGKGLMPDGTTRFSYQGQPLYHYMGCSTFSEYTVLPEISLAKIPEDAPLEKVCLLGCGVTTGIGAVLNTAKVTEGSSVAIFGLGGIGLAAIIGAKMAKASRIIAIDINPAKFEVAGQLGATDFVNPKDHDKPIQEVIVEMTDGGVDYSFECVGNVQLMRAALECCHKGWGESTIIGVAGAGQEISTRPFQLVTGRVWRGSAFGGVRGRTELPSYVEKAQKGEIPLDTFITHNLPLERINEAFDLMHEGKSIRTVIHF

SEQ ID NO: 17234 - protein, 429 aa, Azotobacter vinelandii
MAKIVDIKGREVLDSRGNPTVEADVILDNGIIGSACAPSGASTGSREALELRDGDKARYLGKGVLKAVANVNGPIRDLLLGKDPADQKALDRAMIELDGTENKASLGANAILAVSLAAAKAAAKDKGVPLYAHIADLNGTPGVYSMPVPMMNIINGGEHADNNVDIQEFMVQPVGAKSFAEALRMGAEIFHNLKAVLKARGLNTAVGDEGGFAPNLSSNEDALAAIAEAVGKAGYKLGSDVTLALDCASSEFYKDGKYDLAGEGKTFDAAGFADYLAGLTQRYPIISVEDGMDESDWAGWKGLTDKIGAKVQLVGDDLFVTNTKILREGIEKGIANSILIKFNQIGSLSETLEAIQMAKAAGYTAVISHRSGETEDSTIADLAVGTAAGQIKTGSLCRSDRVSKYNQLLRIEEQLGAKAPYRGRAEFRG

SEQ ID NO: 17235 - protein, 388 aa, Azotobacter vinelandii
MLGATGSIGLSTLDVIARHPERYRAFALTGFTRLDELRALCLRFAPCYAVVPEAAAACRLEDELRAAGLDTRVLFGSEGLCEVAAHPEADAVMAAIVGAAGLRPTLAAVEAGKKVLLANKEALVMSGALFMQAVRRSGAQLLPIDSEHNAIFQCLPAAYGNGLATVGVRRILLTASGGPFRETPAAELIEVTPAQACAHPNWSMGRKISVDSASMMNKGLELIEACWLFDARPAQVEVVVHPQSVIHSLVDYIDGSVLAQLGNPDMRTPIAHALAWPERIDSGVVPLDLFSIARLDFQAPDPARFPCLRLAREAAEVGGSAPAMLNAANEVAVAAFLDGRVRFPEIASIIEDVLQGEPVVAIDDLETVLHVDIQARARAQAWLLRRER

SEQ ID NO: 17236 - protein, 545 aa, Azotobacter vinelandii
MQLLYTILIMLLVVGGTRITAQFIPIPLPLIQIAIGALLALPGFGLHVRLDPELFLLLFIPPLLFVDGWRMPKGEFWRLRTPILLLAFGLALFTVLGAGWLIHLLFPGIPLAAAFALAAVLSPTDAVAVSAIAHGRLPRTLMNILQGEALMNDASGLVAFKFAVAAALTGSFSLTEAGLEFVLVALGGLAVGVALSYALGRFRAWMIALGWEEPAPHVMFMLLLPFAAYVAAEHLGVSGILSAVAAGMMQSRLDLLPRQTTTRLLNRSVWALLEFTFNGLIFLLLGLQLPDIVKATLKEGELFWTSAVELGLLVGQVFLALILLRFVWTWLYWLVSGALRRWRGLPSSFAGQSSLRLAALLTLGGVRGAVTLAGVLSLPLLLSNGEAFPQRDLLIFVAAGVILLSLLVATLGLPLLLRGLPADNEEAREQELRRNRVKTVEAAIRALEAQSEEPGLSPEEMALAAEVKAKIMAEYRQQLERDDSVEARTRLRQMDALEQRLRLQALRSQRLELYRLRRRHQVDDDLLGEILRELDISEARLFRST

SEQ ID NO: 17237 - protein, 480 aa, Azotobacter vinelandii
MRNYFIHGRIARPRSTAREAGADFMSVTRRQILAGLAGVSALGLGAGGARYWLGRPEGAKTHDYELIAAPLDVELVPGRRTSVWAYGGQAPGLELRARQGDWLRVRFVNRLPEPSTIHWHGIRLPLEMDGVPYLSQLPVLPGESFDYRFRVPDAGSFWYHPHTASGEQLGRGLVGPLIVEEREPTGFRHERTLSLKSWHVDGQGVFGEFSVPREAARGGTPGRLSTVNGEASPTLELPAGQVVRLRILNLDNTLTYRLNLPGAEARVYALDGNPVAPHPLGREYLLGPGMRIELGLRVPAVGTALPLRNGPLRLATLKSVDSGETAADWPAALPANPVPEPDLAAATSLRFNFEWAAALSVNMEQGGAFKFWQINGQAWDINDRSCAERPIATLQQGRSYIFELRNVSQYQHPIHLHGMAFKVLDSNRRKIDPYFTDTYLLGRNETARIALVADNPGVWMFHCHVIDHMETGLMAAIKVA

SEQ ID NO: 17238 - protein, 489 aa, Azotobacter vinelandii
MLRISQEALTFDDVLLIPGYSDVLPKDVSLKTRLTRGIEINIPLVSAAMDTVTEARLAIAMAQEGGIGIIHKNMTIEQQAAEVRKVKRFEAGVLRDPITIDADATVRDLFELTRQHDISGVPVLSRGDLVGIVTSRDVRFETRLDARVREVMTPKERLVTVREGADKEEARQLLHKHRIERVLIVDDAFRLKGMMTVTDIEKAKAYPLASKDDQGRLRVGAAVGTGAETPDRVAALVAAGVDVVVVDTAHGHSRGVIERVRWAKLNFPDVQVIGGNIATGEAALALAEAGVDGVKVGIGPGSICTTRIVAGVGVPQISAIANVAAALQGTGVPLIADGGIRFSGDLSKAIAAGAYCVMMGSMFAGTEEAPGEVELFQGRSYKAYRGMGSLGAMAQSQGSSDRYFQDSSAGAEKLVPEGIEGRVPYKGALAAIIHQLMGGLRASMGYTGSADIEAMRTKPQFVRITGAGMAESHVHDVQITKEAPNYRVG

SEQ ID NO: 17239 - protein, 259 aa, Azotobacter vinelandii
MMFERMREDIRSVFQRDPAARNALEVLICYPGLHALWLHRLAHGLWCSDWKLLARLVSHVGRWLTGIEIHPGARIGRRLFIDHGMGVVIGETAEIGDDVTLYHGVTLGGTSWNKGKRHPTLEDGVIVGAGAKILGPFTVGAGAKIGSNAVVTRAVPAGATAVGIPGRIVARPDDEQEARRRAIAEKYGFDAYALGQNTPDPVAQAIGQLLDHLQAVDERLEGMCQALRALGSDYHAKELPALREEDFAGVKDEGGKSSA

SEQ ID NO: 17240 - protein, 263 aa, Azotobacter vinelandii
MDLGLKNKVAVITGSSTGIGLTVAEGLATEGVRVVLSARGADRVIVEAARIADTYGVETLGVACDVSSKEGVETLIAAVTDRFGGADILINNAGTGSNETVMQAPDEKWQHYWDLHVMAAVRLARGLAPGMKMRGGGVILHNASICAVQPLGYEPIYNVTKAALMMFSKNLATELIKDNIRVNTVNPGLVLTPDWIKTAKELTATTDGEWQAYLDRIAAESADIKRFANPAEVADFFVFLCSERASYSVGSTYFVDGGMLKTV

SEQ ID NO: 17241 - protein, 1254 aa, Azotobacter vinelandii
MKIPRRKPSHRLAAAYIALGGLFYGLSSLPANAAERLDIMHWWVSSGERASIEVLRERIRAQGLEWREQAVAGSGTARYINELRKRVAGGRPPSASQMIGFDIQEWARAGHLESLDEAAARNEWDEVVPFGIQALSKYQGHWYAAPINTHSTNWLWMNQRLLEKLGSPPAPDTWDDLVLLLERARTAGMLPLAVGREAWEHTLLFESVAVSTGGAEFYRRAFVELDAEALPLPLAIRIFERMRVLSRFVDPGFRRRRWDQATDLVRKGEALLQVQGTWVDGEFALHGMQPGRDFQCFRFPDTQGVVLFNSDQYVLLKNGPGSQAARRILLDTLMDPDFQAAVNRRSGAIPARVDVPKDGFDACGQRAIDDMRGANMRRTMMGSIAMGQRQPARRQDRHLQRGEPPSRRRTRRRPGGRSAAAGAFRRTLMSVLTPFANLRLTTKILLLVGLLGSIALAISIYSMANMRSVDRGYRGLIERQAQSALLLSDAALLLSDSSKLVYAVLTEQEEHKMRAVNGVVSGLQKEFDATLARIRPLIPGRAAALDAIAAQAPAVFEHARAIVEAAARWRGDRALRIIHEGFEPALRALQADMEALRGASIAEFGHASVELNRTTNRTIVAAAIAVVGGLLLVLALSGYLSITQISRPIAALTRIMERLTDRRYDDAIPGTGRRDEVGTMAQALQVFKDSMQRADRLSIEVAKSEQARLLSEQIAREKTAFLALMSHEIRTPLNAMLGMTQLALKSELSPPQRMRIETILRAGRHLLSIINDILDLSKIDSGKLVLEKTDFELEHLLADVVGMLADKAADKGLPLHVRVADGAPRMLVGDPMRISQILLNYLDNAIKFTQRGEIALEIEVRPDGTEYWLLTGSVRDTGIGMDAQQVANLFQAFRQADASITRRFGGTGLGLAICRRLAESMDGSTGASSTPGAGSTFWFSARLGRSALSEPAPLSMVRPEENAGPDGPAPAAPSCAPGQDARALHGRRVLLVDDNALNRTVATGLLESGGLLVDAVDDGQAALDTLRAAPDGRYAAVLMDMQMPVMDGLTATRLLRTEPRFAGLPILAMTANATREDIAATVQAGMNAHIAKPIDEGALWDILLHWISREAVEAGSERNIPAPTAAETDDAPPMEIFTPAPLRELRQRLAPARFEALLAMFEEDCRARCLRIGEAAWAGHVDALRQEAHDLVSTAGSFGLLALLALGLELRRAAQAHDMRATRHVAARIERATGEGLRALRATFPPPRPADAER

SEQ ID NO: 17242 - protein, 539 aa, Azotobacter vinelandii
MNPRSESHRDVEERDPLRLVLSIGAGVTLPEEASPASLGFKAWNLARMAAMGLPVPAAFVIGTGWCGREAPDPCLWQQALQRLERESGLGFGDARRPLLLSVRSGAPVSMPGMMDTLLDIGLTEVTLPGLVRLTGNPRLAWDAYRRLIAGYGEVVAGIDGRHFEADLDAVRGDGDEHELDFAALRDIAKRHLATYAREAGEAFPQDPQVQLRAAVVAVFASWYGDKARAYRELHELPASPGTAVTVQRMVFGNAGGMSGAGVGFTRDPSSGEPSPWVDFLFNAQGEDVVSGRRRAQSHEELAAVAPQIWEALLKTMTQLEQGFGDMQDFEFTVQDGQLYLLQTRDGKRTPQAAARIALDLCDQGLIPRRIALERTRGLDARALAVRRLVSEAGRTVEPLARATSAAGGVVCGEIALDEARVRARKEAGASVLLVRRDAETRDLPALHLADGLLTQRGARTSHAAVVARQLGKVCLVGCDSLTIDEADRSLSIGGLALREGDPLTLDGNEGVLYAGAARMGEQVAQDLLERLERLRHEPH

SEQ ID NO: 17243 - protein, 836 aa, Azotobacter vinelandii
MHRPEAEVVSPAPALRRAARTHGSHRQAGVRWLALGQLLVSAGPGGRLQARGLPACAERTRTAPAGTGLIRRSSRRAMLNTLRKIVQEVNSAKDLKTALGIIVRRVKEAMGSQVCSVYLLDPETNRFVLMATDGLNKRSIGKVSMASNEGLVGLVGTREEPLNLENAAAHPRYRYFAETGEERYASFLGAPIIHHRRVMGVLVVQQKERREFDEGEEAFLVTMSAQLAGVIAHAEATGSIRGLGRQGKGIQEARFVGVPAAPGVAVGKAVVVLPPADLDVVPDKPAEDLKAELELFGNALEAVRADIRALSAKLATQLRPEERALFDVYLMMLDDASLGCEVQRVIRTGQWAQGALRQVVNEHVKRFELMDDAYLRERASDVKDLGRRLLAYLQQARQQAMVYADNTILVSEELSPAMLGELPEGKLVGLVSVQGSGNSHVAILARAMGIPTVMGVVDLPYSKMDGIDLIVDGYHGEVYTNPSDMLRQQFADLVEEERQLTQGLDALRELPCETLDGHRLPLWVNTGLLADVARAQERGAEGVGLYRTEVPFMNNERFPSEKEQLAIYRDQLSAFYPLPVTMRTLDIGGDKSLSYFPIKESNPFLGWRGIRVTLDHPEIFLVQVRAMLKASEGLNNLRVLLPMISSIHELDEALHLIHRAWGEVRDEGTDVPMPPVGVMVEIPAAVYQTRELARLVDFLSVGSNDLTQYLLAVDRNNPRVADLYDYLHPAVLQALNKVVQDAHAEGKPVSICGEMAGDPSAAVLLMAMGFDSLSMNATNLPKVKWLLRQITLSKARELLDRLMAIDNPQVIHSTLQLALRNLGLGRVINPVASLQS

SEQ ID NO: 17244 - protein, 290 aa, Azotobacter vinelandii
MSRRIRMTTSLQPVSALVPGANLEAYVHAVNSIPLLTAEQERELADRLYYQQDLDAARQMVLAHLRFVVHIARSYSGYGLAQSDLIQEGNVGLMKAVKRFNPEMGVRLVSFAVHWIRAEIHEFILRNWRIVKIATTKAQRKLFFNLRSQKKRLAWLNNEEVDAVAESLGVEPHEVREMESRLSGQDMAFDPAADADDDSVFQAPAHYLEDQRYDPARQLEEADWSDSAAANLHEALEGLDERSRDILYQRWLAEEKATLHDLAAKYKVSAERIRQLEKSALNKLKGSILA

SEQ ID NO: 17245 - protein, 112 aa, Azotobacter vinelandii
MKLVTAIIKPFKLDDVRESLSEIGVQGITVTEVKGFGRQKGHTELYRGAEYVVDFLPKVKIDVAIEDSQLDHVIEAITKAANTGKIGDGKIFVVNLEQAIRIRTGETGTDAI

SEQ ID NO: 17246 - protein, 415 aa, Azotobacter vinelandii
MEPFIYRDGTLFAEGVALSAIAARFGTPTYVYSRAHIEERYRAYADALAGMPHLVCFAVKANSNLAVLNLLARLGAGFDIVSRGELERVLAAGGDPARVVFSGVGKTREDMRRALEVGVHCFNVESDVELERLQEVAAELGVKAPVSLRVNPDVDAQTHPYISTGLKENKFGIDIEQAEEVYARAAELPNLEVLGIDCHIGSQLTTLSPFLDTLDRLLLLVDRLAARGIVIRHLDLGGGLGVRYRDEQPPAPGDYIAAVRERIEGRALALVFEPGRSIVANAGVLLTRVEYLKHTEHKDFAVIDAAMNDLIRPALYQAWMDVVPVTPHGGEVCSYDLVGPVCETGDFLAKDRELALVEGDLLAVRSAGAYGFVMSSNYNTRGRAAEVLVDGERMHLIRRRETIEDLYAGESLLPN

SEQ ID NO: 17247 - protein, 620 aa, Azotobacter vinelandii
MSVKAQQQSRIKELIARGREQGYLTYAEVNDHLPEDISDPEQVEDIIRMINDMGINVFESAPDTDALLLAEADTDEAAAEEAAAALAAVETDIGRTTDPVRMYMREMGTVELLTREGEIEIAKRIEEGIREVMSAIAHFPGTVDGILAEYQRVTSEGGRLSDILSGYIDPDDDSAVPAEAEVPVDLKSKSAATPAASEDEDEDESEESDSDDEEGDGGPDPEIARQRFGAVAEQLGRTRVALERHGRHSVEGLEALQALASLFMPIKLVPKQYDTLVEQVRDALTRVRAQERAIMQLCVRDARMPRADFLRQFPGNETDQDWVDLLAKGKAKYAEALGNLADDIKQCQQKLIDLEQKVGLTIAEIKDINRQMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMDMPEDKIRKVLKIAKEPISMETPIGDDEDSHLGDFIEDSTMQSPIEVATVESLKEATREVLAGLTAREAKVLRMRFGIDMNTDHTLEEVGKQFDVTRERIRQIEAKALRKLRHPSRSEHLRSFLDE

SEQ ID NO: 17248 - protein, 257 aa, Azotobacter vinelandii
MSTRINPFCLDGRQALLTGSCRGIGFELARGLGRAGAKVLINGRDNERTHAACAKLRDEGLMAEAVVFDVTDYRQSETAIDDVENRLGPIDILVNNAGIQHRAPLEEFAHEKWRELMQTNLDAVFYVSQAVARHMIGRKRGKIINIGSVQSELARPSITPYAASKGAVRMLTRGMCADWARYGIQTNGLAPGYFQTELNRALVEDREFSDWLCKRTPAGRWGQVEELCGAAIFLASSASDFVNGQMLYVDGGLTSVV

SEQ ID NO: 17249 - protein, 633 aa, Azotobacter vinelandii
MPKTFHEIPRERPATPLLDRAATPDRLRQLGEAELEVLADELRQELLYTVGQTGGHFGAGLGVIELTIALHYVFDTPGDRLVWDVGHQAYPHKILTGRRERMLTLRQKDGIAAFPRRSESPYDTFGVGHSSTSIGAALGMAIAARLKGERRRCIAVIGDGALTAGMAFEALNHASDVQADMLVVLNDNDMSISKNVGGLSNYLAKILSSRTYASMREGSKNILSRLPGAWEIARRTEEYAKGMLVPGTLFEELGWNYIGPIDGHDLPTLLATLRNMRDLKGPQLLHVVTKKGKGFAPAEADPIGYHAITKLEPEGSAPRQPGPPRYSSVFGRWLCDMAAADPRLAGITPAMKEGSDLVAFSQRFPERYFDVAIAEQHAVTLAAGMACDGLKPVVAIYSTFLQRAYDQLIHDVAVQNLDVLFAIDRAGLVGEDGPTHAGSFDLSYLRCIPGMLVMTPSDENELRRLLTTGYLFEGPAAVRYPRGSGPNAALEPGLEPLPIGKGVLRRRSGKSDGPRVALLVFGVQVAEALRVAGKLDATVADMRFVKPLDEELVRELAAGHELLVTVEENSIMGGAGSAVAEYLAEAGLLRPLLHLGLPDYYVEHARPAEMLAECGLDAAGIEAAVCERLNMLS

SEQ ID NO: 17250 - protein, 469 aa, Azotobacter vinelandii
MQTSTYTSDQTAQVAPARKDLAALIAIVAALGGLLFGYDTGIIGVALLGLSQDFVLNDTLKQFVTGAIIFGALFGCLLTGPISDRIGRRRTIIGVGLVFALGSLLSALSPSVGFLVVSRFLLGLSAGSSTQIIPVYIAEVAPPQHRGKLVVLFQLMVMTGITVAYFTGFALGEHWRWMFGLGVVPALILLAGMAILPESPRWLLVRGREAAALSVLTHVRGDAHWAARELEEIKTVSREPQGTWRDLRLPWIRPAVIVGGAIAMFSQITGVNAMIYYAPTILTQAGFSTDTAVLATGSSTILVVLMTWFGSVLVDRIGRRRYLLWLIPGSIAALIGMGLLFQSGGPTTTLEQWLVVLCLAGYLMLNCGGFGVCIWLINSEVYPLFIRGKGASVGAFSHWFFDLLVTLTTLSLVTALGAANTFWMYAAISTGALLFIWRYVPETRGKSLEQIEHELREHRFYPFQQKTEH

SEQ ID NO: 17251 - protein, 505 aa, Azotobacter vinelandii
MPRAAPTPCASCAWATSSIERRGLRCNRANIRTGRATSTSAPRMPNNRSCSPRARPFRPLHRTRHTMSNPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALKGKAPYDASALLKRRCCGGKA

SEQ ID NO: 17252 - protein, 252 aa, Azotobacter vinelandii
MSKYLDKAFDLQGRCAIVTGGAAGIGLACARLLTECGARVALLDRNPAVETVAAGLGSGHLGVALDVRQLDEIQAAVERVVAAFGQIDYLVNSAGVARLDKALDVDEESWDITLDINLKASFFAAQAVARHMRERGAGRIVNLASQAAVIGLDRHAAYCASKAAIVGLTKVLAMEWAEHGITVNAVSPTIVETELGKQAWAGEVGERAKQQIPVGRFAQPEEVASLVLYLLSDAAAMITGENVVIDGGYTIK

SEQ ID NO: 17253 - protein, 435 aa, Azotobacter vinelandii
MNTASSRLAGLFNLEPNEAPAVLAGLLMFFLLFAGYFMLRPVRETMGVAGGVDNLQWLFTGTFVATLVALPLFGWLASKVSRRRILPWVYGFFVLNLLGFAIALLAWPDSVWAGRVFYIWLSVFNLLAISLAWSVLTDVFASGEAKRLFALIAGGASIGGLVGPILGTLLVEPLGHAGLLILAAIMLAASALAAAWLHRWRDRNPPPADSPSGHEPRGRPLGGNPFAGATAVFGSPYLIGIAVFVLLLATVSTFLYFEQARMMAEHFPDRARQTQVFGLIDSVVQTLAILTQVFFTGRIAQKLGVGVLLVAVPLAVAAGFLWLALAPEFAVFVIVMVARRAGEYALVRPGREMLYTVVPVEQKYKAKNFIDTVVYRGGDALSGWIKRGLDLVAEHPALAMFTGMFIALGWGLVGAGLGRAQHRRETHAQQPDAAP

SEQ ID NO: 17254 - protein, 503 aa, Azotobacter vinelandii
MPRAAPTPCASCAWATSSIERRGLRCNRANLRTGRATSTSAPRMPNNRSCSPRARPFRPLHRTRHTMSKPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWVGWAYLTEKLGQKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDATALLKRRCCSR

SEQ ID NO: 17255 - protein, 500 aa, Azotobacter vinelandii
MAEFWTPRTTTRARDMNDKTVAPQQHDISYVLRICAVAALGGLLFGYDTAVISGAVEALQQYFSLSPAETGWAVSNVVVGCIVGALGAGWVAGRLGRKKALVLSAILFTVSAIGAAVVDSFVWFVIYRIVGGLAVGIASTVSPMYMSEVSPKDIRGRALGMQSFAIVGGQVVVFYVNYLIAKGAADTWLVEYGWRWMLGSEVVPCILFCLFVFSIPESPRWQAMVGQDERALRTLRRISNDAHAHHLLNEIKHSLHQDSQGRTQKPNLREAGLALILFVGCMLAMLQQVTGVNVMMYYAPMVLKGVTGSTESALFQTIWIGVMQLVGTIIGTWLIDRVGRLPLMRVGTVGIVASLLLTSYALYAQESGYLALIGMLLFMVLFAISWGVGTWVLISEIFPNHMRSMGMSMAVCSMWIANFLVTQSFPMLNEHPVLIERFHGAFPMWVFAGCCVFCYWFVARFVPETRGVSLERMEEVMLAKLKRQPLADEEESAALRSSRA

SEQ ID NO: 17256 - protein, 486 aa, Azotobacter vinelandii
MKEIKHFINGEYVGSASGKLFDNVNPANGEVIARIHEAGEAEVDAAVKAARAALKGPWGKMSVAERTEILHRVAAGITARFDEFLEAECQDTGKPKSLASHIDIPRGAANFSVFADLVKNVPTEAFEMATPDGSGALNYGVRRPKGVIGVISPWNLPLLLMTWKVGPALACGNTVVVKPSEETPSTTALLGEVMNAAGVPAGVYNVVHGFGGNSAGAFLTAHPDVDGITFTGETGTGETIMRAAAKGVRQVSLELGGKNAGIVFADADLDKAIEGTLRSAFANCGQVCLGTERVYVQRPIFDAFVARLKAGAEALVIGEPNDPKANFGPLVSHKHREKVLSYYQKAKDEGATIVTGGGVPDMPQHLAGGAWVQPTIWTGLKDDSPVVTEEIFGPCCHIRPFDTEEEAIELANSLPYGLASAIWTENASRAHRVAGRIEAGIVWVNSWFLRDLRTAFGGAKQSGIGREGGVHSLEFYTELKNICVKL

SEQ ID NO: 17257 - protein, 257 aa, Azotobacter vinelandii
MHEKRFQDRVAVVTGAAQGIGRRVAERLVGEGARLVAVDRSELVHELREMGSDRVLTLTADLERFADCQRVMTATVERFGCLDILINNVGGTIWAKPFEHYDEAQIEAEVRRSLFPTLWCCRAALPQMLEQGHGAIVNVSSIATRGVNRVPYGAAKGGVNALTACLAFETAERGIRVNATAPGGTEAPPRRIPRNAAEPSEQERTWYQRIVDQTVDSSLMKRYGTIDEQVGAILFLASDEASYITGTTLPVGGGDLG

SEQ ID NO: 17258 - protein, 355 aa, Azotobacter vinelandii
MSRPLPGGRANPRIRAGCHMSYKVALNFEDGVTRFIEVDSGETVADASYRQGINIPLDCRDGACGACKCLAESGRYDLGENYIEDALSEEEKAAGLVLTCQMRPESDCVLRIPASSEVCKTEQASYAAVISDVRALSPSVISLSIKGDSLVRLSFLPGQYVNLEVPGSDQTRAYSFSSMPHDGEVSFLIRNVPGGLMSGYLSQQARAGDPMTLTGPLGSFYLREIRRPLLMLAGGTGLAPFTAMLEKIAEGGSAHPVHLIYGVTHDADLVEMDRLQEFAARIPGFTFTACVASPESSYPHKGYVTQHIEPRHLNDGEVDIYLCGPPPMVEAVNKFLREQGIQPANFHYEKFAASV

SEQ ID NO: 17259 - protein, 559 aa, Novosphingobium aromaticivorans
MSWHCSPSFRRGPGREASGCRRRAAPASRALAPACRASHRSLRSAREPPVPLLPAPRARPTRHRQWPPPHRGGPVPAPCPDARRRNPDCRLAVRSGSRSLPPPRVRHFHASPDPAPRMYGRNARPREDRFGELPVKSREDKAMASSAMTLNTPRIPVGKSFWQSGHRPTLFAAFLYFDIAFMVWVILGPLAPIISKELGLDPAQKGMMVAVPTLAGAVIRLVNGLLVDRIGPKRTGIISQVVVIAGMFAAWWFGISSYEGTLALGVILGFAGASFAVSLPLASRWYPPEHQGKAMGIAGMGNSGTVFASLFAALLAKSFGWTNVFGLALIPLVAVFAFYLVAAKDSPEQPEPKPLSAYASVLKEQDAWWFMLFYFVTFGGFVGLSSSLPTFFADSFGVTPVIAGYCTAAAVFMGSMLRPLGGALADRFGGIRTLSVVYVVAGALLAVIAAVSTQGLALAIALFVAVMGTLGVGNGAVFQLVPQRFRKEIGVMTGLVGFGGGVGGFYLASSLGAIKKATGSASLGFLIFAALAVVALVGLTAVKRRWRTTWGAALGGARI

SEQ ID NO: 17260 - protein, 451 aa, Novosphingobium aromaticivorans
MVGRVAEADETDMDAAVAAARDAFDHGPWPTTPPAERIAAFRRMVAHLETRVPELAKAWTAQMGGLASFAGPMHGGSVMALGQIAGFAEKFEFVERRPSMAADTALIAYEPVGVVAAIAPWNGPFGIMANKVAYALLTGCTVIMKPSPETPLEAYIIAEAAEAAGIPAGVVNLVTGHREASDHLVCNEGVDKVSFTGSTVAGKRIASVCGSRMARCTLELGGKSAAIVRDDFPIDAAAKMLAGTITMMSGQVCAMLSRVIVPRRRHDELAEAIAAEMKKVRIGNSDDPETQLGPVAMKRQLERIEMYIEEGRKTADLVTGGGRPAHLNRGYFIEPTLFANVRNESRIAQEEIFGPVLSLIPVEDEEDAIRTANASAYGLNGSVLTNDAEAAYRIARRVRTGGFGQNGLRMDFGLPFGGFKQSGIGREGGPEGLFPYLEMKTILIDGMPSAL

SEQ ID NO: 17261 - protein, 323 aa, Novosphingobium aromaticivorans
MASPLAQTMESAIRSMVTKGVVVVSSFRRSRQDANRPHAFLTGIHAPVKEERTIEDLAVTGTIPAELSGRYVRIGPNPFRADPRGHHWFVGDGMVHGVCMKGGKALWYRNRYVRSRNLQDAGGPAAAPGPRRSTFDTVNTNVIQHAGRTFALVEAGSFPVELTHDLESFAYSDLGGTLKGPFSAHPHLDPLTGELHAVTYDGQTLDTVWHVVVDREGRVRREEPVPVAHGPSIHDCAITAKYVLILDLPVTFSMAALVGGARFPYRWNPAHRARVGLLPREGTAADVIWCDVDAAYVFHVANAFDNPDGTVTGSTWARLRKNE

SEQ ID NO: 17262 - protein, 301 aa, Novosphingobium aromaticivorans
MAGCRGLAGRDKRWAAFAANEATPVERIRAEISDIASATGMSLGEFRRIVNMVQKGEREARIAKKEMVEANLRLVISIAKKYTNRGLQFLDLIQEGNIGLMKAVDKFEYRRGYKFSTYATWWIRQAITRSIADQARTIRIPVHMIETINKLVRTSRQFLHEQGREPTPEEMAERLSMPLEKVRKVMKIAKEPISLETPIGDEEDSHLGDFIEDKNAIIPVDAAIQANLKETVTRVLASLTPREERVLRMRFGIGMNTDHTLEEVGQQFSVTRERIRQIEAKALRKLKHPSRSRKMRSFLDQ

SEQ ID NO: 17263 - protein, 323 aa, Novosphingobium aromaticivorans
MWSRRRSPIRGPTKGNRRDERNIQVSEEKTALTVPALGGEASLNRYLSEIRKFPVLTAEQEYMLAKRFQEHQDPEAAAQLVTSHLRLVAKIAMGYRGYGLPVSELISEGNIGLMQGVKKFEPDRGFRLATYAMWWIKASMQEFILRSWSLVKMGTTAAQKKLFFNLRRMKKNLEAFEDSDLHPDDVRKIATDLGVPEQEVVNMNRRMMMGGDASLNVSMREDGEGSWQDWLTDDRPLQDETVADAEEAQYRHELLVEAMESLNERERHILTDRRLIDDPKTLEELSQVYNVSRERVRQIEVRAFEKLQKAIQRIAVERKLLPA

SEQ ID NO: 17264 - protein, 500 aa, Novosphingobium aromaticivorans
MGRHESPRTQEVAPIMDIPLGLTFDDVLLRPAESDIVPSQADTRTRLTKGIGLNIPILSSAMDTVTEADMAIVMAQLGGIGVLHRNLSIEEQCAAVRAVKRFESGMVVNPITISPDAPLGEAQALMRQHKISGIPVVEASGKLVGILTNRDVRFADNPQQPVRELMTHENLATVKLGSSGDEARRLLHQRRIEKLLVVDDAFHCIGLITVKDIEKAVTFPNATKDAAGRLRVAAATTVGEKGLLRTQALVEAECDVVIIDTAHGHNRDVARAVEAAKKLSNSVQVIAGNVATAEATRSLIDAGADGVKIGIGPGSICTTRIVAGVGVPQLTAVMECAAEAEKSGVPVIADGGLRTSGDAAKALAAGASSVMIGSMLAGTEEAPGETFLYQGRAYKSYRGMGSVGAMARGSADRYFQQDIKDQMKLVPEGIEGQVPYKGPAKDVVHQLVGGIKAAMGYTGSPTIDDLRKRAQFVRITNAGLRESHVHDVTITREAPNYKVG

SEQ ID NO: 17265 - protein, 282 aa, Novosphingobium aromaticivorans
MHPPRRRDPHGPALRIEPMSQSPFRDDVLAGKTAFIAGGTSGINLGIAKRFAELGARVAVLGRNPEKAASAADEIGHDAIWRAADVRDYGAICEAMKSVRDEIGALDIVVSGAAGNFLAPVLGMSANAFKTVVDIDLLGTFNVFRGCHELLNPGASLIAITAGQAEQAMAMQAHACAAKAGINQLVRTLAIEWGPDVRVNGISPGPIADTEGMARLAPDESTRQQHYARIPMKRWGTCYEIAEAAVYLSTPAASYVTGAILDVDGGSSVGDASRTSPNKGLA

SEQ ID NO: 17266 - protein, 370 aa, Novosphingobium aromaticivorans
MMHTEKTSGTRESLMNAPTHTNTRYLENAWYVAALSSEVQGQALFHRKILDISVMIYRLSDGSPTALRDRCPHRFAPLHMGKREGDEISCFYHALRFNSVGTCTHNPHGNGNIPDGANVRAFPLLERHGFIWIWMGEQTADPDLLPDFSPLEDSGPNAVGYTYMHMDANFELIVDNVMDLSHIDHVHGEIISTRGKLSPKIPKIRSTSRSISSRWEWEQQPAMLILAPFLPAPDAEARQYFDITWTPPANIQLSVGAVQGELSFDEAVMQYDLHTATPETQFTTHYFFATRRNHDTDNAEYNAMKIKAMHDTFEAEDGPIITGVQREMGDTDFFDLNPVLMSNDVGPVRVRKLLRKLIEEERADDYHKSE

SEQ ID NO: 17267 - protein, 351 aa, Novosphingobium aromaticivorans
MTNTRPNFVRNCWYVAGWDYEFTAGKPHPRTFLAEPVVFYRKGDGTLVAMADRCVHRLAPLSLGRLEGDDIRCMYHGMRFTADGKCVEIPGQDMIPSSACIQTYPVVEKGSWAWIWMGDPHLADAALLPDARGLDDPVWVLKSGQLDYAAPHELINDNLLDLSHLAYVHVASFGATPGWITQQPRTTQIERGVRVERWVESAPPLPPLPSLAAYESVDMWASYEFLIPGVFLMYTSLHPPGTAKGSNHAAPAGDVLFSNFTCQAVTPLTAGSSRYFFSWGPGSQFGGEEIAQQMIDVAMAAFLEDKLIIEAQARIIAMSPGEKIMPNAADRTVTIFQRMMERMKHPASTSS

SEQ ID NO: 17268 - protein, 252 aa, Novosphingobium aromaticivorans
MNALFDLSGKAAIVTGSTRGIGRAIAEALVAAGARVVISSEDAADTARVAAELGMPGCACDVADDLQLAALVEFSLASLGRLDVLVCNAGITGKAGPFAEIDMDDYARVMAINLRSQVVMCNLALPHIAAGGGGAAILVASLSALRGNGRINAYALAKAGVAQLARNLAVEWGPRAVRVNAVSPGFIATELSGPLLADEGFMARRMSMTPLRRPGTPAEVAGAAVFLASPAGGFVTGHNLVVDGGTLVTDGS

SEQ ID NO: 17269 - protein, 263 aa, Novosphingobium aromaticivorans
MAGTLKGRSALVTGGGQGVGQGIARALAAEGADVMIAQRGLEAAEAEAVHLRATYGVNAIARQVDVTVRGEVDAMVDACAAAFGRLDILVNNAGGSFPKRLENHTDEDMEGSFLLNYWSAFWSMRAAFPLMKAQKYGRIVNLGSLNGVNAHMFTAAYNASKEAVRALTRTAAVEWGGHGITANVICPSALSPAARDYFDANPEMAQAILGQVPVGRFGESAGDIGPVAVFLAGEASSYMTGNTLYVDGGGHINGVAWRPEVED

SEQ ID NO: 17270 - protein, 286 aa, Novosphingobium aromaticivorans
MAAGTSTASPGAPKSRTETMSHGLEGKRAVVTGGAQGIGAAIAHRLAAEGATVAVLDLSGEKASALLPAPHIGVACDVSDSASVDAAFAEVAARLGGVDILVNNAGIGSAPGDGMAEYYAGQAAQAGGDASAYADQTIHCTDDGWSRVLSVTLDGAFRCSRAAVRIMAEQGTGGAIVNIGSTAALAGNGPVPYVTAKAAVLGMTRAMARELAPRGIRVNAVNPGATETPIYAPLPDEVKAAVAADSVMKRLAHPDEIAGAVVFLAGNDASFATGSTVNVNGGAWFS

SEQ ID NO: 17271 - protein, 261 aa, Novosphingobium aromaticivorans
MSQDMTGKVAIVTGGSDGIGLATARLLAARGATVVICARREDKLEAARAEIAKVGKVEAVKLDVSDEAAFTALVEDVAARHGRLDMLVNNAMSVHYAPIAKLRLDHWRKDFAVNADAVFVGTKAAMKVMAAQEQRGRQRGAIVNIASTCGIRAAPNMASYSASKAAMVHFTAAAAMEGAPLGIRVNAIVPGQVMTAATQEFADRAPEVAARTTGAIPMQRGGEPEELAEAIVFMLSEAASYVTGTALPVDGGKAAQLYMPG

SEQ ID NO: 17272 - protein, 394 aa, Novosphingobium aromaticivorans
MTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 17273 - protein, 527 aa, Novosphingobium aromaticivorans
MGPAPPSQGRARPQRHPLPRQAGDMAPGDAQPSVITRPAEQRLQGLTTMTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 17274 - protein, 254 aa, Novosphingobium aromaticivorans
MLKESLMGRLNGKVAIITGAARGMGESHARTFVREGARVVLTDLSEEAGKALVAELGDNAVFLKQDVTDPQSWNAVVETAVREFGTIDILVNNAGILGPMAPTDSLDDEGYRKVCAVNQDSVFFGMRAVLPVMVKARRGSIVNISSIAGMAANYGFPSLAYVASKFAVRGMTKATAVEFGKHNIRVNSVHPGFIQTPMMVEATDEVGGEALAQIPLGRIADPSEVSNLVLFLASDESSYITGSEHLVDAGMLAH

SEQ ID NO: 17275 - protein, 343 aa, Novosphingobium aromaticivorans
MAMSVFLRNAWYMACWSHEVPEGGFLARRLLDKPWVIWRKADGTPVIMADRCPHRFVPLSRGQRDGDMMRCGYHGLAFSSSGGCVHNPFTDEALPLARVEVLPVVEKHTGLWFWPGDADRADPALIPDFGFLDVERPLHRGHLKMDAGYELVTDNLMDLSHAEFIHRDSFGVNGSLLTCGQHEVVQDEGGAIWNNWTMPDSEPPSWAVAMLPEGARTDQWLHMRWNAPSCLALFLGLARSGTDRKDMVVPPMADPHILTPETVTSTHYFYTHEPTPEAHALLEKAFLEEDHPMLHAQQEAMGSADFWDLRPVVLPSDAGAIRVRRRMMQLRRAEAGLEEEAAA

SEQ ID NO: 17276 - protein, 134 aa, Novosphingobium aromaticivorans
MVGTMIELPRAALMAGEIAEEAKFFSFGTNDLTQTTLGVSRDDAARFLNPYVDQGIYPRDPFVSLDIEGVGQLVELAAERGRKTRPDIKLGICGEHGGDPASIAFCEKTGLDYVSASPYRVPIARLSAAQAALA

SEQ ID NO: 17277 - protein, 757 aa, Novosphingobium aromaticivorans
MTAYVFHFGGGATSSEPRAKDKTIVGGKGANLAEMAGIGLPVPPGFTISTEVCTAYNASGKTFDDALRAGVAAGVSHIEKATGRTFGDAANPLLVSVRSGARVSMPGMMDTVLNLGLNDATVEGLAAGSGDPRFAWDSYRRFIQMYSDVVLGLDHHRFEDALEIVKEDNGFFNDVELGANHWQALVGEYKSIVEDQLGRPFPQDVHEQLWGAIGAVFDSWESDRAKVYRKLNDIPHDWGTAVNVQAMVFGNMGDTSATGVAFTRDPATGEKAYYGEWLVNAQGEDVVAGIRTPQYLTLAARERAGAKPLSMEEAMPGAYAELAAVFELLEKHYRDMQDIEFTVEQGKLWMLQTRSGKRTAKAALKMAVDMVGEGLIDEATAIKRIDPMALDQLLHPTLDPKAARDVLTKGLPASPGAASGTVVFDADTAQAKAERGDAVILVRVETSPEDIHGMHAAKGILTARGGMTSHAAVVARGMGRPCVSGASALSIDMASRTARIGNREIREGDVITLDGSNGDVMAGKVPTVEPELVGDFGTLMAWADKHRRMKVRTNAETPLDCQVARQFGAEGIGLCRTEHMFFEAGRISAVRQMILAEDEAGRRAALAKLLPEQRSDFQSIFEVMAGLPVTIRLLDPPLHEFLPHGETEFAELAEATGLGIEHLKRRAGELHEFNPMLGHRGCRLGITFPEIYEMQARAIFEAACDVAEQSGDAPIPEVMIPLVATKKELEILRALVDRVPPEFFAEKAARSNIWSAP

SEQ ID NO: 17278 - protein, 419 aa, Novosphingobium aromaticivorans
MDHFEVSNGVLHAEDVALPVIAAEVGTPVYVYSRATLTRHARVFRDALSILPAVKIAFAVKSNPNLAVLKVLAAEGYGADVVSGGEMERALAAGMKPDGIVFSGVGKTEAEMRRGIEAGIGQFNLESEEEGLELAEIAASMGKVASAALRVNPDVDAGTHGKISTGKAENKFGVPFDRAAAIYARLADTPGLNMRGLALHIGSQLSKLDPLEAAFTKVGGLMRAIREGGHAVTHMDLGGGVGVPYKAGEVFPQPAEYAAMVAKVTADWGVTLMFEPGRVITGNTGVLMTQVVRVKEGAGHPWVVVDAAMNDLARPALYDAWHDFAAVEPTGETFVANIVGPICESSDTFAMARTIDKVGRGDLAVFRTAGAYGATMANTYNSRPLVPEVMVDGEKWAVVADRIDPATILAAERVPDFLK

SEQ ID NO: 17279 - protein, 395 aa, Novosphingobium aromaticivorans
MKGKRILLIVGGGIAAYKACELVRLIRKEGAEVTCVLTEGGAHFVTAMTLAALSENPVHTTLWDLKNEVEMGHIQLSRQADLVVVCPATADLMARMAAGIADDLATTLLLATDKPVLAVPAMNVRMWQHPATRRNVATLRGDGIAVMEPGEGAMACGEFGPGRLPEPADILAEIARMSGTAGRLSGRHVLVTAGPTHEPIDPVRYIANRSSGKQGFAIAAAAARAGARVTLVAGPVNLPTPQGVTRIDVETARQMAAAVDAALPADVAIMVAAVADWRSAGEAAQKIKKDGSGAVPPLQLVENPDILATLCKSGRRPPLVVGFAAETNDVLDHARAKLARKGADWIVANDVATHAMGGEINGLHIVSSSGVESLPEMPKDAAAAALIERIADVLS

SEQ ID NO: 17280 - protein, 428 aa, Novosphingobium aromaticivorans
MTAIIDIHAREILDSRGNPTVEVDVLLEDGSFGRAAVPSGASTGAHEAVELRDGDKARYLGKGVTKAVTAVNSDIAECILGLDAEDQRDIDLAMIELDGTENKSRLGANAILGTSLAVAKAAADARGLPLYSYVGGVSAHVLPVPMMNIINGGEHADNPIDFQEFMIMPVGAPSLAEAVRWGAEVFHTLKKGLHEKGLATAVGDEGGFAPNLASTRDALDFVMASIEKAGFKPGEDMMLALDCAATEFFKNGKYEISGEGLSLSPDAMADYLAALCDAYPIISIEDGMGEDDFEGWAALTAKVGKRVQLVGDDLFVTNPKRLEMGIGKGLANSLLVKVNQIGSLTETLEAVSIAQRNGYTAVMSHRSGETEDATIADLAVATNCGQIKTGSLARSDRLAKYNQLIRIEEELGVSARYAGKTAFGRLGA

SEQ ID NO: 17281 - protein, 385 aa, Novosphingobium aromaticivorans
MTRTISVLGATGSIGASTLDLIRRERDKWRVVALTANGNARELAALAREFGAEVAVVADESALAALRDALAGSGIEAAAGPGALIDAAALGAEVTVAAIVGCAGLAPTMAAIERGGIIALANKEALVSAGDVMMAAVERHGATLLPVDSEHNAIFQCLQGNDIAHVRAITLTASGGPFRDWTTEQLQRATPAEAVRHPNWSMGAKISVDSATMMNKGLEFIEAFHLFPVGVERLRIIVHPQSIVHSMVEYRDGSTLAQLGPSDMRVPIASALAWPARMDTPCDPLDLATIGQLTFRAPDEQRFPATRLAREAVIAGGAAPAVLNAANEMAVAAFLGGQIGFTRIVQCCEDVLAHGLAPAPRSLAEVIAVDAEARARALELMEPVR

SEQ ID NO: 17282 - protein, 356 aa, Novosphingobium aromaticivorans
MSGGEPVPKLSAKPAATYLRNTWYVAGWASDLAGEPQQRTFLEEPVALFRDGHGEAKAIGGRCPHRFAPLGHGSVVDGALMCPYHGLRFDGDGRCVHNPHPGGHLPDARQRVYPLVERHALLWIWMGDAAKADPASIPDFSWLSDPRWEAVRGATVAEGHFELYSDNILDLSHANFVHPALVASAFTEGERKFWQDGDNVFAEYVRLNDELSVGISAVMGTEGRPQDFYGMVKWHAPAVLYFDFRAGEPGTPREQCTLLPSLHAFTPETPDTTHYFWATARDYRLGDAEFTAGMRAALEFAFEQEDMPIIRDSHRLMRGEDFWALRPLILGGDGGGVRARRMLQRLIERERQQDAA

SEQ ID NO: 17283 - protein, 458 aa, Novosphingobium aromaticivorans
MNGINANRPHLPLARILEMNLGFLGLQFSFGLQQGNMGPIYSYLGADESQLPMLQLAGPITGLLVQPIIGAMSDRTASRWGRRTPYFLIGAVLCAFGLFFMPLSSSILMAMSLLWILDAGNNITMEPYRAYVSDRLNPEQRQAGFLSQSAFTGLAQMLAFLTPSLLVGLGMNQDWVDSHGIPYTVRIVFMIGAVLSLSTILWSVLRVPELPLTPQERAHIQAQPKGAWATLREIGEAIADMPVAMRKLGLMSLFQWVGMSGYWTYAVYSISRTVYGTSDVHSSAFHTAVLTNGEVAAFYNAISFVTAFAMVPLVRRLGPGPLHALCLFAGGVGMFLLPNVTDKALLFLPAIGIGLAWGSIMGNPYAILTNSIPPQRTGVYMGIFNMMIVIPMLIFAVVMSRLDLGFVSLGFDAYKQVLGGDPRNMLMFCGASLVLAGFSVLWVREGRAGAMPQSAVPA

SEQ ID NO: 17284 - protein, 525 aa, Novosphingobium aromaticivorans
MRKGGSRSNGWCRPSRFPASTRRSTRRRAATASRSSSSPDPRDTRSKTMEFNNNYHMLIGGELVAAEARLDVVNPANEQVIACVPDAGAAELDAAVAAARKAFPGWAATPIAERKAMLDALADSIFANVDGFKRLLTAEQGKPHHEAQGEIMGAGYWLKAYTALDLPETVNEDSDERLSITRHVPLGVVGAIAPWNFPMILAMFKVAPGLLAGNTMVLKPSPFTPLCTLKFAELAKEILPAGVLNVITGGDHLGPLMTAHPGFDKISFTGSTQTGRRVMASAAPTLKRVTLELGGNDAAIVMPDVDVEKIAEQLFWAAFTNNGQICIATKRMYIHKDIYEPLRDALVAYARTVKVGDGSEQGTQIGPINNEAQYNRVLDLIQDAKDNGYKFLLGGEKAEVPGYFVPITILDNPPEDSRIVQEEQFGPVLPLIRFDDFEDVLNRVNASDYGLGGSVWGSDEDKAFELAQRVQSGTVWVNETQHLSPLAAFGGMKQSGVGVEGGLEGLLEYTSAQTLVRRKKAAFVN

SEQ ID NO: 17285 - protein, 371 aa, Novosphingobium aromaticivorans
MTTCCAAVARGANQPFTIEQLTVDGPRAGEVLVQIAGVGLCHTDLVFRDQFDAFAKPGVLGHEGAGVIEAVGEGVTGLAAGDRVVLGFSSCGECARCAEDLPSYCVQFVPLNYAGMRLDDGSTAHAAHDGERVSSHFFGQSSFATLAVTRARNVVKVPDSTTVPLELLGPLGCGLMTGAGAVMNSMACKAGSSLIVFGGGPVGLAAVMAGKVRECSQIILVEPVASRRAIAQELGATHVIDPADGDLGEAIRAILPLGVDAALDTTGNVAVIETGLGNLAPHGIIGLVGVPRDMTASVTFNIAALMTPGLRIIGIIEGDAVPQDFIPELLALNAQGRFPFERMVQTFPLSRINEAIDAQARGDCIKVVLIP

SEQ ID NO: 17286 - protein, 256 aa, Novosphingobium aromaticivorans
MESRKATDRRAMMDDTDFTGRRVLVVGGSSGIGNGIAQAFRDRGAEVHVWGTRANAAGYDPAEGSDLAGLGYTCVDVGSPDAIEAAPAPFPALDVLVLCQGTVVYKRGEFEREGWDKVMAVNLDSLMHCSRKFRPQLAETGGSIIIVSSISGLKANIGNPAYAASKAGAISLTKSLGQAFAADGIRVNGLAPGLVDTKLTKVTTAHPQRLEGAIANIPQRRMGTPADMAGAAIFLASPLASYVTGHTLVVDGGLSL

SEQ ID NO: 17287 - protein, 748 aa, Novosphingobium aromaticivorans
MVRAGYRSQGQRNRGADASRQGNPGRIRARLCGRIHRRHARHAPHHRRALRPLRSGGDEARARMLRQAAERVRQAWICGLSRQHRVHGPDGGPLWPGQAQGRPDAEARARPERHPRAGQVRHPYLIRKRKQANEEDSPPGPGRARRARGRPHRPCPDRREPCQGPASVQDPVRRVPFGRGWKEPDRPQSCRRRRAQGRQGGWLQVFAGARQGLFHVGQGAARQVRGRPFQGRAGQPHALPRPRRRGRAAGLARLPCQREVTDAAMVQREALLLIGNADVAASGGATFERTGPLGGEPTVAAAASAADAIAAADAAAAALPAWAALGPNERRRLLLAGADALEAQTGAFVEAMAAETGASNGWAGFNVHLAAGLLREAAALTTQVKGETILSDRPGCYAMTLRRPAGVVLGIAPWNAPVILGVRAIATPLACGNTVVLKASEHCPATHRLIGTALRSAGFPAGVVNVVTNAPADAGEVVAALVNHRAVRRINFTGSTRVGRIIAGLAAQQLKPCLLELGGKAPMIVLDDADLDAAVAAAGFGAYMNSGQICMSTERIILEDGIADAFVERFRARVDGLTAGDPRAGSAPLGSVVDEATGRRVRHLIEDAVGKGARAHGDWQTGGTLIPAIVVDGVTPDMLLYSEESFGPVTTILRAANEDVAVRIANDTEYGLTSSVFSQNIARALRVAERIEAGMCHINGATVHDEAQMPFGGTKASGYGRFGGEAGIAEFTELKWVTIDTQTPHWPI

SEQ ID NO: 17288 - protein, 429 aa, Novosphingobium aromaticivorans
MAAGRRAFASFSVSPAQERIALLGRILSLMEERAEALAQAVTLEMGCAISFSRTAQVPFGVAHVRAALKVLHDFPFLTPQGSTAILREPIGVCGLITPWNWPLYQITAKLAPALAAGCTVVLKPSELSPFSAALLAQIVHDAGTPAGVFNMVTGTGPGVGEAIAAHGDIDMVSITGSTRAGVLVAQAAATTVKRVTQELGGKSPNILLDDADFERVVPLGIAAGMRNVGQSCSAPTRMLVPRHRLTEVEQLAANAANALVVGDPLAEATDLGPVANSRQFDKVQQMIAVGQAEGARLLCGGPGRPEGLDRGFFCRPTVFTCDDPAMRVAQEEIFGPVICVIPYDDDDHAVRIANDTIYGLGSHVQSADIDRARTVAARIRAGQVHINHPAWDGHAAFGGYKQSGNGREYGRFGLEEYLETKAVLGYFPQ

SEQ ID NO: 17289 - protein, 482 aa, Novosphingobium aromaticivorans
MSFPGGFAMRERLQQYIDGKWVDSEGGKRHEVINPTTEEPCCVITLGTQADVDKAVAAAQRAFKTFSKTTREERLALLERIVEEYKKRVPDLAAAMAEEMGAPVSFASTAQVGAGIGAFLGTMAALRNFSFVEDNGAFKVAYEPIGVVGMITPWNWPLNQIALKVAPALAAGNTMILKPSEECPTNAAIFTEILDAAGVPPGVFNLIQGDGPGVGTAISSHPGIDMVSFTGSTRAGILVAKAAADTVKRVHQELGGKSPNVVLPDADFAKYLPSTASGPLVNSGQSCISPTRILVPREREAEAAAFVSAMYSATPVGDPMQEGAHIGPVVNKAQFDKIRGLIQSAIDEGAKLETGGPDLPANVNRGYYIKPTVFSGVTPDMRIAQEEIFGPVATIMAYDSLEEAIEIANDTAYGLSACITGDPAKAAEVAPELRAGMVAINNWGPTPGAPFGGYKQSGNGREGGLYGLKDFMEMKAISGLPA

SEQ ID NO: 17290 - protein, 112 aa, Novosphingobium aromaticivorans
MKKVEAIIKPFKLDEVKEALHEIGVSGITVTEAKGFGRQKGHTELYRGAEYVVDFLPKVKLEVVVSDALVDRVVEAVAAAAQTGRIGDGKIFVIPVESALRIRTGERDDDAI

SEQ ID NO: 17291 - protein, 240 aa, Novosphingobium aromaticivorans
MFNGLIAYLDSIRSRDPAPRSRWEILLYPGLWAVGFHRVAHWLFEAELYFLARAINHFSRFLTAIDIHPGAKIGKHLFIEHGFTVIGETAEIGDNVTIYQCVTLGGTNPTNGIPGKRHPTLCDEAIIGSGAQILGPITVGARARVGANAVVTDDVPEGATMIGLKARSTLVPAETWLKQFIPYGTPCKEPCEPNGGTRVDDLEAEVAALKAQVAALMAARDGGDDLTPAPTPSRARRTRS

SEQ ID NO: 17292 - protein, 283 aa, Novosphingobium aromaticivorans
MAKACPRRSAIRNSSSPTSSSSPAVRPASLPLPDGATMTTTFDLSGKRALVTGAGQGIGRASAEAFRDAGADVLATDLNPHALASLDGCRSRVLDVTDAAAIAAMVAEEDGFDVVFNCAGVVHNGTILDCTDADWAFALDLNVTAMFRMTRAILPGMIARGGGSIINMASVASSILGVANRFAYGASKAAVIGLTKAVAADFVQQGVRCNAICPGTVHSPSLEQRLAATGDFNAAMAAFTARQPMGRIGRPDEIAALALYLASDASAFTTGQCHVIDGGWSNS

SEQ ID NO: 17293 - protein, 838 aa, Novosphingobium aromaticivorans
RTKGDLTRSIAVEASGEMAALKDNINEMILNLKDQTLKNAEQDWLKTNLARFSRMLQGERDLATISNLIMSELAPLVNAQYGVFYVTSRDDEEQNRLELVASYGAENHDQLKRQFALREGLIGQAAADKRPIRLSRVPDDFIRIGSGLGQAKPANIQILPALFEDEVKAVIELASFEEFNETHHSFLNQLMETVGIVLNTIAATMRTEGLLAQSQLLTQELQARQTELTRKQEELHATNEELQEKAQLLENEKKQVEAKNFEIEMARRAVEEKAEQLALTSKYKSEFLANMSHELRTPLNSLLILSKLLADNQQGNLNEKQTEFARTIHGAGTDLLNLINDILDLSKIESGTVSIDIGDMSIPGMKQHVERTFRQVASEKGLAFEIDFDDSLPASIQTDEKRLQQIVLNLLSNAFKFTARGRVTLNVRPARHGWSPTHPVLGDLDRALEISVSDTGIGIPEDKQKLIFEAFQQADGTTSRKYGGTGLGLSISREIARLLGGELQVRSVPGEGSTFTLYVPMKAVITSPALLAAPTTENDPVVTFAPQDDRDELDGKPFVMIVEDDPTFATILIDLAHQCGLKGVISSAGSGTVAMVRKLKPSAITLDLGLSDIDGFVLLDLLRNEPDTSSVPVHVISGADQAAHALTLGAAGVIEKPASREELQALFESIADRSRNAAMRRKTARATQSANMSDNQPRLAGSRILIVDDDIRNIYSLTSVLESHDVEVVHAEGGVEGIRILESTPGIDVALIDIMMPDMDGYETMRQIRATPAIASIPLVAVTAKAMKGDRQKCLDAGASDYISKPVDIDLLLALLRVWIGRSRSQQSLVTDQGMQVV

SEQ ID NO: 17294 - protein, 253 aa, Novosphingobium aromaticivorans
MELQGKIALVTGAASAAGLGFATARLLARRGAAVWLTDIDAAGAEARAAELAAQGFAARGMGHDVTSASGWAEVLFAIARQDGRGPDILVNNAGIAVLRWTPDLEPDEWQRQIDVNLTSVYLGCRAVLPAMRAAGDGAIVNISSVAGLVGIPGASAYAASKGGVRLYTKSLAMECAREGIRVNSVHPGVIWTEMQQVAIRDNPDQYDAINASIPAGRMGEPDDIAQAVAFLASPAARYITGAELAVDGGLTAQ

SEQ ID NO: 17295 - protein, 497 aa, Novosphingobium aromaticivorans
MGAFPQTIYFTGANAPVGEEPDLRGLKVEGDLPAEVRGSFYRAIPDPAFPPRFENDHTLSGDGMVSRLSFNGDGTADFIQKYVETARYKAEKAAGKALFGKYRNPFTDDPEVQGVDRTVANTTPVWHAGRMLMAKEDGRPYRVDPRTLATIGSYDFGGALKSETMTAHVRIDAGTGELFFYGYEADGQASTKVAYCIVGPDGELKREQWFDAPYCAMMHDFTISENYALFPIYPTTADLDRLKAGGEHWHHQPELDSWLGVMPRYGDVSEIKWFKGPKGCHSYHMMNAWEDADGMLHFDACLNNTNAFAFIREPSGIHMGPQDIKGALTRWTVDPRADGGDVVETVIGPPGDFPVIPAKLQGRPYKTGWMLSMNPELQGPPLFAGPVGVSFNLLLRLDGMDTPAPQVTGALALPPMAGFNEPVHVPAADPAKDGWLVFLVDQQVGDNQFVHEAWVVDAGNIGAGAVAKVHIPTRLRPQVHGWWVPQAQLDALEGSAA

SEQ ID NO: 17296 - protein, 461 aa, Novosphingobium aromaticivorans
MAIELKMPALSPTMEEGTLAKWLVKAGDEVRSGDILAEIETDKATMEFEAVDEGVIAEILVAEGTEGVKVGTVIATIQGEGEDAAPAAATPAVEQKVEMSEAAPSVEARAAPAVAIAPKVDAKPAVDPEIPAGTAMVPTTVREALRDAMAEEMRADDRVFVMGEEVAEYQGAYKVTQGLLDEFGPRRVIDTPITEYGFAGIGAGAAMGGLRPIIEFMTFNFAMQAIDHIINSAAKTNYMSGGQMRCPIVFRGPNGAASRVGAQHSQNYGPWYANVPGLVVIAPYDSADAKGLMKAAIRSEDPVVFLENELVYGRTFDVPQMDDFVLPIGKARIVRQGKDVTIVSYSIGVGLALEAAETLAAEGIDAEVIDLRTLRPLDKDTVLASLAKTNRLVVAEEGFPVCSIASEIMAICMEDGFDHLDAPVLRVCDEDVPLPYAANLEKAALIDAGKIAAAVRKVCYR

SEQ ID NO: 17297 - protein, 500 aa, Novosphingobium aromaticivorans
MRALRAGATVHVWRRPASRGTDTNPQREGEKGMSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 17298 - protein, 112 aa, Novosphingobium aromaticivorans
MKFIIAIIKPFKLDEVREALSGLGVAGMTVSEVKGFGRQKGQTEIYRGAEYSTNMLPKVKIEIAASDDLAPQIVETIQQAASTEAIGDGKVFVLDLASATRIRTGETGDTAL

SEQ ID NO: 17299 - protein, 295 aa, Novosphingobium aromaticivorans
MGTAGDQTGRSIAGLLNVPVHESGRSLVDRNQIRQRDVDMRFKDKVVIVTGAGSGLGLATVQRLAEEGATLALVDLREDWLEAARATLPDATRTKLIKADVADVAQVEAYVDATVAQFGRIDGFFNNAGIEGRQNLTENFGAEEFHRVISINLDGVFYGMAAVLKVMREQGFGAIVNTASVGGIRGVGNQSGYAAAKHGVVGLTRNSAVEYGQYGVQINAIAPGAIMTAMVEGSLRQIGGENWEEAGRQFVSVNPMKRFGRPEEVAALVAFLLSGEAIFINGATIPIDGGQSYKY

SEQ ID NO: 17300 - protein, 421 aa, Novosphingobium aromaticivorans
MGTSKPQGSLVQRSVWGSLELHIHPDALAVVRASAPDQPAILNRPHAAARAARFFVEKFPGKSLYAVKANPSADLLRVLWDSGVTHYDVASIAEVRLVRATLPEATLCFMHPVKAPAAIREAYEQHGVRVFSLDSFEELEKIKEACGFAEDLTLCVRLRVSSDYSELSLASKFGCDLTNAAELLQATRQAADSLGVCFHVGSQSMSPHAYVQALERVRAAIVDASVTVDIIDVGGGFPSIYPGMEPPPLEDYFGVIDRTYESLPISYSAELWCEPGRALCAEYNSMIVRVERRRGAELYINDGAYGALFDAAHVGWRFPVRVLREEVANDGVEIEMEPFSFYGPTCDDMDHMEGPFELPADMKVGDYIEIGMLGAYGAAMKTAFNGFGATEVFEVSDEPMASQYRGDRRDPRVSDNVVSLR

SEQ ID NO: 17301 - protein, 274 aa, Novosphingobium aromaticivorans
MQTAKCVLEIDLGIEPLGERPSMELNGKVILVTGGGSGIGAATCRLLGKAGAQVIVADRAGARAEAVAADIPGAWGVVVDVVDAAACEAMVEGIRERFGRLDGAFNNAGITEVTALGGAPIPETHALPLEVWRKVLSVDLDGVFNCLRAEIPLMLASGGGAIVNTTSLQAHISYPRTAAYTAAKHGVLGLTKAIAKEYGEQGIRCNSVSPGVVDTPLTAGVIHSPQYKDMLLAPIPLKRFATPEDIAKAALWLLSDESAYINGATLAADGGYLA

SEQ ID NO: 17302 - protein, 327 aa, Novosphingobium aromaticivorans
MSSETMGYNAAMGLGLVEEMRRDDSIFIMGQGVVTGGWFGMEKGLVAEFGNDRVLDCGIAEAFEAGLAAGAAIAGMKPVINMGFGDFALIAGDEIYHKLAKWRYMHGLDVPMTAVIIFPIGAMGGAGPEHSSCTEVLGMHFPGLKVVVPSTAEDAKGLMKAALREPNPVLFHSVQGLGWSRGDVPLDPDFVVPIGKAVTRRRGADLSIVTYGSMAPRSLKAAERLASEGIDAEVIDLRSLVPLDWEHVLESVSRTHRAMVVHEAFRTAGPGAEIAAQIQERAFFDLDAPVLRLGARDFPLCQNADLEQAAIPSVDAIAAEARRLAAI

SEQ ID NO: 17303 - protein, 254 aa, Novosphingobium aromaticivorans
MENRLFDLTGMTALVTGAAGGIGSSICHALARQGARIALSGTNPAKLRAFREELNDTYGNDHVEITCDLSNTEQVEHLVPAALDTLGKLDILVNNAGITRDNLAMRMKDEEWDAVIRVNLEAAFRLMRAATKPMMKARFGRIVTITSVVGATGNPGQVNYAAAKAGLVGMSKSLGQELASRGVTVNCVAPGFIRTAMTDVLPDGQKDALNARIPMGRMGEGSDIGAAVAYLASKEAGYVTGQTLHVNGGMAMIS

SEQ ID NO: 17304 - protein, 468 aa, Novosphingobium aromaticivorans
MASVLDAQNDYVVADIGLADFGRAEIRIAETEMPGLMALREEFGASQPLKGARITGSLHMTIQTAVLIETLVALGAEVRWATCNIFSTQDHAAAAIAAAGIPVFAVKGESLAEYWDYVGSIFDWGDQTANMILDDGGDATMFALWGARVEAGEPLFEPSNAEEIEFVRALKEFLKRKPGYLTMSVAHIKGVSEETTTGVHRLYQIAKDGKLPFPAINVNDSVTKSKFDNLYGCKESLVDAIRRATDVMLAGKVACVAGFGDVGKGSAASLRQGGARVMVTEIDPICALQAAMEGYEVVTMEEAVQRCDIFVTATGNEDVITAEHMKAMKPMSIVCNIGHFDSEIQISALNNYKWTEIKPGTDLVEFPDGKQIIILAKGRLVNLGCATGHPSFVMSSSFTNQVLAQIELFTKNAEYKNEVYVLPKHLDEKVAALHLEKLGVKLTKLSKKQADYIGVSQEGPFKPDHYRY

SEQ ID NO: 17305 - protein, 472 aa, Novosphingobium aromaticivorans
MADATRFYIGGEWVAPSTSVTTDIVNPANRSVVGQVALGGPADAEAAIAAARAAFPAWSATTREHRLAVLERINAALIARADEIGDAIMAEMGAPLGLARGAQAGSGPQHFEETIRVLKDYAFETPLGTTLLQREAIGVCVLITPWNWPMNQIATKVAPALAAGCTMILKPSEVAPLDAAILAEIIDEAGLPDGVFNLVHGTGPGIGDALTGHPDVDMVSFTGSTRAGIAIAANAAPTIKRVALELGGKSANILLPDADLAKAVPASVRGCMLNTGQSCNAPTRLLVPRTTLSRVEHLAREAAEAIVVGMPTDNPHMGPVANEAQYRRVIALIEQACHEGTQLLCGGVEPPKSLEHGLFVAPTIFTDVAPDATIAREEVFGPVLAIIPYETVDEAIEIANDSPYGLSGYVWGDPDAARNVARRMRTGMVHVNGASLDSAAPFGGYRMSGNGREWGVWGLEEFLEVKSIYGGA

SEQ ID NO: 17306 - protein, 455 aa, Novosphingobium aromaticivorans
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMARGFGGDFRPGGAGHPLCRRTASDPHRQRHALWPRRLFLCSRRGPDLAGDGSARIRDGRRQRRHHFHRSRAVRRDQAFGPGPRGIAPWPR

SEQ ID NO: 17307 - protein, 486 aa, Novosphingobium aromaticivorans
MRERIDIAGIPVSPDHFIGGKRVSSPYTFETRCPFDWSWKLADISRGTVTTAAQAAQAATDAFPAWAALSAAERGAYLHRLADLIEANVEKLAMIECLDMGMLLESLRLRVILRGAANFRNYADLATGHEERVWSSRGTLNRVIRMPAGPALIITPWNAPFMLSTWKCAPALAAGNTVILKPADWSPLSASILADLIEEAGFPAGVFNIVQGLGAELGNALTSDPRIKRISFTGSVPTARVIGKAAAENIVPLTAELGGKSPLLVFADADIDAAAKKAAGQYDDSGQVCMAGTRIIVEESVKDEFLAKFHAYADAHVMGDSRDAATTMSALIHPVHVERVLGFIERARAAGDAIVRGGRLWKEGSNWIEPTLIEPKNNQSEVVQSEVFGPVLTFQTFRDEAEGVALANSTAYGLSGIVYTGSAERAERVGRQVRGGTVWVNTFLVRDLTAPFGGIGISGIGREGGDYALDFHSDLKTLQILEGSVV

SEQ ID NO: 17308 - protein, 522 aa, Novosphingobium aromaticivorans
MDREACVEAKQREGRARLVLVTGAARGIGLACAHRFARAGDRVVMADRDLAACTFEAERLGSRHVALQLDVSDEAAVEHAMDGLLQQFGAFDVVINNAGVVDRFARPLLDVPPEDIDRLIGVNLEGPYLVVRAALRTILAGRRGAAIVNVASGAALRALPGRAAYSMTKAGVIGMTRAMAIELGPQGIAVNAVLPGYIDTEILLALEREGKFDRAAAAGAIPMGRLGRTDEIAEAVHYLARGGYHCGSLLSVDGGVDAYGGSGKASTAVMPHRPVRAGDVACVTGGASGIGAVVADRLAGLGWLVAIIDSREIADGPHPAWQADIASEASVESAMAGIAGQLGPVTLLVNNAGIVEPMAKSADQALADFRRTIDVNVKGTIHASRAAARQMIGAGGGAIVNLSSITASLGLPGRNAYCASKSAVTMLTRSLACEWAAHGIRVNAVAPGYILTPAVQALLASGERDMNSVVRRIPVARLGQPDEVADAIAFLASDAASYVTGATLQVDGGYLASGHPPDGPMP

SEQ ID NO: 17309 - protein, 261 aa, Novosphingobium aromaticivorans
MSVSVPPYPTPLGMLKGKTVVVTAAAGTGIGFAVAKRAAEEGARLLISDFHERRLGEAADRIAAEVGCERPATVVCDVTNEAQVQDLRDAALEKLGKVDVLINNAGLGGEVDVVDMTDDQWSRVIDVTLTSLFRMTRAFLPAMYANKSGVMVNNASVLGWRAQKGQAHYAAAKAGVMAFTRCAALEAADHGVRINAVAPSLAMHPFLAKVTTEERLAELVKTEAYGRPAEVWEVANVMLFLASDLSSYMTGEIVSVSSQRA

SEQ ID NO: 17310 - protein, 261 aa, Novosphingobium aromaticivorans
MPRERGPVQGADHIDLVGQVAIVTGGTRGLGRQIAEALVRAGAAVTVCGRTEPDDLPEGLHFHAADIREPDQATALVDAVVARYGRIDILVNNAGGSPQAPATASPRFFDAIVRLNLHAAMYMSQAAFAHMQPARRGSIVNIASVSGIRPSPMTAAYGAAKAGLLNLTQSLAQEWGPDGVRVNAIIVGLMQTETAGETYGDDEAQAAVGRSLPLQRMGTGVDIAGAVLWLCSGLASWVSGARINVDGGGERPYFLDLVKGN

SEQ ID NO: 17311 - protein, 367 aa, Novosphingobium aromaticivorans
MKTRAMVCHAPGAPLVEEELDLAPPGPGEVLIEIMASGLCHTDLSQLEGVAAPYPFPIVVGHEGAGVVREVGPGVTSLRVGDHVVPLGIGECGECGNCRSGLTNLCEAFLADMASQPTPFSLGGKRVSAYSGVGSLAQFIVTAERNVALIRKDVPFELACTVGCCVATGVGAVLHTADVGEGATVAVFGLGGIGLNVVQGARLAGASRIIGVDINPLRDAQGRRFGMTDFIDARNADPVDAIRALTGGGCDFAFECAGNIKLMQQAFESTRIGWGCTVVLGVPPDGAALSLVPFQLQLGRRVQGSFMGNMKGRSQLPGLLDHYAEGRLNLDDLVTHRLPMREVNNGFALMKRGEALRTVVSFARNES

SEQ ID NO: 17312 - protein, 584 aa, Novosphingobium aromaticivorans
MYSFALNRRTLIRSAALGGGGLALSAVLPAWARSGTSGLGVPMAEVSGEQIALSIGHASLRVGGRDGHAIGINGATPGPVIRLKEGQKVRLAVNNTLKEETSIHWHGLLVPFQMDGVPGVSFPGIKAGQTFVYEFPVRQSGTYWYHSHSGMQEAMGMYGAIVIDPAAPDPIAYDREHVIMLADWSFMHPHTQLRKLKAQPGYFNLQKQTLSGLLAGKDQSASERRMWAGMRMDPTDISDVTGATYHFMVNGHDSAANWTGLFAPGERVRLRIINAAAMTNFNVRIPGLAMTVVAADGQNVQPVETDEFQIGIAETYDVIVVPRADEAYGFIAEAIDRSGQVRATLAPRLGMVAPIPAIRERPLLSMQDMGMGDMAAPGADASATDHAAMGHAMPGMDHGSMKMRDPAVAPQVKMGPGVATLSPMPMDRTGERPTGLEKVDHRVLTYRDLKALPPNADKRTPSREIDIHLTANMERYMWSFDGVKFSENTEPIAFRHMERVRVNLINDTMMPHPIHLHGHFFELVTGNPGHHPLKHTVNVLPGGKVSFDLTADELGDWAFHCHMLLHMMSGMFRVVTVRHEEDAA

SEQ ID NO: 17313 - protein, 502 aa, Novosphingobium aromaticivorans
MMATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 17314 - protein, 269 aa, Novosphingobium aromaticivorans
MGWEKSGMTDANGRFADKIAVVTGAAQGIGFATAQRLGREGATVVVADRAEQATLDAVARLMAESVDAHPAIHDLEQQTGAAALYNAVSDKFGRIDVAVHNVGGTIWAKPYWEYTTEEIVAEINRSLWPTLWCCHAVLPHMRAAGRGAIVNIGSVATRGVNRVPYAAAKGGVAALTAALSLELEDCGIRVNCVAPGGVNVTRVTPRNTAPHSDADRKGFGEVMEQTLRDTPLGRFGEPEELAAAICFLAADEASYITGQTLYVAGGGIG

SEQ ID NO: 17315 - protein, 317 aa, Novosphingobium aromaticivorans
MAARGEPPDHARLHHLRPSRGSRRSAGHARPALCRREAEAAGERARRSGKAARGFHRPDERTHYRQDAGACLMGVLDGKVTFVTGGASGLGEAIARAFAAEGASVVVADIDVAGGETLAAQIGAQFVPLDVTQEGSWAEAVAPFERIDVLVNNAGITTLGSVEEITLDQFRHELDIDVLGVFMGIQATLPRMKTHGGSIINMSSLSGVKASANLVAYNAAKAAVTLMTKSCALHFADKGYGIRCNSIHPGAIHTPIIDKVLAQSDDPDALYRSFVDVHPVKRLGKPEEIAAIAVYLASDASAFATGAEFRVDGGASI

SEQ ID NO: 17316 - protein, 254 aa, Novosphingobium aromaticivorans
MARLSGKIALVTGGASVPGLGSATAQRFAEEGAKVWLTDRDLAGAEKVAEGIRAAGGQARALLHDVTNEAQWDEVFAAIEAEDGKLDVLVNNAGIAVLRPIAEMTTADWNLQNSVNLDSVFQGTKRAVVLMRKTGTKGSIINISSVAGLIGVPACGAYAAAKGGVRLFSKTIAVETAKDGIRVNSVHPGMILTNIQGVAQEDNAANYDATLALVPMGYMGDPLDIANMNLFLASDESRYVTGTELVVDGGMTAL

SEQ ID NO: 17317 - protein, 509 aa, Novosphingobium aromaticivorans
MHDGSRVMASSEGQLSKLGEAARTFLATRPGLLIAGRNTPAASGARRDVLDPSTGLVVTDVAEGGAADVDAAVAAARATFQSAEWRDMRPLARERLLHRLADLIERDADILAELEVIDTGKILPMARHGDLVIALDSLRYMAGWTTKIEGTTIDPSFSYIPPIRFSARTVRQPVGVVGQIIPWNFPLVMAIWKIAPALAAGCTVVLKPAEDTPLTALYLGRLIAEAGFPAGAVNIVTGGREVGMAIVEHPGIDKIAFTGSTAAGQDIQRRAAATMKRLSLELGGKSPVVILEDCPVPMAVEGAAGAIFFNHGQVCTAGSRLLVHRSIYEDVVQGLAHAANGMVLGEGMDPAGQMGPLISARQRDRVAGYVQGALDQGARLLAGGEAPDRDGFFYRPTVLADGTPSMTIFQEEVFGPVVIAMPFDTEEEALALANDSCFALGASVWTQNLAAANRFAGALRSGNVWINAHNILDPAVPFGGWKMSGYGRELGHSAVELYTEAKSITMPLL

SEQ ID NO: 17318 - protein, 579 aa, Novosphingobium aromaticivorans
MQEAMPKAYAQLAEVFELLERHYRDMQDIEFTVERGRLYLLQTRSGKRTAKAALKIAVDMVEESLVDEVTALLRLDPASLDQLLHPSLDPNAPRVLLGKGLPASPGAASGGVVFDAETAARWAELGEKVILVRHETSPDDIHGMHVATGILTARGGMTSHAAVVARGMGRPCVAGTASLKIDPVARVAEIGGQRLEEGAFITIDGSTGEVFLGELPTILPKLSGDFATVMAWADKHRRLKIRTNAETPLDCEMARRFGAEGVGLCRTEHMFFDESRILAMRQMILADSEKERRSALDQLLPEQRTDFRRIFEIMEGLPVTIRLLDPPLHEFLPHTDSEFTELSRAMGIDVEQVRHRAIELAETNPMLGHRGCRLGVVYPEIYEMQARAIFEAALEVAGEAGMAVCPEIMIPLVGLPRELESLKDTLYRVAEVVFAEKGERIAFSVGTMIELPRAALVADEIAASGEFFSFGTNDLTQTTLGISRDDAARFLGAYVEKGIIAKDPFVTLDIEGVGKLIEMASRKGRETRPDLKLGICGEHGGDPATIAFCEEIGLDYVSASPFRVPIARLAAAQAALAPS

SEQ ID NO: 17319 - protein, 227 aa, Novosphingobium aromaticivorans
MRSGARVSMPGMMDTILNLGINDATVTGLGQSSGDERFALDSYRRFIQMYSSVVLEIEHGVFEAALDRIKEDRGVDEDIDLRVEDLRGVIATFKDLVLAHHGAAFPQDVQEQLWTAIEAVFRSWDSPRAKVYRRLNDIPGDWGTAVNVQAMVFGNLGETSATGVAFTRNPATGEKAYYGEWLANAQGEDVVAGIRTPQYLTRGCPRSRRCAASLNAGSDAEGLCPTC

SEQ ID NO: 17320 - protein, 365 aa, Novosphingobium aromaticivorans
MDAYAAIIERQGGEFVLDNVSIEDPRDGEVLVKVAAAGMCHTDLTVRDQYYPTPLPAVLGHEGSGVVEKVGRGVTTVKPGDKVVLSFSYCGTCPSCLKGHQAYCPSLFPLNFMGRRLDGSTPITRNGQEVNACFFGQSSFATYSIASENNCVKVADDAQIELLGPLGCGIQTGAGSILNALCPEPGSSIAIFGVGSVGLSAVMAAKASGCLKIIAVDRNAGRLELARELGATDVIDANTVNAQEAIVAMTGGGADYAMDTTAIPAVLRSAVDSTHNMGETAVVGGAKLGTEFSLDMNNMLFGRKLRGVVEGSSTPQVFIPQLIAMQKAGLFPFEKLCTFYDLDQINQAVEDTEKTGKAIKAILKM

SEQ ID NO: 17321 - protein, 473 aa, Novosphingobium aromaticivorans
  unsure (1)..(473): unsure at all Xaa locations
AFVPLPNHRLMPGNVVFPCLPPVGMESTHHLGPVRDGWVYATARPDALGRTHATXLGPSGSRMKPGNSFAFQGLLWPSFRSNGNETYVSNTIFRNQSLGGAFQPAGAADMNDKSSDNFPPPGYTDQAHTAFDPAVARFRAQHPEDTFEGASGVLFEQAMAQTRMAICLCDPHEKDLPIVFANRAFRHLTGYDEHEVVGRNCRFLQGPGTDPAAVARIKAALEREDVIVVELLNYRKDGTAFWNALHLGPVYDADGRLIYFFGSQWDVSDVRAVRADERHARQLARELSHRMKNMFAVIGSIVNFTGRVRGIEVEAREINDRIQALGRAYETTLDDSHRETVEVGQAIRAVLAPYDPDGTRIAFEGNGLRSDFASVSVLGLSLHELAVNAIKHGALSADSGKITVAWRKNGSTEGPAIRIDWVEQSASPRVSLDTGNDGIVDRMLDMARGGIVREWHQDGLRARLNIPLRENAE

SEQ ID NO: 17322 - protein, 408 aa, Novosphingobium aromaticivorans
MKPLGPIPPGYETIDGELAVDGHKVTDLVMQAGGTPLFVYSRALLTRRVQDLRAAMPERLAIHYAVKANPYIPLLSHMLELVDGFDIASGGELAIVRDAGIDPAMVSFAGPGKRDAELEAAIAAAVTLNLESEGEATRALAIAGRLGIVPRLAIRVNPDFDLKGSGMKMGGGAKPFGIDAERVPALARKLISAGAEWRGFHIFAGSQALSADAIIETQAQTIGLAARLAEETGAPLPKCNLGGGFGIPYFPGDEPVDVVAVGAALGDQFAALPDVLRDTAFCIELGRYLVGEAGIYLATVIDRKESHGEVYLVTDGGLHHQLAASGNFGTVVRRNYPSAIATRFGAAVEEEASIVGCLCTPLDRLADKGGFPRTDTGDLVVIFCAGAYGASASPAAFLGQGPAREMLV

SEQ ID NO: 17323 - protein, 337 aa, Novosphingobium aromaticivorans
MAKMMYRDAVVSTIAEEMERDENVVMLGEDIVGGMGTPGGPEAIGGIWSTSTGLFGKFGADRVIDTPISESAIMGAAAGLALSGKRPIAELMFADFIGVSLDQIWNQLAKFRYMFGGKTKCPAVIRMAYGAGYNAAAQHSQAVHQILTGMPGLKVVMPTTPADVKGLLRTAIRDDDPVIFLEHKALYGVSGEVPDDPDFMIPFGHARLSRAGQDVTIVSTGLLLGFCEAVADKLAAEGIGCDVIDLRTTSPIDEETILDSVEVTGRLVVVDEAPPRCSLASDICATVAEKGFAALKAPPQAVNPPHTPIPFARELESAYLPSVDKIEAAVRKVLAYR

SEQ ID NO: 17324 - protein, 271 aa, Novosphingobium aromaticivorans
MELSAQRLKGRVAFVSGGLRGIGLACAERFLAEGAEVVLSDLDAEASDTARDVMARLGQAASYISANVAREEDWERAVALVKERHGKCHVLVNNAGIDLTGPVETLSMEGWRRIMSINVDGVFLGTKHFVPLMAESGKDFRGGSSIINVSSIMGLVGMNEVSAYNASKGAVRLFTKGIAIEFAQKKTPIRANSLHPGFVETPLLKAGFQRWVDQGFADKPDDLVAGVVGATPIGRLAQPSELASAAFFLASEDSSYMTGAELVIDGGWTAQ

SEQ ID NO: 17325 - protein, 266 aa, Novosphingobium aromaticivorans
MDCRRSKALNPNQVFLEGKVAIVTGAGVGMGAATARLLAARGARVVVSDINPDTAAATVETIRADGGTAHAVRTDVSDEAQVEALVAETVATFGRLDCAVNNAAITPDVLPIHEADMAVFDRVLNVDLRSVMLCMKYEIRQMLAQEGPGSIVNIGSVSSFRPQPNNAAYVAAKHGVIGLTKTGSLEYAGRGIRVNAVLPGAIDTPMLRGALETTGFTEADFAPALSLFGRFGKPEEVAEASAWLCSDAASYVTGHSLAVEGGYLTR

SEQ ID NO: 17326 - protein, 403 aa, Novosphingobium aromaticivorans
QRHARRILRPGDRSDRRVLVRPDQRRQRNLDALFQGLWLGRRTEPPGRLPQAVRRRARAWLSPRARRDHAQEPRHPARAEGRILPRHADRAQDRGPGPAAGRNRRREVRRTVLSQLQGRRDRELPAQPGRLNARHDQNRPRSAGRGHSMSIFDLSGRVAVVTGANTGIGQGIAVALAEAGADIAAVGRTPAEETAAKVRALGRKCELVSADLSTIAPVQDVVDEVLSSLGGLDILVNNAGIIRRADAVDFTEEDWDAVVDTNLKSVFFLSQAAGRHMIANREATGRRGKIINIASMLSFQGGIRVPSYTASKSGVAGLTRLLACEWAARGVNVNAIAPGYIATNNTSALQADETRNRQIMERIPEGRWGDPADIGGAAVFLASGAADYVQGHVLAVDGGWLAR

SEQ ID NO: 17327 - protein, 240 aa, Novosphingobium aromaticivorans
MSRVAVVTGGTRGIGQAICLALQAQGRTVVANYAGNEEKARTFTAETGIPAYRWDVGDHEATLEGCARVAAEVGPIDIVVNNAGITRDGVLHKMSFDDWNEVMRINLGGCFNMAKATFSGMRERGWGRIVNIGSINGQAGQYGQVNYAAAKSGIHGFTKALAQEGAKYGVTVNAIAPGYIDTDMVAAVPPQVLEKIVAKIPVGRLGHADEIARGVAFLTADQGGFVTGSTMSLNGGQHMY

SEQ ID NO: 17328 - protein, 428 aa, Novosphingobium aromaticivorans
MDGRPVRRARHPPRLAPARRRDYRRRVLPPPLRRRRARFPLLHPQPRRTVLCDLPPAWPSSPDSGAGESRVTLIPSPLIPSGARTAFLEQASQRILITDGAFGTEIQNFKLSEEDYAGTLGLAKDQKGNNDILALTKPEVPESIHRAYFEAGADIAETNTFSANRISQADYAAEHLVREINVESARLARRVADEFTARDGKPRFVAGAIGPTNKTLSLSPDVNDPGFREIDWDHLVDVYAEQVHALVEGGADFILIETVFDTLNAKAGVMSVRQVEKQLGREIPIMMSMTLTDLSGRNLSGHTVEAFWYAIRHARPLTVGLNCSFGATQLRPHVKALSEIADTLIMVYPNAGLPNELGEYDEMPQTTAGLVKEWADHGQVNVLGGCCGSTPAHIAAMAQAVKALPPRKMAVPETVTRLAGLEPFIMAA

SEQ ID NO: 17329 - protein, 404 aa, Novosphingobium aromaticivorans
MAMTRVLHVLDHSLPLHSGYTFRTRAILKAQEAMGIEVRGVTGRRHVAPPAAQEPEESDGLRFYRTPGAAGNLPLVREWAEVSALARRIVEVAGEWRPDILHAHSPALCGLAAVKAGRKLGIPVVYEIRAFWEDAAVGNGTGREGSLKYRVTRAMENDVVGAAARVVTICEGLRQDLVGRGFAPEKLSIMPNGVDLDLFGAPLPRDLGLAQELGLGDGPVIGFLGSFYPYEGLDDLVDAMPAIAGAVPGATLLLVGGGPAEADLRARAAASPAAPAIRFVGRVPHHEVDRYYSLVDVVCYPRKAMRLTEMVTPLKPLEAMAQGKLVAASDVGGHRELVTDGETGALFPPDDPAGLAAALVSLLAGRDGWEERRATARAFVRDRHDWAINVRRYQDVYQALLPSP

SEQ ID NO: 17330 - protein, 270 aa, Novosphingobium aromaticivorans
MLTRKKRERRVMGRLSGKVAIVTGGARGMGAATSRLFVAEGAKVAIADVLDEAGEALAAELGDAARFFKLDVTSEDNWASVVSEVEAALGPVDVLVNNAGILMFKSLLETTKADYEKVLGVNLVGEFLGIKAVAPGMIARGKGSIVNISSVDGMKGANSLVAYASSKWGVRGLTKVAAMELGHKGIRVNSVHPGGVDTVMSNHSGAAREDVDKGYANVPLQRIGGPEEVAAASLFLASDDASYLHGAEIVVDGGMTVGTYYMGFPGSPGM

SEQ ID NO: 17331 - protein, 359 aa, Novosphingobium aromaticivorans
MATSKEYGLGEFDFPRGWFMIGTAADATRIPAPIRYFGKDLVVYRGESGAPYVVDAYCPHMGAHLAKNSTSYIVRDGEHVEGESIRCPFHGWRFGTDGACNHIPYSDFIPKAAKLRTYPVVERAGILWMWHDPEGLEPDVELANFGGHHGEPGWVEWKIDYMGDLNSHGIEIVDNMADFGHFVPIHGATDWQYFANEFKGPHLHQYYSAGHRTLTANPEDFLVLDTWYEGPGFLQSEMAGAFDSFIMIANTPVEDGVSRCWHALMVKVHDGSRETTDEDRANALAYQEGSRLAFAQDVEIWANKRACLNPLAVPNDGPYGKVRLWYRQFYNPRDKAPEIQGRVNGLHVTLDKRPGQKVA

SEQ ID NO: 17332 - protein, 269 aa, Novosphingobium aromaticivorans
MSGALTGRTAFITGATGAIAEACALQLARDGARLALMARRPQGLDEVAARIRAEVPGAEIHAFIGDANDESAVAGAVRGAHGLAGRLDVAFATVGGGSFKPLIENTAQDLRDAFESNVVSAFHVIRAAAPLMRPGGSIVCLSSGAAVLTFRHLAAYHVAKAALEGLVRMAADELGPSGLRVNAIRPGLTRSGATEGMFEGGAAEAFLPEYPLGRLGEARDMAGAVRFLAGDESAWVTGQCIAVDGGNLLRRSPDLAPLPVVNTHSEGRI

SEQ ID NO: 17333 - protein, 252 aa, Novosphingobium aromaticivorans
MAINYGLDGKVALVTGAGGGIGRAAAQVFARSGASVMVSDVNEAGGAETVALIEAAGGKAAFVRCDVSNADEVKAMVKATVDTFGGLDCAFNNAGINRVTDDQYDDAIWERDIAINLSGVMRCMREESAVMLERGGGAIVNTASINGLVGNGSQPAYTAAKHGVVGLARHGALRWAKNGIRVNAVCPGVIETPMTAPLVQNPEIKALMDSMTPMGRMGSAMEIAEAVVWLCSPAASFVTGHAMVVDGGATAF

SEQ ID NO: 17334 - protein, 458 aa, Novosphingobium aromaticivorans
MSRAREGRPMSKPASPIATSRPKCLDAAPRWSAASSTPLARREFSATGRFRGSSATSMPDGPTWPTIRPRSAAISAACCSARRTWTASSDRRGVDAMATTAEYGLGPLTFPRGWFMVAVADEVTSTPQPVRFFGKEMVLYRGKGSGRVVLLDAYCPHMRVHLGRNTTSYVVKDGTHVEGDAIRCPAHGWRYTPEGKCDDIPYTTQPIPKAACVKSHKVVEKAGCVWMWHDMEGGDPEFDLPDFAEWDMEGEGWVRWRLDHLGTLPIHPQEIVDNMADLAHFRPVHGSTEIIRFENGFHDHIITQRLCSGHRTLVGSDQALVNDTWYTGPGILLSRMEGQHPSVIMICNTPVEDGEVRVWYALAVRVSDKAADDAGVALARAYQDTALEAFAQDFELWKYKEPAISILQVAGDGPFHKERIWHRQFYNPRERAGEFQRRVNGVHVSLGAAKDFAAEAAE

SEQ ID NO: 17335 - protein, 277 aa, Novosphingobium aromaticivorans
MPPPTRRSSMRRGFHQPKDAGLKWRLSDMGPKHDFAGAHVLVTGGTSGIGAASAALFRDAGAQVTITGTRGSAAEYDADLSGYRYLQLDIEDKDRIDAVAAALPRLDVLVNNAGFALPSIGLDEWEPDVFDRAVNMLLNAAFRMARRTVDLLAQSAVPGGGSVIGVASMSSYFGIPVVPGYGAAKTGLVGLTRTMAANWGPRGVRANAVAAGLTRSKMTAGTFEQEAWTAPTLSRTPLGRLGEADDIAQAILFLASPAASWITGQTLAVDGGYTISG

SEQ ID NO: 17336 - protein, 362 aa, Novosphingobium aromaticivorans
MKAAVLVEPGKPLDIQHLSVSKPGPHEVLIRTAACGLCHSDLHFIEGAYPHPLPAVPGHEAAGIVEAVGSEVRTVKVGDAVVTCLSAFCGHCEFCVTGRMSLCLGGDTRRGAGEAPRLTRTDDGSAVNQMLNLSAFAEQMLVHEHACVAINPEMPLDRAAVIGCAVTTGAGAVFNAAKLTPGETVCVVGCGGVGLATVNAAKIAGAGRIIAVDPMPEKRELAMKLGATDVMDAGPDAAAQIVEMTKGGVHHAIEAVGRPASGDLAVATLRRGGTATILGMMPLAHKVGLSAMDLLSDKKLQGAIMGRNHFPVDLPRLVDFYMRGLLDLDTIIAERIPLEGINDGFEKMKQGHSARSVIVFDQ

SEQ ID NO: 17337 - protein, 694 aa, Novosphingobium aromaticivorans
MVRASPPPADHRPLVVEEAMDDTQRVANSPIWHEGERALQAHVGVVDRMGEVGARVIRPFMPDQHRTFYAQLPFVILGSVDAEGAAWATVVEGEPGFLSSPDPKSLVLGALPHADDPALGGIHDEAALGLLGIELHNRRRNRVNGTLRFPSAGAPLLEVGQSFGNCPQYIQLRDATLSRAPAAPPPHLAEELPALDAAARAMIGSADTLFVASYADRLDSGRQVDVSHRGGKAGFVRVDAEGKLTIPDFAGNLFFATLGNVLLNGQAGLVFIDFESGDLLQMSGKAEVVLDSPEIASFAGAERLWTFVPQRIVRRKGALALRWSFRDNGWSPNSLATGQWPAALHWQQLRVERIVAESASIRSFHLRPVSPDLGWQHEAGQHLPIRVRLPGEDSPAVRTYTLSSAPSDPLYRISVKREGKVSAWLHEQVREGDIIEARAPAGSFVIEPGAPRLAVLIGAGIGITPMISMLRELVSLGANGAPARPAVLIQSARSLAERAFANELASLADRVRVVRVLGDAKGAQAGADYDLEGRIDLQLLSAVLPFGDHDFYLCGPKGFMQAIYDALRGANVPDHRIHAEAFGPSSLVRRRDTTRETAPAAQPSAVPVPVLFTASLKEARWKPGEGTLLELAEARGLKPEFGCRSGSCASCKVKLVSGAVAYPRTPSAEVASGEVLLCCAVPAEGNDKPLQVEA

SEQ ID NO: 17338 - protein, 238 aa, Novosphingobium aromaticivorans
MMPCDECALSPGRRGAIVPVRAGSGPDQSGAPMKLYHHPLSGHAHRARLFVSLLGLDAELVEVDLLAGEHKQPAFLALNPLGQVPVLVDDDGTVVSDSNAILVYLARKHDRTDWLPEDPASLAAVQRWLSVAAGELAFGPAAARLVTVFGSRHNPQEVITRAHGLLANLERHLEHRDWLVGAAPTIADVSLYSYLSSAPEGNVDLAAYPNVRALLARIEHLTGFVPFVRTAAGLRAAA

SEQ ID NO: 17339 - protein, 530 aa, Novosphingobium aromaticivorans
MIALPRFAALPSRGVPIAAAWAALAVALLIVDAVVPGESLALHGATLTSFCIFVLTCIRQARRDDDSQDTDREALRQELDAAECASAAKSRYLASVSHEIRSPLNAIYGYAQLVEREGTVDPRDAARVIRRSAEHLTNLVEGLLDIASIEQGVVRIDSTVARLDALVEQVAEMFRPLAVQKGLAFRCDLPARLPEFVRMDERRVRQVLINLVSNAVKFTQAGEVVLAVRWSGEIATFEVRDTGPGISPAHQETVFSPYQTGGVECGGGAGLGLAITRAIVDMLGGDLRLESRLGEGSLFRVVLMMPHVSGMVDCAAPRPRPVGYRGARRSLLLVDDDADHLAVLRCTLESCGFDVSLAPDGAAALALAHARAFDAVVLDIAMPGLSGWEVAERLRAAHGQSFRLVMLSANAEERHGPRGKEPDHDLFLMKPVELSALVDSLGKLLGLEWILSEGGGDTVLAQPRIDVSDSARTHVDRLKSLARIGHLRGLEAEIRSMQETDTGTAPLAARLFDCLDRCDLVAMRRVLEGI

SEQ ID NO: 17340 - protein, 466 aa, Novosphingobium aromaticivorans
MQFERINPMTGAVASQAEAMKASDIPSIAARAGQAFPAWAAMGPNARRGVLMKAAAALEARADAFVEAMMGEIGATRGWALFNLGLAASMVREAAALTTQISGEVIPSDKPGCISMALREPVGVILGIAPWNAPIILGVRAIAVPLACGNAVILKASETCPRTHALIIEAFAEAGFPEGVVNVVTNAPADAAEVVGALIDAPEVRRINFTGSTNVGRIIAKRAAEHLKPCLLELGGKAPLIVLDDADLDEAVKAAAFGAFMNQGQICMSTERIIVVDAVADAFADKFKAKVASMAVGDPREGTTPLGAVVDAKTVAHCRSLIDDALAKGARLLTGGETTHNVLMPAHVVDGVTQDMKLFRDESFGPVVGVIRARDEAHAIELANDSEYGLSAAVFTRDTARGLRVARQIRSGICHVNGPTVHDEAQMPFGGVGASGYGRFGGKAGIDSFTELRWITMETQPGHYPI

SEQ ID NO: 17341 - protein, 467 aa, Novosphingobium aromaticivorans
MADYKLLIGGNLVDGDMTMDVINPATGEPFCTVPRASAAQADAAIAAAKAAVPGWSAVPWAGRQAKLIELADAIAARKDEIARVLTMEQGKPLAEALGELAWTDGYLRHYATLELPDRVIQDDESGYIAVRHRPLGVVVGIIAWNFPLLVACWKIGPAVLAGNAIVLKPAPTTPVCALILGEICRDVFPAGVVNIITDANDLGPHLTAHPDVAKVGFTGSTATGKRIAASGADTLKRVTLELGGNDPAIVLEDVDVRETAQAIFGNAFLNNGQVCLAVKRAYVHSDIYDAMCGELARLAQAAVVDDGLQQGTQIGPIQNAMQFEKVKGFLDAAREEGTIVAGGEVMERAGYFIRPTIVRDVTDGDRIVDEEQFGPILPLIRFDDVEDVIARANASDYGLGGSVWSKDVARAADIASRIESGQVWVNQHIAIGPHIPMAGFKSSGLGVEQSVEGLAEYTQTQVVNIKR

SEQ ID NO: 17342 - protein, 259 aa, Novosphingobium aromaticivorans
MGRVQGKKALVTGAAQGLGAAHAWMLAREGARVLLTDINGEGATATAAAINAELGAGTAFAMRHDVTSADDWDAAIAFAAEKLGGLSVLVNNAGVGVRGNIETCTLEEWHRGFAINVDSVFLGCQKALPLLRDSQPASIVNISSIAGLIASDTMPGYNASKAAVWMLTKSVALYCAKRGWDIRCNSVHPTFVDTPILDGISANANLEKSVVMGKLARQIPLGRVGEPDDIAAGVLYLASDESRFMTGAELKLDGGISAM

SEQ ID NO: 17343 - protein, 434 aa, Novosphingobium aromaticivorans
MWRFRAVWPRPRKCRYRPLPRPRLSRPSDCSLFSSCNSVSRIAQFNRAVAIMLSDRHVKGRPHEMKTRAAVAFAPKQPLEIVELDLEGPKAGEVLVEIMATGVCHTDAYTLDGFDSEGIFPSVLGHEGAGIVREVGPGVTSVKPGDHVIPLYTPECRQCKSCLSGKTNLCTAIRATQGQGLMPDGTSRFSYKGQTVFHYMGCSTFSNFTVLPEIAVAKIREDAPFKTSCYIGCGVTTGVGAVINTAKVQVGDNVVVFGLGGIGLNVIQGARLAGAGKIIGVDINPDREEWGRKFGMTDFLNSKGMSREDVVAKVVAMTDGGADYTFDATGNTEVMRTALEACHRGWGTSIIIGVAEAGKEISTRPFQLVTGRNWRGTAFGGAKGRTDVPKIVDMYMTGKIEIDPMITHVMGLEEINTAFDLMHAGKSIRSVVVF

SEQ ID NO: 17344 - protein, 494 aa, Novosphingobium aromaticivorans
MAQFPNTPSFTGFNTPSRIEADIADLAHEGTIPQGLNGAFYRVQPDPQFPPRLDDDIAFNGDGMITRFHIHDGQVDFRQRWAKTDKWKLENAAGKALFGAYRNPLTDDEAVKGEIRSTANTNAFVFGGKLWAMKEDSPALVMDPATMETFGFEKFGGKMTGQTFTAHPKVDPKTGNMVAIGYAASGLCTDDVTYMEVSPEGELVREVWFKVPYYCMMHDFGITEDYLVLHIVPSIGSWERLEQGKPHFGFDTTMPVHLGIIPRRDGVRQEDIRWFTRDNCFASHVLNAWQEGTKIHFVTCEAKNNMFPFFPDVHGAPFNGMEAMSHPTDWVVDMASNGEDFAGIVKLSDTAAEFPRIDDRFTGQKTRHGWFLEMDMKRPVELRGGSAGGLLMNCLFHKDFETGREQHWWCGPVSSLQEPCFVPRAKDAPEGDGWIVQVCNRLEEQRSDLLIFDALDIEKGPVATVNIPIRLRFGLHGNWANADEIGLAEKVLAA

SEQ ID NO: 17345 - protein, 476 aa, Novosphingobium aromaticivorans
MTAYPSLHMIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 17346 - protein, 529 aa, Novosphingobium aromaticivorans
MPVFQIFWKIIAHLRRASSLPLREARHRLPPITSKTDTTMTAFDPDSIRPALAANFIGGEAVVGRGRSFEVLRPSDGQLLGELRAADEQQLCAAVENAAMAQKASGWGAMEPRGRMKLLRRWADLIEADAETLVPLEAVGSSRTLAEVRAWDLPYTAECIRFFAEFADKHGGEIAATTPDKLGFTLTEPYGVIGAIAPWNLPLVMAAWKLGPALAAGNAVVLKPSELTPFSVVRLAELAVAAGIPAGVFNVVQGGGGDIGDALVRHERIAKVSFTGSTRTGQAIMAACAMTGPKPSTLELGGKSPQIVFADADLAKASALVARAITLNSGQVCVAGSRLLVHEKARDEVVERLTTAFEAHRLGTTWDAATTMGPIISEGQLATIDGIVQRARAAGAEAVTGGARAVSPQSGSYYQPTLLAGMSDDNEAVQGEIFGPVLTVQSFADEDEAFALANGTRYGLAAGVHTTDISRALRAVRALEAGTVWVNRYGRSDDFILPTGGFKQSGVGKDLGREAYLGSCKVKTALIQI

SEQ ID NO: 17347 - protein, 485 aa, Novosphingobium aromaticivorans
MALQLNDPSLLRQAALIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFHIGGLKI

SEQ ID NO: 17348 - protein, 594 aa, Novosphingobium aromaticivorans
MDKNLLLDRRRLLVGSGALALAPLFPAWAQSGNLAGHGGHSRGSGPMAGRNSGGTLSGDTIALNIGEARYSVGRRSASAVAVNGTIPAPLIRLREGQTVRIAVTNHLKEQSSIHWHGLLVPFQMDGVPGLSFPGIDPGETFTYQFPILHSGTFWYHSHSGMQEAVGLYGPIVIDPALPDAAAPFDREYVLMLADWSPVDPHAQLRKLKTMGGYYNWQRQTVGGLIAGKDQSLKDRLEWAKMRMDATDISDVTGATYSFLVNGHDTEANWTALFRPGERVKLRIINASAMTNFNFRIPGLPMTVVAADGCNVAPVETDEIQIAIAETYDVIVQPGEAAPFGIIAEAIDRSGLVRATLAPQAGMVGPVPKLRQRPILTMRDMGMDMSGMDMGAGGEIDLSKPANESMDGHSMSMRDFSAAPGVKKGPGVATISPMPADRLADRGTGLENEDHRVLTYADLRSRDPNPDPRKPTRQIDVNLTANMERYMWSIDGETISDGAAPIPFRKGERVRVNLINHTMMPHPIHLHGHFFELVTGEAGNRPRKHTVNVLPGGKASFDLTADAEGDWAFHCHMLLHMHSGMMRVVTVRADKGDAA

SEQ ID NO: 17349 - protein, 296 aa, Novosphingobium aromaticivorans
MTEPFIQIITPVAHDLGAFEVRRAIPSRQRTMVGPFIFVDQFGPAHLPDGTAMDVRPHPHINLATVTWLFEGAIDHRDSLGSFATIRPGQVNLMTAGSGIVHSERSPATERPGGPHLYGMQTWLALPDGKEEIAPAFEQVTALPLVEDVCVNARVIMGTLWGQTAPTTQHAATIYAEILLAPGGSLPIDADADERAVMLVGGEAEIDGHPLALYDLVVLAPGAILKLQSGTGGRVMLMGGEAFSTKRHVWWNFVSSSRERINQAKADWQEGRFPKVPGDEEEFIPLPKVATTVSYP

SEQ ID NO: 17350 - protein, 215 aa, Novosphingobium aromaticivorans
MKLYGALLSPFVRKIAVVATEKGLSFEMARGGPGSTDPEFIACSPLGKIPAIDDGGFQLADSSAIAVYLDARYPEPRLIPEDPQLRGKAVFWDEFADTVLGASGLKILFNRLVGPKLLKTGGDEAIALQGEAELPRWVDWFESVVPGQGWLLGETFSLADIAVASTFRTLAYVGHGVDAGARPGTASWYDRVTARPAWAAVAEQEEVTARRIMAL

SEQ ID NO: 17351 - protein, 246 aa, Novosphingobium aromaticivorans
MRFRDRCVAILGGNAGIGLAAARLFAAEGAKLAITGRNAETLRAVAEELDALCIRSDMGDLNDTERALEEIEDALGGIDVLFVNAGVGGFAMVPDVTPEFWDQIHSVNLRGAFFAIQRALPLMRDGGSIVITGSIGSMAAVPGNVAYAAAKAGLRAMARIVGKELLPRRIRVNMVSPGPTDTEIFKRDASAEEIQGMKDMLSSVVPIGRMGTSEEVARAVLFLASAEASFINGVDLCVDGGCIELG

SEQ ID NO: 17352 - protein, 504 aa, Novosphingobium aromaticivorans
MNDMTTISRTQREYSEAAKAFLARKPQLFINNEWVDSSHDAVIEVEDPSNGRIVGHVVDASDKDVDRAVAAARAAFDDGRWSNLPPMVRDRTMNRLADLLEANADLFAELEAIDNGKPKGMAGAVDIPGAISQLRFMAGWASKVAGETTQPYTMPNGTVFSYTVKEPVGVCAQIVPWNFPLLMASLKIAPALAAGCTLVLKPAEQTSLTALKLADLVVEAGFPAGVINIITGNGHTAGDRMVKHPDVDKVAFTGSTEIGKLINRNATTTLKRVTLELGGKSPVVVMPDVDVAQTAPGVAGAIFFNAGQVCVAGSRLYAHRSVFDSVLEGMTQTAPFWAPRPSLDPEAHMGPLVSKEQHDRVMGYIEAGKRDGASVVMGGDCPSADGGYYVNPTILADVNPQMSVVREEIFGPVVVAQRFDDLDEVAKMANDTCFGLGAGVWTRDVAVMHKLASKIKSGTVWGNCHALIDTALPFGGYKESGLGREQGRAGIDAYLETKTVIIQM

SEQ ID NO: 17353 - protein, 288 aa, Novosphingobium aromaticivorans
MSRDARSRCAQTDGTAVVPRGPRQQGGPCLGRIHRTERKVTDLSGKHVVITGASTGIGRATATRCVAAGARVTLIARRADLLEQAARELGGSTAFAAADVADKAALKAALDHAVAANGPIDGLFLNAGIGGMFAPVEDYGDEAFDAVLAVNLKSVFWAIQHALPAMKERGQGAILVTGSLASERGLPMNAGYVASKHAVLGLSRAVANEAAEAGVRCNCILPGLIETPMLDGLPPEAASQMARAVPQGRTGSSDEVAQVAAFLLSDAASHVTAQALAVDGGMLGTMRV

SEQ ID NO: 17354 - protein, 149 aa, Novosphingobium aromaticivorans
MMRIASEHAKTIVKATAPAIEKHGVDITTAMYKRLFQNDEVKAMFDQAAQDSGEQPRRLAGAILAYAKNIDKLENLGSAVQRMVQRHVDTGVKAEHYPYVAEALLPAIRDVLGAEVATDEVLAAWGEAYWMLADILIAAEKQAYLEAVA

SEQ ID NO: 17355 - protein, 339 aa, Novosphingobium aromaticivorans
MPNGAFPRMSDPLYDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQRLG

SEQ ID NO: 17356 - protein, 640 aa, Novosphingobium aromaticivorans
MSQEPATPLLDTVKTPDDLRKLAPTQLRQLADELRVEMISAVGQTGGHLGSGLGVVELTVAIHYVFNTPEDRLVWDVGHQAYPHKILTGRRDRIRTLRQAGGLSGFTKRSESEYDPFGTAHSSTSISAALGFAIANKLSGRLGKGIAVIGDGAMSAGMAYEAMNNAEAAGNRLIVILNDNDMSIAPPVGGLSAYLARLVSSGPFLGLRDIARRLSRKLPRPLHEAARKTDEFARGMAMGGTLFEELGFYYVGPIDGHNIDQLIPVLENVRDAAEGPCLIHVVTQKGKGYAPAEAAADKYHGVQKFDVITGEQVKAKAAAPAYQNVFGETLAKLADADPTICAITAAMPSGTGVDKFAKAHPDRTFDVGIAEQHAVTFAAGLAAEGMRPFCAIYSTFLQRAFDQVVHDVAIQNLPVRFAIDRAGLVGADGATHAGSFDVTYLATLPNLVVMAAADEAELVHMTYTAALHDSGPIAFRYPRGNGVGVPLPEVPERLEIGKGRIIRQGSKVALLSLGTRLAEALKAADQLDARGLSTTVADLRFAKPLDVALIRQLMTTHDVIVTVEEGSIGGLGAHVLTMASDEGLVDGGLKIRTMRLPDLFQDHDAPEKQYDEAGLNAPHIVDTVLKALRHNSAGVSEARA

SEQ ID NO: 17357 - protein, 765 aa, Novosphingobium aromaticivorans
MDPVAYHQQFRHAPGVIFPQRFPVYRVVEQEARKRLYGRKQQQQGGGPHRQSRKIGTVTRLRAPGQFVRPLHAGTLSPPPARVNLQRAAGHALKRELRKQSLLQRLDVGDQFLALGRVGLAGISHARTRHRLHRAREEPVERRIVPGQTRRLHGGAERIACDVPCLCSVDAEQARPDHVLALLDGMARLADRERGWRGIGRSGRDRRGLGGGRGLAGRAGGRAGGRGCLSGRVALIPALRTAAGSKRQCERRRDRGVENRVHVCRLSFFPPAAQRPLDRSTPDGTKISVPGGLFFPWGRTRPMAPLPMFEKPPVHWTEELRAMLRLAAPMVGANLLQMAVFAVDVVFVARLGPVALAASSLSVSLFGLLVWSLSGLVGAASPLIAAELGRRRHAVREVRRTVRMAAWAGTLAGLFAMGVCLLGGPLMRVTGQQPEVIALAVPFLNVLMWAAIPSTISALLRTFVATLGRPTIGTVITGMAVAINAFGNWVFVFGNLGAPEMGLTGSALSSIVTTCAMVLAYIVVIRSDRRLRRYRLAGRWWKPEWKRFADVLRVGLPITGTILAEAGMFNGAAFLMGRIGEVELAAHTIALQFAAIAFQVPFGVAQAATIRVGLAFGAGERAAIARAGRVAVVLGMGFMVVTASIMLFAPRAILHLYVDPDAPENRAMAVLAVQYMAVAAAFQLFDGAQAVGAALLRGLQDTRIPMAFALFGYWLPGLGTAVGLGLFSPLGGLGVWIGLMVGLVVVASLMLWRWRNRARLGLLPA

SEQ ID NO: 17358 - protein, 163 aa, Novosphingobium aromaticivorans
MQPGDIIVCVLDRPRHSDLIAELRSLGCGISLIPDGDVAGVIAVTNEETGVDMYMGTGGAPEGVLAAAALRCVGGQFKGRLLFRNEDEKSRARKWGIEDLNKQYDLIELAKGDCIFAATGVTDGSLLAGVKVHKNGTMTTESVVMRASSGTVRWVKGEHRKVR

SEQ ID NO: 17359 - protein, 198 aa, Novosphingobium aromaticivorans
MTDKPTNPAASHVLDRVLVLEMVRVTEAAAIGASRLIGRGDEKAADAAAVEAMRAAFNELWMDGTVVIGEGERDEAPMLYIGEKVGAAPGTGPKIDIALDPLEGTTITAKAGPNALAVLAVAEEGGLLNAPDVYMDKLAVGPGYPEGIIDLDKTPSENVRAVAAARACSRATSSSACSIAPAIRISSRNCAASAAASR

SEQ ID NO: 17360 - protein, 464 aa, Novosphingobium aromaticivorans
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 17361 - protein, 341 aa, Novosphingobium aromaticivorans
MSFPQNSSARRPGRIEQGIGVGIEEQALRNALQDAAGDRLQSLKISGDAATIMLEVGGLDRLERDRLEMAVRDAARLAGVAEVRLGMTAERKARVIIAVGSGKGGVGKSTVSANLAVAMARLGRKVGLVDADIYGPSQPRLLMTEGRRPEAEGNKMIPIDSPYGVPMLSMGHLVQPGQAIAWRGPMAGNALGQLIDAHWGETEIIVVDLPPGTGDVQLTMLQKHKPAGAVIVSTPQDLALMDATRAIGLFEQGQVPIVGMVENMAGYICPHCGEESDPFGVGGAEAAAKTMGLPFLGRVPLDMAIRRESDAGNPPAAGDGPQAEAFLSIARGVLAWLDGRR

SEQ ID NO: 17362 - protein, 151 aa, Novosphingobium aromaticivorans
MTRWPLPEPMRLALDEALRAADEGEVPIGAVVVKDGKVVAAAHNRPRTLRDPTAHAEMLAIRAAAAQLGQERLEGCDLWVSLEPCAMCAGAIAHARIARVYYAASDPKGGAVEHGSRVFDQPTCLHRPEVYSGMGEAEAAEMLRTFFRDRR

SEQ ID NO: 17363 - protein, 330 aa, Desulfitobacterium hafniense
MNNEMAMERELTMEFARVTEAAALASARWVGRGNKEAADDAAVQAMRSVFDTIRMQGTVVIGEGEMDEAPMLYIGEKVGSGEAPELDVAVDPLEGTNSVAKGLAGAIAVVAIARKGGLLHAPDMYMDKIAVGPLAKGKIHLDAPVQENLANVARALGKSMDDLTVVILDRPRHEKIIHDVREAGARIRLITDGDVSPAVACAIEGTGVDVMMGIGGAPEGVWLQLRMRSLGGEMQGRLWPENEEDVLRAQKLGVSDVAKLYTMDDLVCSDDVFFAATGITEGPLLKGVHFTSQGALTHTVVMRGKTGTVRFIEARHRFDKKPAYAMKGAV

SEQ ID NO: 17364 - protein, 416 aa, Desulfitobacterium hafniense
MAVKNLPFNQEQLQKIMEDYGTPFHIYDEEAIRKNAQRLQAAFAWAPGFKEYFAVKALPNPYILKILGEEGFGADCSSLAELILAEKAGITEENIMLTSNNTPAEEFQKAKDLWAIINLDDITHIDYLEKHTGLPEVLSFRYNPGSLRAGNAIIGNPEESKYGLTKEQLFQAYEIVRDKGVKRFGLHTMIISNELNPDFFIETAEMMFDLAIELKEKLGIRLEFVNFGGGIGIPYRPEQEPVNLETIGEGVRKVYEEKIVAKGLDPLRICLECGRMITGPYGYLVTKVLHRKDTYKNYIGVDASMSDLMRPGIYGAYHHITVMGKEDLPEDHIYDVTGSLCENNDKFAVDRELPRIEIGDTLVIHDTGAHGHAMGFNYNGKLRHAELLLQADGSVKLIRRAETLEDYFATLDFSEL

SEQ ID NO: 17365 - protein, 112 aa, Desulfitobacterium hafniense
MKKIEAIVRPGKLDDVQSALDDFGVSGLTVTQVLGCGNQKGHTQVYRGVEYKVYLLPKVKIEVVVTDQDVDQVISIITQAARTGEVGDGKIFVYPVEEAIRIRTGEKGDDVL

SEQ ID NO: 17366 - protein, 285 aa, Desulfitobacterium hafniense
MILDKDSYVIFDGAMGTMLQKYDLAPGQPPEVLNITRPEVIEEVHRKYIKAGSNIITTNTFGAIETKLNGTGYSVEEVVQSAIAIARRAAGKNLVALDVGPTGELIEPLGDLSFEEVYDLYACQIKAAALTGNVDLVLIETFFDLTEAHAAIRAAKDHSSLPVICTFTFQQKGRTLMGKDIKTVVTSLEEYGVDAVGVNCSLGPGEMLSIVETMVSSTQLPILVQPNAGLPKLIGDRTVYDVEPEEFARYIQVMANLGVKWFGGCCGTTPEFISAIKESLGLKHN

SEQ ID NO: 17367 - protein, 112 aa, Desulfitobacterium hafniense
MKKIEAIIRPSKLDEVQSALDRFGVSGLTVTHVIGCGKQKGHTQVYRGVEYKVFLLPKVKIEVVVNDQAVDEVVRIISDEARSGEVGDGKIFIYPVEGAIRIRTGEIGETVL

SEQ ID NO: 17368 - protein, 896 aa, Desulfitobacterium hafniense
MDSRLHLVDNLPALLWSSDRAGNYDYVNQAWLEFTGLTFVEVRGEGWLSCVHPEDSPGVMNVLEHSRRHKAPFEAEYRLRRYDGEYRHCLSRGQPYDDPKGELAGYTGVIIDITERKAAEIMTRENAEKFREIFNRITDCVFIHEVKDDGQIGKIQEVNDMACELIGLTRAEIIDLSREVIKVKSPLTLANEFTQKLLSKNYLVFEGMLLTHQGKEIPVEVKAHYHVLNGRRMLLSIARDISNQKRIHKILLASHNKYRQLFDNITDAVFVYELQKDGYPGLLIEINEKARRLMGYHEETFMFSAGPCIRPSSPQLTLDDVWQSLERTHSASFEGICTNLEGEDIPVEVNCHTFPLNGSKVMLTLLRDITERKQIEQERKRTEAEFQQAKEKAEAANRAKSEFLANMSHEIRTPINGIIGMIDLTLLTSLEKTQRENLKIAKNCAYSLFKIINDILDFSKIEAGKLTVEEIEFNLKEVIEQIIKTHSPEAERKGLDLAYTLSANLPDYYKGDPERIKQVLNNLLSNALKFTERGEVSLAVKRLQGDEDVSDLKFTVMDTGIGIAEEDQLHLFEEFNQVDGSITRKYGGTGLGLAISRKLVEMMGGRIWVESEKGKGSSFGVVLRLKHGDKDTLRFKSTQNNDQSREGSTARSYRILLAEDHIVNSIVITEMLKIQGHRVDIAMDGEEALALYHQNPYDVILMDIQLPRLDGIEVTKRIRASEGAQSRTPIIALTAYALQGDREGFLQAGMDEYIPKPVMMEELIMVLDRVVTKFASGEGQAQQEEVVITDEGVYLKDISSFPESVNKDLELSEMAYDFKKLRIALNNGDSVALEHIAHRIKERCSVIGAHKLKALAFKIELAARRGNPGEAKDYLHDLDSEYNQLSGGMLNENTRS

SEQ ID NO: 17369 - protein, 281 aa, Desulfitobacterium hafniense
MVTTFLMGSSFAVVKIGLIYSSPLLLAALRFILAGGIMGIIVGVLKRTHPTTKDQWVKLLIIGAFQTAGVMGCIFLSLRTITASESAILTFTNPLLVVLFSTVFLKMRYRLYQWIGVILGLVGVSITMGAQIEFRIGVFFGILSAVFWAIATLLTKRWGGLTDIWVLSAYQMLFGGLILWVGSFILETPFFTVNGTALLILLWLSLISSIVQFALWYYLLQKGEPGKTSAFLFLAPFFGVLTGWLLLGDPLYPSLLAGGLLIIIGIFLVNKDFNHKRVSAN

SEQ ID NO: 17370 - protein, 77 aa, Desulfitobacterium hafniense
MGILAKIEQPRDLKGLTYPELEQLAQEIRAEMIDVVSANGGHLAPNLGVVELTLALHRVFDSPKDKIIWDVGHQAMS

SEQ ID NO: 17371 - protein, 493 aa, Desulfitobacterium hafniense
MVAVIGDGAMTGGMAFEALNHAGHTKTNMIVVLNDNEMAIAQNVGAMSSYLNRLRTDPRYDRSKDEIENLLKRIPGIGSKMAKAAEKAKDSLKYLLVPGLLFEEMGFTYLGPVNGHDQIALEQVFEQAKMVKEPVLVHVLTQKGRGYEPSEKNPALFHGVGPFNKVTGEVIKKPAPPTYTQVFGEALCELAEKDPRITAITAAMPSGTGLNLFAQKFPDRFFDVGIAEQHAVTFSAALAFGGMKPVVSIYSTFYQRAYDQVLHDVCLPHANVVMAIDRAGVVGDDGPTHHGVFDISFLRVIPNLVFMAPKDENELRHMLYTSLQLDGPVALRYPRSVGQGVELTEELRELPVGKAEILQEGKDITLIGVGPMVYTCLAAAVELRHRGVEATVINLRYINPLDRESILRYARMTKRIITVEDHMLAGGMGSAVMEVLGDEGLTDVVVERLGYDEYVDQGAISLLHQGYGLSVVGILKAAERLKVLQRIEGRSSV

SEQ ID NO: 17372 - protein, 148 aa, Desulfitobacterium hafniense
MNHQDYMRLALEEAEIAFAQGEVPIGAVVVHKGEIIARAHNEKELRQDPTAHAEVLAVQRATQALGIWRLSEATLYVTLEPCPMCAGSLVQARLKTLVFGAADLKGGAVGSVTNVLDVNRWNHRVEVVAGILEEECAQILKDFFRKLR

SEQ ID NO: 17373 - protein, 289 aa, Desulfitobacterium hafniense
MNQKKILREVLLPDGTKLPKLGQGTWYMGEKSRLWQQEVKALAMGIEYGMTLIDTAEMYGEGAAEELVGEAIKPYPRETLHIVSKVYPHHAGRKTIFKSCEASLRRLGLDYLDLYLLHWRGNIPLEETVECMNELVAQGKIKHWGVSNFDTEDMEELWQTPGGDRCSTNQVLYHLNSRGTEYDLQPWLKAHRLPMMAYCPMAHNLSTRQRIAQNPVVQEIAQNYGLTVEQILLCFVLGQENVMAIPKASQPDHVKDNAQVYDISIHEEDWQRINLAFPAPQHKTYLDIL

SEQ ID NO: 17374 - protein, 301 aa, Desulfitobacterium hafniense
MKYKPELGILIVTILWGASFAVSKLIMADITPNYYTFLRFAGAFLVLALCFHKRLRHIPKQTLQAGVIIGLAIACGYVLQTMGLNYTSASKAGFLAGLYVVLVPVMESFLCKTLPRYNMILGVFLATAGLALLSLERDFTIGFGDLLVFVGAVFFAVSMVLISRFASKHDPMVLAIIQIGVTALFSLVLAMFTEPGLSPAQFTPALLGLVLFAILFGTAVNTAVQNWAQGYLTATTAALIFVLEPVFAGVFGWLLVGDVIGMKQISGSALIISGMLVTLLLKPGQRPQGKTGHEAQLSGRS

SEQ ID NO: 17375 - protein, 496 aa, Desulfitobacterium hafniense
MNMGVDKKQNTVLYISSAIALLFVLWGVFLPENMANVVNKVFALLTTNFGWLYLLAVAIFIIFVFGIAISRYGKIKLGADDDKPEFSNFQWFAMLFGGGMGIGLVFWSVAEPIMHFNSPPFGEPGTVEAMQTSMRVVFFHWGIHAWVNFAIAGLALAYFQFRKGLPFLISSAFYPLIGDRIYGPIGKAIDILAVFATIFGIATSLGLGSSQIATGIQYIWGIPAGPLTISLVIAVITVIFTLATVSGLHKAMQSIANVKVWLSVAFMVFIFYFGGKVFILNTFTQSLGDYLQNFVGQTFWMANESWVGGWTIFYWAWWIAWAPFVGQFVARVSKGRTIREFVFAVTLLPVGFSFIWLAIYGGAAFNLDQISGGFIQNAVNADYTTALFALLQQMPLYAITGPLAILLIVTCFVGAADSATYVLAMLTSNGDMDPSKKLRSFWGIMQGAMTIVLIVVGGTAALKALQTASIASAFPFMLIMLVMCYSILKALRSDHP

SEQ ID NO: 17376 - protein, 553 aa, Desulfitobacterium hafniense
MPITYYRPNQEKNPEIEGRMDMETDTNSKNSKVLNRQPKTVNWALLGNIDPYVFIISALLAVGFLLWGVVDSEGLSHVSNTILDYIIQQWGWLFIVGILFFLLFCLYLAFSRYGDIKLGGQDTLPEYSTFSWFAMLFGCGMGVGLVFWSIAEPINHFLNPPAYVNALSPSQSAEWSLAISFFHWGLSAWASFVLIGLAMGVIIFRNKMPMLLSSCFYPLLGDRIYGPIGKLIDIITLWASLFGMTTTIGLGTKQLAAGVTYNYGIPQGIPLLLGILAIVIICYLISACTPNLKGIKIGSDLSLIATGGLLLFVFLFGPTKFIMDMFVNSTGVYIQNFFAMSLWTDPIEQSGWLGSWTIFYWAWWIAWAPFVGMFIAKISKGRTIKEFVLGALIAPTLLDMIFFGIFGGTSLSFELNQVSQGILANAINVDISSAVFVLFEQFPFREITSLILIFVIFTFFVVSADSCTIVLGMLSSGGNENPRIPLKLFWGIAMGAAAGLLLMLGDGGLDALQMASILGGFPFLFIMFAICYSIIKTLRREKSTNLVGIRERN

SEQ ID NO: 17377 - protein, 297 aa, Desulfitobacterium hafniense
MALGAENKDIVVLDADLSKSTKTADFAKHYPERFFNMGIAEANLMGTAAGLAAAGKIPFASTFAIFATGRAFEQIRNSIAYPKLNVKIAATHAGVTVGEDGGSHQAVEDVAIMRAVPNMTVLVPADGVETQQAIRAAAAYEGPVYIRMGRLDVPLLFDDQYQFEIGKANVLREGSDCVVFANGVMVAAALEAAQDLEQENIRVAVVNVASVKPLDVQTIVACAQKTGAAVTAEEHNIIGGLGSAVAEALSEQAPTPLVRVGIKDTFGESGRPLELLEKYGLTKKEVVAAVKVAIARK

SEQ ID NO: 17378 - protein, 420 aa, Desulfitobacterium hafniense
MTWLSQDNMESTIRDIGLAPQGQLKIDWVQAHMPVLNTLREEFEKTQPFQGKKVTICLHLEAKTAYLAKVVQAGGAEVTVAASNPLSTQDDVVAALVAGGVHAHAWYGATDEEYHQHLHKALDFEPDYIIDDGGDLVSTLHKERRELLPKVLGGAEETTTGILRLRAMEKNGELAFPMMAVNDAEMKYLFDNRYGTGQSVWDGIMRTTNLVVAGKTICVVGYGWCGKGVALRAKGLGARVIICEVNPIKANEAWMDGFEVMPMLAAAPLGDFFVTVTGNKNVISGEHFQVMKDGAILANAGHFDVEVNKVQLAAMAQSCHEVRRNIEEYLLQDGRKIYLLAEGRLVNLAAGDGHPAEVMDMTFALQALALHYLATAKTPLEPKVYSVPTEMDMRVAELKLKTLGLSIDQLSEEQKSYLAS

SEQ ID NO: 17379 - protein, 281 aa, Desulfitobacterium hafniense
MSDACGSCPSASSCTTGSCPSTQPEKTKAQQASNIKNVIAVMSGKGGVGKSSVTSMLAVSLMRQGFKVGILDADITGPSIPRIFGLRDKANMNEVGVIPGETSHRIKVMSLNLMIPNEDDPVIWRGSIITQLVQQFWTDVVWGELDYLLIDLPPGTGDVPITVMQSLPVSGVVIVTSPQQLAGMIVRKAINMVKKYDATIYGLVENMAYVACPQCEERIEIFGKPHGEAEAAQNEIPYLGQLPIDPVLATMSDLGKIEDYESAGFTQIAKNLAEVIQEKQK

SEQ ID NO: 17380 - protein, 248 aa, Desulfitobacterium hafniense
MSNPYEAANRGSWRVEQIEKYLPLVKRISGRLLISLPQHVDEDDLIGYGVFGLLDALERFDPVRGVKFETYATLRIRGAIIDGLRTMDWVPHSARQKIKRIQDAFAEVEARHGRPASNEEVAVLLEMEPRDLEAALHQGQMLTLTSLDEVAVGEEGEAYTPRTQLTDPIAQEAFQEVELDEQKKILADAIEKLPEKEKLVVALYYQEDLTLKEIAVIMKLSESRISQLHSQAILRLRGRLSRQKKNLF

SEQ ID NO: 17381 - protein, 394 aa, Desulfitobacterium hafniense
MKILVISHMYPSTQNPTYGIFVHEQVKALVAGGCEVKVISPVPYAPWPLPVLKKKWQAYASIPAKDRVDGIEVFYPRYPEFPRSYLLEHSGALMYLGLRNLVKTIDKEFPFDLIHAHVALPDGHAAYSLKKEFPVPTVVTIHGQDFQSTLHKGPACRKRLQEVLLGMDSVITVSTKLKNLVKDEPYYPKIQVINNGIHLAEIDRAEVGRSGARDQITILSVSNLKKTKGIDLNLQALASLVKTYPNLTYRIVGDGEERKNLEALAESLDLGNHVFFLGKLPHQEALQEMAQADIFCLPSWQEGFGVVYIEAMALGIPVIGVKGEGIEDVIDHGANGLLVRPHEVEDLAEALESLLKSPDYARKLAVAGRATVLAGFTWEHNAARMIELYRGLLG

SEQ ID NO: 17382 - protein, 479 aa, Desulfitobacterium hafniense
MKKEIRESLFIDGEWQEAINKEVKGVINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 17383 - protein, 313 aa, Desulfitobacterium hafniense
MAEKRMAYLAAIIYAFIIGLSFMFVKLTLTVATPLDTLAHRFTVAFLAATLFIFFTKHKVNIGWHDVAQIAPLATLYPILFFGFQIFGLARTTSSEAGIIQSTVPIFTLLLAVFILKEKVGRGQLISVFLSVFGVIYLLAMSGAESQTANIVGSVLIILSAFTNALYNVLARRLTQRYSLLTLTYIMTLFGFIAFNSLAIGSRVLAGTVGEFFQPLLHWQFVVAVLYLGILSSLVTSFLANFVLSKIEAAKMSVFSNVATLITILAGILFLQEAFHFYHVIGGMMIITGVVGTNLMGARSKAKEKAKTKDVEE

SEQ ID NO: 17384 - protein, 283 aa, Desulfitobacterium hafniense
MLRGKKLLIGVTGGIAAYKAADVVSRLRKQGAIVYVAMTKGATEFIAPLTLRTLSANPVYVDMFEEPKVWNVEHIALAEAVDAVLVAPATANLLAKMTVGLADDFLSTVLLATQAPIFVAPAMNHHMYHHPATQENLKRLRERSVRILGPAAGFQACGTDGDGRMSEPQELVEALQSFFAASGVLAGKKALVTAGGTQEPLDPVRYLGKRSSGRMGFAVAEALREAGAETILVSAPNELTNPTGVRRINIMTGQENECCGHGRIGRMDQVGKANRSDYRTGTS

SEQ ID NO: 17385 - protein, 564 aa, Desulfitobacterium hafniense
MKRLGLSNVRIRTRFVILLVGILAVSLLMNVVWIWMTQQKQAEREMHEKAYVLSQQMEAAWEFMVINQDIINYDANGEYNFKKLHCSLVGKSIGKLFGKKTGYTIRYTNFNPRNKADIPDEFELEALTLFAADVKTSEFYKVSEYAGKGAFRYTAPMRIEENCLECHGEPAGELDILGYPKEGWKIGDLAGIVSIVMPTAMYTENIQSNVVKQVGYISLLTLSIIMVIYYAMSKLVTRPLNQLKDAMGHVKTGDLKVDLKDIDAQGEIRDLSDHFEIMTQELQTLYDDLENKVELRTQDLARANDILESQQIQLEEANRRLREDNQYKSDFLAIISHELRTPLTSIIAFAEVLEKASEDKCPKEQKITQEIRANSQVLLRMINNILEIARIEAGKQELIIEPIDLVDVINAVESVIEPLIEKKSIQYSSVLHSDVPVIEGDREGLRRIVENLLSNALKFTPEGGEIKVWVAYDQERNEVLINVQDNGIGIRKEDQPYIFEKFVQSDSSIHRQYNGSGLGLALAKELAELHGGWIKVVSELDKGSLFTVGISAGEGKEDWLHLDF

SEQ ID NO: 17386 - protein, 105 aa, Desulfitobacterium hafniense
MKMIRSIIRPEKAEVVAEALADAGLTSLTKMHVFGRGRTKGIRIGDVVYDEFPKTLLLMVVPNENLEKAIQIILEKSKTGTMGDGKIFITEVEEAYTISSGTKGL

SEQ ID NO: 17387 - protein, 127 aa, Desulfitobacterium hafniense
MKEIIACIRRHQVPATKKALEEAGFPALTIQSIEGRGKQYGIGGWEAEVDPELNKVLRPQQVTESRINWIPKRMLTLIVQDQEVEAAVKTITAINKTGHCGDGKIFVCPLHEVVRVRTGEVGKEAVL

SEQ ID NO: 17388 - protein, 882 aa, Desulfitobacterium hafniense
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLEPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENQAIYAQFVKTSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGEKVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQAAARLVKEGYEIYPEVMIPLVIHVKELAKLRKVTEEAAQTVMAEQGVTFAYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSKGQ

SEQ ID NO: 17389 - protein, 261 aa, Desulfitobacterium hafniense
MMIQRLTEMNLPRFPLLSDEEMMDLLHRAQNGDAEARERLINCNLKLIFNLVQRFSHRGYELEDLFQIGTIGLIKAIDKFDFTYGVKFSTYAVPMIIGEIRRFLRDDHPVKVPRSYKELVYKVNKARESLSATLGRDPTIGEIAESIGVDREDIVSALEAVQSPTSIHDTLYQDDSDPIYILDQLPMEKDLEAGWFEKIALKEVLDKLPEREKRVLMMRFYEDKTQSEIAALLNLSQVQISRIERAALHRIRQYLHEPEHD

SEQ ID NO: 17390 - protein, 514 aa, Desulfitobacterium hafniense
MEYSMEGFMKSASKVDKTIVWSSLIVSSAFIIATLVTPSGVSQILNAIFSFFTKNLGWAYMLSAAAFVAFGIGLAVSKYGHIKLGKDDEEPEYSRGSWFAMLFATGMGVGLVFWGAAEPIMHFDTSPFAANRTPEAASIAMRTVFFHWGLHPWALYGVVAMSLAYFQFRKGLPGLISSTFYPLIGEKGIRGPIGKIIDVIAVVVTLFGVATSLGLGTQQLTTGMNYVYGLPNTTSMALVIIAIITILFTIAAASGIDKGIKFVSNTNMVLAFLLMLFLLIVGPTKYILNTFFESMGNYLQNFVSLSFFLDTQGAVAERTGYDWIGSWSVFYWAWWITWAPFVGSFIARISRGRTIREFVLGILVAPPLLSAIWFSIVGGSALHIELFGSGGISAAVAEDVSSGIFAMLSHFPLSGPVALLTMILLAIFFITSAESATFVVGMFTSGGDLNPDARLKIVWGVVEGAIAAMLLVAGGLSAVQTVAFIFSFPFMLIMILMVVSMVKALGEGEKKPLQ

SEQ ID NO: 17391 - protein, 520 aa, Desulfitobacterium hafniense
MNFSFSFTRREVMNEGQGSIKIDKKIFFPPLVLVSLICAYIIKYPEAGSATINKVFAFVTGDLGWAYELFVFANLGIILYFIFGKFANKRLGDEKPEFGTLTWLGMLFSAGTTGTILYWSSMEFYFFLTAPPFGAEPLSPEAWKYSLAFSFFDWGISAYGLYVAVGVVFGYFFYVLKKDVFRPSTACEGLLGERVHGPLGKVIDIFYMIGIIAGVATSIGLGTPIISEIFTKLSGQPRTLAVDAVIILIWTVIIAISVYGGLEKGIARLSNFRIYLGYAILALVAILGPTAFMLNNTFDALGVYLNDFLRMSFYTDAHLGTGFPQNWPIFFFAWFLAFALSTGIYLARISKGRTVREFTLGATFSGVLCAFLYFAVLGNYSIDAFVNNKVDIGRIVAESGGFRAAVEIWSTLPFSSVFLVAILILVFISTATSINSIAYTLAMVSSNKLEKGQDPAKWNRLSWAIIIGGLSLTLMFLGGLTPLQTAATAGSLPTMIIMAIILIGFFKTAGKSWGEESDKQ

SEQ ID NO: 17392 - protein, 437 aa, Desulfitobacterium hafniense
MEGFKIKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 17393 - protein, 280 aa, Desulfitobacterium hafniense
MIWHAFCLYKHSDSKVVGEESPRQKAGRGRCLFMAKFAGRVAVITGGAKGIGEAIVRKFYGEEAKVAVLDVDAAGARQLALELDPSGEKVIGLGCNVVSREGVKAAFAEIMAKFGTVDILVNNAGITRDAIFHKMTEQQWDDVMAVNGKGLFNCTQEAWLIMREKKYGKICNLSSTNSSGEAGQANYSFTKAGTIAFTKSLAREGGRYNINVNCVRPGVIDTEMMRAVPEQALEDYINKTAFKRMGQPSEVADVIAYLCSEESSFVTGEEILVAGGYIYR

SEQ ID NO: 17394 - protein, 530 aa, Desulfitobacterium hafniense
MKNLLQEKLEKIPKSKSVDARINPVVFWGSAILCVALYAPMMIFGTELQPFVAAALKAITYRMDWLWLLFALGCVIFSLWLAFGRYGNVKLGGPDDKPQFSNFSWISMMFTGGVGAGLVYWTMAEPIFYLKWPPYWGEAFSAQAAQFSLAYGIFHWGISAWAIFVPGAIAFAYMIYVRKKPYFYPSYACRGILGDRVDGWLGRVIDIFVIIGLVGGLGTTLGTVVPMISAVTANMLGVEDSMTVKVGVTLVISAVFGYSAYSGLNSGIKKLSELNSWLCMGLLAFVMLVGPTLFMLSMYVDSIGVWATNFLRMSLYTDPITKSGFPQDWTVFYWAWWAAWAMYFGLFVARISRGRTIRNVVVNMMIVTTIGCSLFFLVFGGYAVDLQLNQGVALDQTLAEFGGGAMITQVLNTLPLTAIVIPYFLFVMLIFQATTIDSNAYIISMIACKEVKNDQESPRWTRLFWCSALAVIGVAIMTVGGLPVVQLSSVATSVPTIIIIVILGMSLCKWLKEDFGKEKEVQVIDYPEED

SEQ ID NO: 17395 - protein, 276 aa, Desulfitobacterium hafniense
KDVFHTFMIGTYFFPLLGGWLADRYFGKYNTVIWFSLVYCAGHACLALFEHNQTGFYTGLFLIAFGAGGIKPLVVSFCGDQFDQSNKHKAKLVFDAFYWTINFGSLFASLLMPIFLREYGPSVAFGIPGALMFLATFIFWLGRKRYVLVPPTRNAPDPDSFFNVARTALRAKTAGQGNPGVAVAAVGVALAAGALALIPSLGFVKSACLALGLLIGFGGYGISLQLERARGIHPDAAVDGVRAVLRILIVFAFVTPFWSLFDQKASTWVLQGQRMV

SEQ ID NO: 17396 - protein, 186 aa, Desulfitobacterium hafniense
SLDKLRTDYVDLTLIHWPAPGNGVALSEYMAALAEAKALGLTRQIGVSNFNIELTRQAIEAVGKGEIATNQIELSPYLQSRKLTAFLKEQGIAVTSYMTLAYGKVLKDPVLGQIAAKHHATVAQVALAWALQLGYAVIPSSTKRENLASNLLARDLKLDADDMALIASLERNGREVSPEGLAPVWD

SEQ ID NO: 17397 - protein, 263 aa, Desulfitobacterium hafniense
MILPVGVPNFAEALRAGAEVFHALKSVLKGRGLSTAVGDEGGFAPDLRSNEEALETILEAIGKAGYKAGEDILLGLDVASTEFYDNGKYHLVGEGKRLTSEQFVDFLANWAAQYPIVTIEDGMAEDDWNGWKLLTDKIGNKVQLVGDDLFVTNPKIFAEGIDKGVANAILIKVNQIGTLTETLEAIAMADRAKYAAVVSHRSGETEDTTIADISVATTATQIKTGSLCRSDRVAKYNQLLRIEEQLGSAARYAGRDAFVSLRR

SEQ ID NO: 17398 - protein, 338 aa, Desulfitobacterium hafniense
  unsure (1)..(338): unsure at all Xaa locations
LALPRLGAATGAAIYCALSPPRGAATRDGXXGXXXSXXRRPGPNGARFESSRLAGPGIPPAPPALELIRMNAVPKTFSTEGDYKVADISLADWGRKEIDISPEHEMPGLMSIRKKYAAAQSLKGVRVTGSLHMTIQTAVLIETLRDLGADVRWASCNIFSTQDHAAAAIAASGTPVFAWKGESLEEYWDCTLAALSFPNGQGPELVVDDGGDVTLLIHKGYELENGDGWVNTPSGNHEEQVIKNLLKRVHAERPGFWHEVVKHWKGVSEETTTGVHRLYQLAEAGSLLIPAINVNDSVTKSKFDNLYGCRESLADGLKRAMDVMLAGSRRVTLAAGSG

SEQ ID NO: 17399 - protein, 220 aa, Desulfitobacterium hafniense
MTLPSRKVAVLGATGSIGASALDVIARHPQALSASVLAAGGKVEALLALCERHRPEHAVIADAAGFDALREGLRARGLGTQAHCGSQALDDLVGSDACDTVVAAIVGAAGLDSTLAAARAGKRLLLANKESLVLAGELLMRAAHEAGACIVPIDSEHNAIFQCLPDAHAHAGLRRILLTASGGPFRGRTRSQLGEVTPEQAVAHPKWSMGPKISVDSATL

SEQ ID NO: 17400 - protein, 166 aa, Desulfitobacterium hafniense
MAKARDEYFAETGIYVPICSDGGIVHDYHMTLALAMGADFIMLGRYFARFDESPTNKVNINGSYMKEYWGEGSNRARNWERYDMGGDKKLSFEEGVDSYVPYAGSLKDNVTLSLNKVRSTMCNCGVLAISDLQEKARITLVSATSIVEGGSHDVVLKDNNMVEYMK

SEQ ID NO: 17401 - protein, 221 aa, Desulfitobacterium hafniense
WKAAVDAADFPQRDAAARLRVPKDSHAAFAADALTHDVRAEQDKLRRADALILQFPLWWFSMPAILKGWFDRVYSYGFGYGVGEHSDTHWGDRYGEGALAGKRALVSVTAGGWQPHYAPRGINGPIEDLLFPINHGLLHYPGFEVLPPFVAYRSDRLDAEQFEQTRAALLQRVDGLWRDAPIAFRRQNGGDYELPSLLLKPGREAGGERGFALHVTPAGAV

SEQ ID NO: 17402 - protein, 288 aa, Desulfitobacterium hafniense
MVFGKEGKKDMKKRDIKKMIRGQRATDGAGVRLVRVLGRRDVEDFDPFLMLDSFDSTDPEDYVAGFPMHPHRGIETITYLIAGEIDHEDSLGNKDTIHAGESQWMTAGSGIMHQEMPRESAWMLGFQLWLNMPRGEKMAPPAYLSITQDKIGKAAKEGAEIRILSGRLGETAGVTTKHIPATIYDVSLVQGGEVEIPTHPEENVFVFLIEGDALINGELIAAKTAVLFGEGEYISVAAPPGLELRFAFFAAKPLGEPIAWGGPIVMNTREELEHAFAELREGTFIKHK

SEQ ID NO: 17403 - protein, 355 aa, Desulfitobacterium hafniense
MFVIFGQRSRPRRAGRALLPRLPARGPRRSAWQYRPRRAHGGFVGDMLGLASGFAGLRAIDGVLHFAPTLPQRWHGFGFGLRWQGRRLRIEVRRDGVEYSLLDGAPLTLAHAGHYVELSQGQPLRRALAAAEVDARERFPRPAQALIFDLDGVLTDTAQTHYRAWKRMADEEGLAFDQHVNERLKGVDRMSSLEIILRHAGRTLSAEQKLALAERKNGYYVEAIAEVTPADLFPGVTRVLERARARGLKLGLASASRNAAVLLDRLGIAERFDYIADAARIARAKPAPDIFLDVAAALGVAPAQCIGIEDAAAGVAAIKSAGMAAIGIGDARTLAQADACLPDIAAFDVDAFVSP

SEQ ID NO: 17404 - protein, 267 aa, Desulfitobacterium hafniense
MAPLQRTHIAAGAGRRGAGARRPHRRTPAAPAGAGLSPARNDSLPTQGFHRMTTALNEAAAAVVRATVPALAAHGHAVTTAMYRRLFRDERIAALFNHANQGGDNAQAHALAGAILAYAQHIDDLPALSGALERIAQKHVGYHILPEHYPFVAGALLGAIEETLGEAATPQVLAAWGEAYWFLADLLQRREAELRGELAQVVGGWSGWREFVVAAKRAENASSDAAIVSFELRPADGGAVIAHRPGQYLTLRYPVPGQARQAQYSIS

SEQ ID NO: 17405 - protein, 325 aa, Desulfitobacterium hafniense
MKEKPARELKQRVSDLDIEVVSGMEGLLRTVTDEVPDTVVTAISGRIGLEPTMEALKAGKDIALANKETLVAGGDLVMGTAQRLGRTILPVDSEHSAIFQCLEEDPRTLDKIILTASGGPFRGWSEEQLREVTPERALQHPNWAMGAKITIDSATMMNKGLEVIEAHHLFNMEYDQIDVLIHPQSVIHSMVQYCDGSVLAQCGRPDMRLPIQYALTYPTRWPNPFERLDLRGKTLSFFDPEDYDFPALKLAYACGKRGGTLPAVMNAANEVAVHAFLARRVAYLEIIGLVDKVCSEHDVLDATDLETILNADHWARIRTEELIHS

SEQ ID NO: 17406 - protein, 221 aa, Desulfitobacterium hafniense
MDTLQGIELTAEQIDEVYEQIGRMGIDIIPEAGEVEALEKVTDEIPDDVDDPDVEEEVDVDLSIPEGVGIDDPVRMYLKEIGRVPLLTAEEEIELAKRMEQGDESAKRRLAEANLRLVVSIAKRYVGRGMLFLDLIQEGNLGLIKAVEKFDYVKGFKFSTYATWWIRQAITRAIADQARTIRIPVHMVETINKLIRVSRQLLQELGREPTPEEIAVQMDIS

SEQ ID NO: 17407 - protein, 338 aa, Desulfitobacterium hafniense
MRAGQGPHRVDQAHRQIHRRPRHRHPGGVRNRPVRLALNPQPHHRAQRYSIAASACRLAAPGPRARRAGSQDAAVISSGATTSQHYGVKPMSTTPLSGEIALVTGASRGIGAAIADELAAQGATVIGTATSESGAKAIGERLAAHGGHGRVVDVADPASVESLLDAVAKEIGAISILVNNAGITRDNLLMRMKDEDWQAILDTNLTSVYRTSKAVMRSMMKARKGRIINIASVVGVTGNPGQANYAAAKAGVIAFSKSLAREIGSRGVTVNVVAPGFIDTDMTRDLPEDAKKAMFDQIALGRFGEPADIARAVAFLAGPGAGYITGETLHVNGGMYMP

SEQ ID NO: 17408 - protein, 601 aa, Desulfitobacterium hafniense
MQRLNGLEHYQREVGRWVLRDRAGVERGIPAVEGTGLFRDRAGRLWLPTARGLFRWDPKQLRLRRFGVQDGMSSQEFLRRASVLTGDGTLAASLSDGSVVLIDTAWPDPAPRQPRLVWHQLDVRRHGRWVPLALNKPVRPSGSERASRYEALPTLAPDDREMRVQMRLLSFDDPQANRYYTRLEGYDSDWVAVGESGERVFAGLPPGSYVLHARAIDANGNTALERVLEFNVRPPWWRTPPALAALLGLLALAAWWGTMLYRRRLARRLNWQRAEHEREVAKQASLAKTRFLATLGHEVRTPMTGVLGMSELLLDTPLDQKQRGYTESIRRAGEHLLRLVNDALDLARIESGKLELAHEPFDVRALVAQAADLMRPLAQQRGLVFEVHVAASVPRGLRGDASRVCQILLNLLGNAIKFTEVGSVKLSVERLTPQGVRFEVSDTGPGLNEEQKQRLFRRFEQAEGARTAARYGGSGLGLAISQELAAAMDGQIAVYSEPGQGARFVFDLPLANAEPPAGAGGAATHLPRPHAGPLAILLVEDDATVAEVIAGLLRAQGHRVTHVGHGLAALAETATARYDIALLDLDLPGINGLDLARKCGT

SEQ ID NO: 17409 - protein, 456 aa, Desulfitobacterium hafniense
GMGKGKSLWPPNCGPGSPQRRRQPFRGMIRSREIKDEFLARTSHELKTPLHGIINISGHLLKGETSSLSLEQRENLLLLQDTSSRLSLLVNDLVDIIKLRHEDLQLNLITVDLYVVIQLVFQLLSFDLQGKEVKMLNKVKPMTFVEADENRLRQILYNITSNAMKHTEKGEIVAQAREEGLDIVLTISDTGKGIPQEHWELVFKDFNHDSLPQQDYKQGMGLGLYISRQLARKMKGEVWIADSVVNKGTSMAVRLAKGQCLNTEMTAGSVLERKVWSSKPTSSGLSEKMKKILIVDDEPTNIRVLSLMLEGEYQVSAAYSGEKALESLKNEKFHLLLTDLMMPGMSGIELTQQIRQNYSLIELPIIIATARNREREIELAYQNGANDYITKPFTAEEVQWRVRSLLKLTDTMEKAFESEMAYLQAQIKPHFIYNALSNIIALCHEDGEKASEMYPS

SEQ ID NO: 17410 - protein, 151 aa, Desulfitobacterium hafniense
MDDEVWEHNLSVDLTGVFRIAREFGKVMLEAGYGRIINISSMYGMVGNSATPASAYHAAKGGVVNLTRALAAEWADRGVTVNCLCPGYFETELTVDLLKTEEFKAYMERTVPLKRYGNSGELNSAACFLAADESSYVTGAILPIDGGYTCV

SEQ ID NO: 17411 - protein, 223 aa, Desulfitobacterium hafniense
MVFGQIKQDIKVIFERDPAAKTIVEVILCYPGLHALIAHRLAHCLYKKNMVLIPRLISQTSRFFTGIEIHPGAKIGQGLFIDHGMGVVIGETAEVGDNVTIYQGVTLGGTGKEKGKRHPTVGNNVFIGSGAKILGSIKIGDNVKIGAGSVVTKPVPSNTTVVGVPGKVVSRHGMPLKELHVVTKSVCNKEIRAEEMPDPVQETLQILMERINYLEKKLGEKES

SEQ ID NO: 17412 - protein, 561 aa, Desulfitobacterium hafniense
  unsure (1)..(561): unsure at all Xaa locations
MSEKYENSFKTIEKLSDRLVVLDKLKDDFLAKTSHELKTPLNGIINISQSLLDGAGGSLSRAQAEDIRLITSIGKRLSTLVYDILDYSKLKVMDIQLHIVCLDVHQVAESTVDIFRYLIKGRPITLENKIPPNQHLIWADENRLKQIFSNLLDNSLKYTELGSISLSCRQDGGFLWIQVSDTGIGIPADKLKDIFAPYEQLGEQSANQRGIGLGLTITQQLIELHGGQIVARSEPGQGTSFTFSIPLAKDNKPQRSLPGDYVGYDGSESLATEALPQTVHVGGEFSILVVDDEFSNLKALMNILTLNQYNVTVAINGEAALHLLKGAFHYDLCILDVMMPGISGYEVCRKIRETYSPLELPILLLTAKALPEDMEAGFRAGANDFIEKPFEVRELKCRVSTLVQLKNSMDLLLKKETAFLQAQIRPHFLFNALNTIYSFCYTNPGKAGELLAELGVFLRSSFDFSSTASLVTVEKELRLVKAYVAIEEARFGSQLEVEYAVEPSVLXSHSFLMISHREIHPLGVRKPGEALSWTLDASGNQKGAPPREVCQTPPGWHTGVA

SEQ ID NO: 17413 - protein, 252 aa, Desulfitobacterium hafniense
MRLMNKVAIVTGAASGMGKSIALLYAKEGAKVVVSDLNLEGAHKVAEEITSAGGTALAIKTNVAVEEDIQALVDTAVSTYGTVDIFVNNAGIMDNFEPAADIEDKNWERIFAVNTTSVMRATRKVLPIFLEKSSGVIVNVASAGGLNGARAGATYTASKHAVIGFTKNTGFMYAQQGIRCNAIAPGAVETNIGSTITDPHKFGSARAYAGMATNPRMGKPEEIAQVALFLAAEESSFVNGAVIVADGGWSAY

SEQ ID NO: 17414 - protein, 522 aa, Desulfitobacterium hafniense
MMKDSLTHRFMLFTTIVVVFIMLINFIWDYRNQRAQATLKMHEKAQVITKQLIATREVIAKNQNRINYDSKGNFEFKHLNPAAVGMQIGDIFGQLTHYSIKQTRLDYRSAGNAPDDYEAQGLLRFSNEPHLAEIWGEDVVAGERVFRYMVPLHMQEECLSCHGEPIGDLDITGHCKEGYKVEDLGGAISLIMPMDIFLHGIKLNVYRHLSFSLLLIGVIVISMYLLVTRLVTRSLGELKGATAQVGQGDFDIDLNRIKAQGEIKELAQHIQEMADQLKDLYQNLEAKVEKRTHQLKLVNEDLRIKQDELEAANIKLNEINTYKSEFLAIMSHELRTPLTSVMAFTDLLLQDLPKELKQERQNLKYIKANSQNLLKLINNILDLAKIEAGRLELKLEYVDMADVMGAIDSVIAPLAKKKGITWEISLDPEVSLLRADPEKLRRVIENLVGNAIKFTPAEGRVEIEVKHGPRDNWLMIRVIDTGIGIPPEEQEEILNGYPDRQLNSRNMEVRSGLPWPRISRLT

SEQ ID NO: 17415 - protein, 510 aa, Desulfitobacterium hafniense
MKNKIALKLTLYFSLSLLLFSLIIGSVFMTLFKNQTVQLHKVDMEKRATSIAGTLSTLISNSNAAATQGNEAGGTNGMNSANRMGGMMHGMGMGGMGGMMYGMGGYSSYLQFLDEIAMADVWLVDETLQLMTIGHMTNRQINYADLPADADQVVKEVFQGNTTFSEGFSSLLNTPTLTVGAPIKAGEKVVGALLLHSPIQGTKEALQQGAGILAMSITVALLLSLLLSIVLAYTFTKPLNRMKNSTLQLAKGDYLAKTGVQQEDEIGELASAIDILSERLESASHESDRLEQQRRDFIANISHELRTPVTVIRGSLEALCDEVISEPDQIKAYHRQMLKESIFLQHLVNDLMDLTRLQNPDFKIEMENTSLGDLLRDVLRSAQNIACGKGILLKTDIEPEAPLCSIQGDYVRLRQMFLIILDNAIKFSPAEEEVWITFANNTVAIRDKGPGIPPENLPHIFDRFYKSSAVENKTGTGLGLAIAKQIAHRHRIQITVDSQPGQGTQFSFHF

SEQ ID NO: 17416 - protein, 317 aa, Desulfitobacterium hafniense
MEKKKPRRKLPIGWVYPNPIFRGWKSGLSAVCGKNLSVWNKFQFQRAYSSKMKNGLEGAQMALNKVEICGVNTSKLPVLSSAKMKELFVAYQSGEKEAREKLIYGNLRLVLSVIQRFTNRGEYVDDLFQVGCIGLMKAIDNFDLSQNVKFSTYAVPMIIGEIRRYLRDNNPIRVSRSLRDIAYKALQVRDQLVNECSREPTVSEIADKLTLPREEVIFALDAIQEPISLFEPIYHDGGDPIFVMDQIGDEKHSDNSWLEGIAVREALRRLSEREKLILSLRFFHGKTQMEVADEIGISQAQVSRLEKAALGHMRKYV

SEQ ID NO: 17417 - protein, 679 aa, Desulfitobacterium hafniense
MRKMLMALVAVSFGCFLLLFGLLETTDNKVLKSELSQQGVLDLRDWDAASDQVVPLDGQWEFYWHQLLEPGGEPDSAANVIQVPGFWRNDMATRIDHARGAATYRLTIKLKPSDTVYGLRISNIRMASAIYVNGNQAGGSGKPALTQDEYQYENKPYNVFFPVQGDTAEILIHVANYENNQGGIPYRLYFGSAQGIHTLNTNTTLLNVSLIVSLLMLGCYQLSVFIIRREEKGPLYFGLSCVVIAWSYASTGDRLLIEYFNLPTEIYYKIQAISLYSSLIPMAMFIKTMCKGLIPRWLTKGIIYGMGLYSGVVLVTPFQWYSPFNLLFSFIQMAANIIIVGLLLYSFRQGRYGEFNRKSLGLFILALGCYLLGLIDYGLYLSSVVLDYKLGYYAILSFCFLASFIMSYQFSEAYKTIESMAAELQQADKQKDEFLLHTSHEFQTPLHGIINLSQAMLETEGELSENHLQNLAVIRDTSRKLSALVRDILDLDKIKRNELTVHPAEVDVRVTVSLVFDLLKHLITAKKIRLINRVPEDLPFVYADENRLRQIIHNLVGNAMKFTSAGTIAISAQVLENHVKIMVEDTGVGIAPSDWDTVFQLFEQAHSPNEYGGTGLGLFICRKLVQMMDGEIYIDWSEPERWNRIAFIWRWRAKIVLGPASVRPGKLPMDEPVHGSDSN

SEQ ID NO: 17418 - protein, 221 aa, Prochlorococcus marinus subsp. pastoris str. CCMP1378
MYMNYLISSFYLGYYFKVEFQVSIFVGNLPFRAEREDILELFTPYGEVMNCSLPLERDTGRKRGFAFVEMADEALETSAIDGLQGTELMGRPLRINKAEPRGGGGGPRRGGGGGRGGYGGGGNGGGYGGGGNGGGYGGGGNGGGYGGGGNGGGYGGGGRGGYGGGGNYSEPASSYVNKSSGAEGWEDRSYGNSSENSDFENGRSRRKRSVASNSEISQEGN

SEQ ID NO: 17419 - protein, 430 aa, Prochlorococcus marinus subsp. pastoris str. CCMP1378
MKETIDFLIDTIEARQVLDSRGNPTVEAEVFLECGAIGRAIVPSGASTGAHEAHELRDGGTKYMGKGVLNAVNKIHETISPALCGLSALDQTSIDNLMIEIDGTPNKSSLGANSILAVSLANARAASNALDLPLYRYLGDPLSNLLPVPLMNVINGGAHAPNGLDCQEFMLVPHGVKTFSEALRIGTEIFHSLKSLLEKKGLSTAVGDEGGFAPELSSSEAAGDLLLEAIQKAGFIPGEQVSLALDVASTEFYKDGFYKYEGKSLTSSQMISYLSNLVSNYPIVSIEDGLAEDDWEGWSALNKEIGNKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGDQARFAGDLGLGPKNI

SEQ ID NO: 17420 - protein, 418 aa, Prochlorococcus marinus subsp. pastoris str. CCMP1378
MNVKSKELKVKVLLLITGSIAAVRIPLLVSQLVKDNYEIKCVVSENAEKLIQPLSLSILSRNNCILDKDQWSYLHSRPLHIDLCEWADVLIIAPLTATTLSKWVTGNADGLISSILIANNKPIIVAPAMNSKMWSNKAVQRNYVYLKDYPNVLILKPSKGILACDEIGVGKIPPNDLIQLALKFLLLQNKKPYYRDLLNKEFLITGGCTSENIDAARKITNNSSGTMGLMLAQVARFRGAKVKYIHGPLKNKLDITEGINTYEIDNSNDLIQEIEKEISKCDYFIMNAAVADFKISGDTSKKIPKSKFEDFLNKNIEYVPDILKEISKVKKENQIFVGFCAFTGSFKSAKKSIKEKIMLKGCDLLFANPIDIEDQGFGSLAKNEGWLFDKKNMENYLEKTSKIELANNLIDEIISTKK

SEQ ID NO: 17421 - protein, 494 aa, Prochlorococcus marinus subsp. pastoris str. CCMP1378
MTNLQDKKIDKPKSFNKEDWSSAYQNVEKELTNEPLKISKGNNINNLNGTLLRNGPGILERGGQWVHHPFDGDGMITSIKFENGQPFLTNRFVKTKGYLEEEKINKFIYRGVFGTQKNGGILNNALDLKFKNIANTHVVKLGDEILALWEAAGPHAIDPDSLDTIGLTTLKGVLKPNEAFSAHPKKDLNSKASSELLVTFGVQTGPKSTIRLMEFNNTGLNSGELIFDRKDTFNGFAFLHDFAITTNWAIFLQNAIDFNPLPFVMGQRGAAQCLKSNPNKKAKFFIIPRESGLFRGQPPLTIDAPEGFVFHHVNAFEKDSKIVLDSIFYDDFPSVGPDENFRDIDFDKYPEGKLKRSFIDLKKKTCELETLSEQCCEFAVVNPKNLGLTATFSWMASTSQKLGNAPLQAIKKINLTSKEEISWSAGPSGFVSEPIMVPSENSSKEDEGFLFILLWNGERRGSDLVILDANDLKELAVYELPISIPHGLHGSWVN

SEQ ID NO: 17422 - protein, 249 aa, Prochlorococcus marinus subsp. pastoris str. CCMP1378
MSNTESLTGKVALITGASRGIGKEIALELSNLGAKVIINYSSSDEKAEEVVNLIKESGGKVHKLKFDVSKEESVSKAFEEIIKINGAIDILVNNAGITRDGLLMRMKSEQWDDVLNTNLKGVFLCTKYASKFMIKKRSGKIINISSIVGIIGNPGQANYSAAKAGVIGFTKTCAKEFASRGINVNAIAPGFIETEMTEKLNNEEIIKAIPLGKLGSCSQIANLVSFLVSSNAGSYITGQTISIDGGMSI

SEQ ID NO: 17423 - protein, 396 aa, Prochlorococcus marinus subsp. pastoris str. CCMP1378
MCPAATESKSSNPSSKKKINKKIDSNFKNDREEESIKYQDPIQNSKQKPLNDEGSIENKDEFNGSDEEAKAIGNVKLGPKGIYTEDSIRVYLQEIGRIRLLRPDEEIELARKIADLLQLEELATQYESEKGHFPSVREWAELTDMPLSKFRRRLLLGRRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKVLSQEFGRKPSEEEIAESMEMTIEKLRFIAKSAQLPISLETPIGKEEDSRLGDFIEADIENPEQDVSKTLLREDLEGVLATLSPRERDVLRLRYGIDDGRMKTLEEIGQIFDVTRERIRQIEAKALRKLRHPNRNGVLKEYIK

SEQ ID NO: 17424 - protein, 338 aa, Prochlorococcus marinus subsp. pastoris str. CCMP1378
MIEKNNLFDLKKDIDLIGLGNAIVDIIVNVDDEFLEINTLKKGSMNLINSNESEALLKNCTVIKKISGGSSANTVVCLAELDNNVQFIGRVKNDNFGNFFSTDIKRSNTIFNTPPIDKGPSSAHSIIFITPDAQRTMCTYLGASIEFEPKDVNYKLIANSKYLYLEGYLWDSDLAKNAFLQAAKLAKESDTKIILSLSDSFCVDRHRESFLELIENYIDIVFCNESEVLSLFQENDLQRCQESISSICELVIITLGSKGSLVVNKDKSEEIKPKLLGKIIDTTGAGDLYAGGFIHGLINNYSLKKCGEIGSICAGQIITQLGSRSNINLQNLLRKHLI

SEQ ID NO: 17425 - protein, 333 aa, Prochlorococcus marinus subsp. pastoris str. CCMP1378
MNQTLIQEILEVVEQAAIASAKLTGLGQKDEADAAAVEAMRLRMGKIEMKGKIVIGEGERDEAPMLYIGEEVGSGNGPGVDFAVDPCEGTNLCANNQRGSMAVLAASDTGGLFNAPDFYMNKLAAPPAAKGKVDIRNSATENLKILSNCLDLAIDELTVVVMDRARHKGLIKEIRECGAKIQPISDGDVQAAIACGFAGTGTHCLMGIGAAPEGVISAAAMRALGGHFQGQLVYDPAIAQTSEWADYTKEGNIKRLNEMGITDIDKIYEANELASGENVIFAGSGITDGLLFDGVKFEKDCTRTSSLVISTLDSTCRFTNTIHMKDGAKSISL

SEQ ID NO: 17426 - protein, 440 aa, Prochlorococcus marinus subsp. pastoris str. CCMP1378
MENKQINFFKTKDINTVLKPFKKGTVVNIDNLEVREKQKELKLGLHGWYAICPSTELKKNKIHYFSLFDEPLLLFRDKNNNVRCIKNICPHRGSSFYGGSISNGELTCPYHGARFSSQGNCQNIDRITCSHIVDNNYDNYAKRIHLSQFKVVERESYIFIYFTDKSETDLNKFNDDSLISNYDLTANGFSVKDSVSEEVLVDFKCDWSRIIENHLDILHIFWVHGDTIPDKDVNKNVLVSFNQKININPNYIESIYFYKNNPTKEFIRIKYIPPGRILIYKGDPAASRYVQVLDHIPLGDNKARVIVRHYRKFLKNKFLNNLILFKEIQKKIFYKIFDEDYMILKTQTYNQKLGLIKNDEIKLLGEDRIINYFWNWYKKSEEKDNPWKHINKNKELNVYDEIILKYPPEIKKLEVINNINIIRKTFIRYAAPLVFLLLII

SEQ ID NO: 17427 - protein, 637 aa, Prochlorococcus marinus subsp. pastoris str. CCMP1378
MLLSELSHPNQLHGLTVSQLEEIACQIRERHLEVVSTSGGHLGPGLGVVELTLALYQTLDLDFDKVVWDVGHQAYPHKLITGRFNEFDSLRQQKGIAGYLKRSESHFDHFGAGHASTSISAALGMAIARDRKGEDHKCVAVIGDGALTGGMALEAINHAGHLPNTPLVVVLNDNDMSISPPVGALSTYLNRVRLSPPLQFLSDSVQESVKNIPLIGKDIPEELKNIKGSVRRLAVPKVGAVFEELGFTYMGPIDGHDISNLINTFNAAHRLKKPVMVHVVTTKGKGYPYAEADQVGYHAQSSFDLTTGKSIPSSKPKPVSYSKIFGQTLLKICEQDSKVIGITAAMATGTGLDLLQKNIPEQYIDVGIAEQHAVTLAAGMSCDGLKPVVAIYSTFLQRAFDQLIHDVGIQNLPVSFVLDRAGIVGADGPTHQGQYDISYMRAIPNFVLMAPKDEAELQRMLITSINYKGPTALRIPRGSGLGVAVMDEGWEPLKIGEGEILEEGDDVLIIAYGSMVQSATETANLLKNRGISACIINARFVRPLDQDLIIPLVRKLKKVVTMEEGTLVGGFGSAIVEMLNDNDINIPVLRIGIPDVLVDHASPDQSKEKLGLTPDQMAEKIINKFNLAKLNSKITVE

SEQ ID NO: 17428 - protein, 175 aa, Prochlorococcus marinus subsp. pastoris str. CCMP1378
MLIKKNVIDKMNQKTINRHRKIEHLDYLKWMKFILRRSEEVGKVELPITAVIIDENGRCIGRGSNKREINNDPLGHAELIALRQASWIKNDWRFNECSIIVNLEPCTMCAAALVQARMGQVIYGTKDDKRGGFGGTIDLSKHESAHHKMKVVGGVLNQDCKNNIKLWFKKMRNQK

SEQ ID NO: 17429 - protein, 327 aa, Prochlorococcus marinus subsp. pastoris str. CCMP1378
MASTLLFTALKEAIDEEMANDVNVCIMGEDVGQYGGSYKVTKDLYEKYGELRVLDTPIAENSFTGMAVGAAMTGLRPIVEGMNMGFLLLAFNQISNNMGMLRYTSGGNYKIPAVVRGPGGVGRQLGAEHSQRLEAYFHAVPGIKIVACSTPTNAKGLMKAAIRDNNPVLFFEHVLLYNLSEELPEGDYICSLDQADLVKEGKDITILTYSRMRHHCLKAVEELDKKNIDVELIDLISLKPFDMKTISKSIKKTNNVIIVEECMKTGGIGAELIALITEECFDDLDTRPIRLSSQDIPTPYNGNLENLTIIQPHQIVEKVEEVINGSI

SEQ ID NO: 17430 - protein, 387 aa, Prochlorococcus marinus subsp. pastoris str. CCMP1378
MNIEIGLNKKVRRAYGIDEIALVPGTRTLDYDLTNPSWSIGNVKREIPIIASAMDSVVDVDTAVELSELGALGVLNMEGIQTRYENPKEILSQISSVGKSEFVPLMQKIYSEPIKEDLIIKRINEIKEKGGIAALSGTPQAAIKFKEILVKSKIDLFFLQGTVVSTEHLGMEGKETLNIKSLCKSLKIPVVAGNCVTYEVADLLMKAGVAGLMVGIGPGAACTSRGVLGIGIPQATAISDCSSARDDYFEETGRYVPIIADGGIITGGDICKCLACGADAVMIGSPIAKSSSAPGNGFHWGMATPSPILPRGTRIEVGSTGSLERIIKGPALLDDGTHNLIGAIRTSMSTLGAKNIKEMQKVEIVIAPSLLTEGKVYQKAQRLGMGK

SEQ ID NO: 17431 - protein, 457 aa, Prochlorococcus marinus subsp. pastoris str. CCMP1378
MNVKTSFLKNKINEDSPNKNIVPVTTTINSEHKLFIGECSLEDLVSKYDSPLYVLDEITLRNSCKAYKKALEKYYPGPSLPIYASKANSSIFMSNLIASEGFGLDAVSEGELLTALKGGVPNEKIVFHGNNKSDKEIEFAIKNNIKVIVDNDHDLKRLEEISNSFNHDIEIMVRFTPGIECHTHEYIRTGSFDSKFGFGIESLGRLFEVISKTKHIKLTGLHAHIGSQIFELDPHNDLGKIMVDVILQAKDFGHNIKELNVGGGLGIKYTEEDDPPSIDEWIKTVSLSVVKACDKNNLNLPILMCEPGRSIVSTAGVTIYKIGSFKEIPGIRTYLSVDGGMSDNPRPITYQSKYSACLVNNPLNSNSKNKYTVAGKHCESGDVLFKELELGDCKTGDLICVFGTGAYNNSMSSNYNRIPKPAAILVCNGEAEIIQKRESPHDLLKYDVLPDRFIKQS

SEQ ID NO: 17432 - protein, 404 aa, Prochlorococcus marinus subsp. pastoris str. CCMP1378
MLGSTGSIGTQTLEIVSELPDKFKVVALSAGRNIDLLTEQVSQHKPEVIAIEDENLLTDLKNNINNLGISNPPIVLGGREAINSVAAWDSADTVITGIVGCAGLIPTMSAIKAGKNIALANKETLIAAGSVVIPALKESKSRLLPADSEHSAIFQCIQGLPNYENADFSTGQIPNGLKAIHLTASGGAFRDWEVEDLKNVTVEDATSHPNWSMGRKITVDSATLMNKGLEVIEAHYLFGTSYENIEIAIHPQSIIHSMIEMEDSSVLAQLGWPDMKLPILYAMSWPERFKTNWKRFNLTEIGQLTFKKPDEVKYPCMGLAYSAGKCSGTMPAVLNAANEMAVDQFLKEKISFQEIPIFINKTCESHLNKINLNPKLEDILEVDNWARIFVQEEIKKGKKYINVG

SEQ ID NO: 17433 - protein, 313 aa, Prochlorococcus marinus subsp. pastoris str. CCMP1378
MNSILNWFLMILPFALWGTSMAAMTPLVSSAGPEFVASLRLLPAGILVLITTYLLKRDLKIYKCDLKWFLVFTIVDATFFQLFLTYGISKTGAGLGSVLIDSQPLIVALLARAIFGNLINPIGWLGLLFGLGGIIFLGVPKELLESWWLMSDKSIIDIAFNVGELWMLGASLAMALGTILIRFTCTKSDPVAVTGWHMVLGSVPLIIKHCLQTNFQLIPNWSIFDWGLMSFASIFGGALAYGLFFYFANNKEITGFSTLAFLTPIFALLSGGVYLNERLTIVQWIGVVFVLISVFFVSQRKSIWEFSNTKTNI

SEQ ID NO: 17434 - protein, 343 aa, Prochlorococcus marinus subsp. pastoris str. CCMP1378
MKAAILVNQKKKLIVDELDLPTSLKVGQVLVKLEYSGICGTQIGEIDGVKGEDKFLPHLLGHEGSGIVEKVGPGVKTVREGDSVVLHWRQGNGIQSEPPKYNWNGKTVNAGWVTTFNTKAIISENRCTKIPANISKEDAALFGCAVTTGFGVIENNAKLKMGESIVVFGAGGIGLNIIQAARLTSAWPIIAVDLFDNRLDLAKKLGATHSVNSSNKSYLDEIENILKDRELDVFIDNTGNTSIIEMGYNLISDQGRLILVGVPKTGENINIFSLPLHFGKKITGSFGGECNPAKDIPRFIKMMQNGLWDLKGLITESYDLENINEAIFSMRTGKTSGRVIIKL

SEQ ID NO: 17435 - protein, 305 aa, Prochlorococcus marinus subsp. pastoris str. CCMP1378
MRDAFANEIKRLSEANKNVVLLSGDIGNRMFDKYKSVSPERFFNCGIAEANMMSLASGMALCGLKPVIYTITPFTTTRCLEQIRIGVAYHNAPVVIVGTGSGLSYSELGPTHHSLEDIAILRAVPNINILTPSDKQELTTQLQEAISMNTPSYMRIGKKGEPDLFNESHNLGIGKANILKEGEEILIIGIGPILIEAIEAAKSLKNDGLNIGVASMGSIRPLDDDFLRKMISKKYKYWITLEEHGIVGGLGSTLIEWCSDKQLYDIKIKRLGVKNEFIHKLGNQSYTRNILGIDKKGIINTIKEL

SEQ ID NO: 17436 - protein, 689 aa, Prochlorococcus marinus subsp. pastoris str. CCMP1378
MIESNEPNKIKLNPSKKFIDENNPDHWSSRVLTWWSGFSLRTKLLAIATLVVSLLMTGITFFALNSIQRDAGMNDTRYARDLGLLLSGNVTELVANNQRKEISNVAEKFWRSSRNLRYIFFTDADDIVQLGIPISATPTSSDNQFQLTRRLKLPSELKKRPQFPLVRQHATPQGQVTDVFVPMLWKGKYLGTLALGVTPNKKALSSAALTREVTIAVFISIWVLVILGAVFNALTITRPVRELVKGVREISKGNFKSRISLPMTGDLGELLTGFNRMASQLENYDEANIEELKAAQIKQQSLIATMADGAILLDSKGKIVLTNPTAKRLFRWEGRFLEGKYLLNEIPEILSNDLHTNIESILKREKENDDLRCSLGEPARTLRIVLQSVLDTNKVELKGIAVTIQDLTREVELNAAQNRFISNVSHELRTPLFNIKSYVETLYDLKDQLSNEEQLEFLGIANSETDRLTRLVNDVLDLSRLESGKIIQLEPMEIKPAIEQTLRNYRLNATEKNVSLAHDIEENIPSILGNFDLLLQVFDNLLGNGLKFSPKNSTLKIRAYTWPDSCPAFPPNNNKDAPQCELVSPLPKVRIEIADNGSGISQPDQEKIFDRFYRVENAVHTEQGTGLGLSIVRGIIEKHGGQIRMASELGIGTTFWFDLPLEQSDKDELLAQTINNVENFSDSQVSELF

SEQ ID NO: 17437 - protein, 92 aa, Prochlorococcus marinus subsp. pastoris str. CCMP1378
MTIFIGNLSWKTEEEDLKDLFKTYGAVRNCTIPLERDSGRKRGFGFVEMTSESSEKTAIDDLQDVEWMGREIRVNKAEQKDRSRRNSRHHGS

SEQ ID NO: 17438 - protein, 225 aa, Prochlorococcus marinus subsp. pastoris str. CCMP1378
MEFPEAILFDLDGVLLDTEPLLANAWSETAKEYNHSLSIDKLLELKGRRRIDCAKKVLNWINKESSLEELLIIQKLKVDKVLTKAKPFKGAIELINFCINTNLPIALVTSSSSESFKIKSSVNPWLNLFKTKVLGDDKFISNGKPSPDPYLRALKILDVDPRKSWVIEDSYAGSISGLKAECNLMFFSKDNEILNKLINEFNQEKIQKVNELSEIIYYLKLYKGF

SEQ ID NO: 17439 - protein, 112 aa, Prochlorococcus marinus subsp. pastoris str. CCMP1378
MKKIEAIIRPFKLEDVKIALVNSGIVGMTVSEVRGFGRQKGQVERYRGSEFTVEFLQKLKVEVVVENEKVSSVIDAIAEAAKTGEIGDGKIFISSIDSVVRIRTGDTDEEAL

SEQ ID NO: 17440 - protein, 311 aa, Prochlorococcus marinus subsp. pastoris str. CCMP1378
MSIFLISSLVIFLTLLFSSLILWRINTRKYISSRTVATAYDSWTQDKLLERLWGEHIHLGFYPLNKNIDFREAKVQFVHELVSWSGLDKLPRGSRILDVGCGIGGSSRILANYYGFNVTGITISPAQVKRAKELTPYECKCNFKVMDALDLKFEEGIFDGVWSVEAGAHMNNKTKFADQMLRTLRPGGYLALADWNSRDLQKQPPSMIEKIILKQLLEQWVHPKFISINEFSSILINNKNSSGQVISSNWNSFTNPSWFDSIFEGMRRPNSILSLGPGAIIKSIREIPTILLMDWAFKKGLMEFGVYKCRG

SEQ ID NO: 17441 - protein, 355 aa, Prochlorococcus marinus subsp. pastoris str. CCMP1378
MTTVEDANYSLSKILDSGSKKNLIELAWIKNVRVILPRIIITLSLPSFANSQRERIVKEVKNILLKFEDVNDVQIEIDNKVSQSNSTSENNFPELKNIKGIKHIIAISSGKGGVGKSTIAVNIACSLAKLGLKTGLLDADIYGPNTPSMLGVTEENPKVTDGSGNDQRLIPINKYGISLVSMGFLIEEGQPVIWRGPMLNSIIKQFLYQVEWNNLDFLVIDLPPGTGDAQISLSQSVPISGAIVVTTPQKVSLQDARRGLAMFKQLGVPLLGVVENMSVFIPPDMPNKKYEIFGKGGGKILAGENNLPLLAQIPIEIELVNDSNKGVPISISEPDKESSIRFKELAQLIKKQFIN

SEQ ID NO: 17442 - protein, 472 aa, Prochlorococcus marinus subsp. pastoris str. CCMP1378
MVIANSIKTSIPNYVIKDISLSDFGRKEIKIAETEMPGLMALRDKHHSDKPLNGAKIAGSLHMTIQTAVLIETLVDLGAQVKWASCNIFSTQDHAAAAIAEQGISVYAKKGESLDEYWQYTHYILDWGTDSPNMILDDGGDATGLLILGSKAEKDLSVLKNPSNEEEIALFNSIRSKLQEDSSFYSRIKGNIIGVTEETTTGVARLYQLQKQNALPFPAINVNDSVTKSKFDNLYGCRESLVDSIKRATDVMIAGKVALVMGFGDVGKGSAQSLRGLGAIVKVAEVDPICALQAAMEGFSVVTLNDVVEDIDIFVTATGNYQVITNDNLIKMKDEAIVCNIGHFDNEIDVASLKDYPWENIKPQVDHITLPSGNKIILLAEGRLVNLGCATGHPSFVMSNSFTNQVLAQIELFNKSDEYSKEVYVLPKHLDEMVARLHLDKIGAKLTKLTKDQADYINVSVEGPYKPEQYRY

SEQ ID NO: 17443 - protein, 333 aa, Prochlorococcus marinus subsp. pastoris str. CCMP1378
MSPETLVENKLATISSLKSSNDVDLVRSYLRDIGRVPLLSHEQEITLGRQVQEYMQVERAEIEIMELTDNKPSPEELAEKLNLSTSQIKKRLRAGQRAKERMVAANLRLVVSVAKKYTKRNMELLDLIQEGTIGLVRGVEKFDPARGYKFSTYAYWWIRQGITRAIAEKSRAIRLPIHITEMLNKLKKGQRELSQEMSRTPTISELAKYVELPEDDVKDLMCKAGQPVSLETKVGDGEDTVLLDLLAGGEDLPDEQIEMDCMRGDLHSLLHQLPDLQCRVLRMRYGMDGDEPMSLTGIGRVLGISRDRVRNLERDGLRGLRRLSESVEAYFVS

SEQ ID NO: 17444 - protein, 244 aa, Prochlorococcus marinus subsp. pastoris str. CCMP1378
MLRTFKSDIEIIRERDPAARGILEIFLCYPGFQSIIVHRFTHKLWLLKLPLIPRLLSHLNRLLTGIEIHPGAKIGEKVFIDHGMGVVIGETAEIGNNCLLYQGVTLGGTGKSHGKRHPTLMENVVVGAGAKVLGSIIIGQNTRIGAGSVVVRNVEENSTVVGIPGRVVHQSGVKVNPLAHSALPDAEANVIKNLMDRIDQLENQILQLQNTLQCLVNSESNDISKIGNAQNLKDKEIIEFLGDN

SEQ ID NO: 17445 - protein, 340 aa, Prochlorococcus marinus subsp. pastoris str. CCMP1378
MMGILLESGNSSSKKKTEEPRLPNTAGKTRKTKPSLTAKQNQKKSARLASDSIGYYLSSIGRVPLLTAAEEIELAHHVQNMKKMLEIPEIERSSKHLRLIKIGKRARDRMMSANLRLVVSVAKKYQNQGLDLLDLVQEGAIGLERAVDKFDPAMGYKFSTYAYWWIRQGMTRAIDNSARTIRLPIHISEKLSKMRRVSRELSQKSGRQPTRLEMATAMGIEQKDLEDLISQSAPCASLDAHARGEEDRSTLGELIPDPNGEEPMEGMDRTIQKEHLGTWLTQLNEREQKIMKLRFGLDGEEPLTLAEIGRQINVSRERVRQLEAKAILKLRVMTTHQKAA

SEQ ID NO: 17446 - protein, 341 aa, Prochlorococcus marinus subsp. pastoris str. CCMP1378
MGVRLSQALKVPFIFTGHSLGREKKRKLLEAGLKINQIEKLYCISERINAEEESLKYADIVVTSTKQESVSQYSQYHSFSSEKSKVIAPGVDHTKFHHIHSTTETSEIDNMMIPFLKDIRKPPILAISRAVRRKNIPSLVEAYGRSEKLKRKTNLVLVLGCRDNTFKLDSQQRDVFQKIFEMIDKYNLYGKVAYPKKHSPANIPSIYRWAASSGGIFVNPALTEPFGLTLLEASSCGLPIIATDDGGPNEIHAKCENGLLVNVTDINQLKIALEKGISNSSQWKLWSRNGIEGVHRHFSWNTHVRNYLSILQGHYEKSTIVSSSGIKESCLKGSSSLIKPH

SEQ ID NO: 17447 - protein, 278 aa, Nostoc punctiforme
MSDLILNKLFSLKDRVAVVTGGSGVLGGAMAKGLALAGARVVVLGRNEARASAVVSDITANGGESMAVLADISDRSQLEIAREAIIQRWDQIDILVNMAGGNIPAATITPDATIFDMPHTAFEEVVSLNLLGTLLPSQVFGQAMVERNQPSGCIVNISSMSAIRAISRVVGYSAAKAGIDNFTRWLAVELAQKYGDGMRVNAIAPGFFIGEQNRDLLLNADGSLTERGQKIIEHTPAGRFGKPDELLSTLIWLCSSGSSFVNGVVIPVDGGFSIYSGV

SEQ ID NO: 17448 - protein, 109 aa, Nostoc punctiforme
MSIYVGNLSYEVTQDALSTVFAEYGSVKRVQLPTDRETGRLRGFAFVEMSSEDEETKAIESLDGAEWMGRDLKVNKAKPREDRGGGGSFGGNRGGGGGGYNRGGGGGRY

SEQ ID NO: 17449 - protein, 248 aa, Nostoc punctiforme
MTLLQGKVAIVTGASRGIGKAIAIELASQGAIAVVNYASSSAAAEAVVTEITAVGGQAIAIQADVSKGDQVDALVNAVMEKFSRVDILVNNAGITRDTLLLRLKPEDWQAVIDLNLTGVFLCTRAVSKIMLKQRSGRIINITSVAGQMGNPGQSNYSAAKAGVIGFTKSVAKELATRGITVNAVAPGFITTDMTSDLNNPEDILKYIPLGRFGQPEEVAGMVRFLAADPAANYITGQVFNVDGGMVMA

SEQ ID NO: 17450 - protein, 1242 aa, Nostoc punctiforme
MICGIISLQDYCQFLPQVGESDVDRQRTTLNVSLTPDFNKFITSLVNSGKYKSASEVVRQGLRLLQQQVASSNLKKESNSQESATINSAVNDKRLNMFPGSGEMRERIHNFDWASTSVGSVETWPQSLRATIRTLLGSRYPMILLWGQDLVQIYNDAYTSLIGAKHPLALGRSIQETQSESWDVIGPMIVEVMTTGVPNWVEDQMMVVNRADYNEEAHFSLSYSAVEDDEGAIKGMLCVCSEVTQQVLGERRLRLQRDLAARSGDTRSVETTCKDILSTIAEYPQDVPFALIYLSEPDGKTVRLSGSVRANINESIAPLKVVLEEFTDIWPLAEVMLGNTTLIEGLNRHITIVGGPWNEIVYQAIALPIPSSNVTAPLGVLIAGISPNRRLDESYKSFYELLAGQVSVSLRNAQAYEEERKKAQALAELDRTKTAFFNNVSHEFRTPLTLILGPLEDVLNNQNARLTSEEREQLQLVHRNSLRLLKLVNTLLDFSRIEANRIQAVYEPIDLAVFTTELASVFRSTIERAGLRLIVDCPPLPEAVYVDREMWEKIVLNLLSNAFKFTFIGQISVSLRWYTEYVELEVQDTGIGIPAEELPHLFERFYRVQGLQGRTYEGSGIGLSLVQDLIRLHGGSIRVSSKVNQGSSFIVLLPTGTAHLPTERIASGHDLPNTASVTAAFVEEAWRWLPQEAGEQGSRGAGEENTFFSSAPLPLCPPRTSARILLADDNADMRDYLKHLLQPDYEVEAATNGLAALAAARRQIPDLVLSDIMMPGIDGLQLLRELRSASSTREVPIILLSARAGEESRVEGLEMGADDYLIKPFSARELLARVRTNLELSRLRKDALAQQAERIREQAARVEAEAANRMKDEFLQVLSHEIRTPLNGMLGWVKMLRQGKLDSSATTRALETIERNANAQAKLVDDLLDVSCIIRGQLRLEKRPVSLISVITEAIETLKPQAEAKDITINCMLDRYVSSVSGDASRLQQVAWNLLSNAIKFTPSGGQVEVSLQAVGTDALLQVKDTGNGIKADFLPYIFERFRQADASTTRTYGGLGLGLAIVRHLVEMHGGTVEADSPGLGLGATFGVRLPLMSISYISEGAESISGNDDSQISLNGLRVLVVDDEADGRELVGFILQQHGALVSQAASVAQAWSALESGMPHILISDLGMPEEDGYSFIRRIRALPIEKGGRMPAIALSAYAKEEDRRRALLTGFQMYLSKPFDPDELLIMVASLSGQFP

SEQ ID NO: 17451 - protein, 1403 aa, Nostoc punctiforme
MVKQRRYHWLKAVIFFRKRKLLALLLGIFFSISVVLLWQRLSIQTPGLLKPVVLITGLLVVTLTLSICFALAIKVNNQQIALINQDLTHRILEQKQVEITLRASENRLRQLLETVKVIPWELDLKTWRFIYVGPQAVDLLNYAIADWYEENFWINHLHPHDKEKSVRFRQEATARCENHELEYRMLAADGRVVWLRDVVSVVEEAGTLTTLRGFMFDITDLKQVEETLRLRERALAATSNGIIIADARLPYNPIIYVNCAFEKITGYTAADVIGQNCRFLQRTDSQQPALNELRSSLQAGTSCKVILRNYSKDGVLFWNELCISPIHDENGKLSHFIGIQTDISQRKQAEASLRRQALTFENMHDGVIITDLGGNIIDWNPAAQSMFGYTKAEILAKHISILHRPEVAATLSAKILEKINQQARWSGEIHFLCKDGSQAICETTVVSLQDEQGETVATVGINHDITENKRAKEALQRQLHRTLLLEQITQEIRQSLDTSKIFETAATQIGKAFKADRCLIHSYISDPTPRIPLVAEYNTLPGYCSMLKLEVPMTNNPHAEQMMAQESAIASPDVYADPLLQAAEPICRKIELKSMLSIRTSYQGEPNGAIGLHQCSYFRQWTPDEIELLEAVAAQLGIALAQAQLLEQETHRREELTLKNFALEQAKRQAEAANRAKSEFLAMMSHEIRTPMNAVIGMTDLLLDTDLTPQQQDFVETVRSSGDALLTIINDILDFSKIESGKLELEEQPFDLRACVEQAISLLAPKAAQKNIELVYLIQPQVPTQIVGDMTRLRQVLMNLLNNAIKFTERGEVVLSVELGAGDSVKQGENSSPLHPSLVRLRPSLREAAPTTTLRTSSRQARPSASSESPIQIQFAIKDTGIGITPEKIERLFHPFTQADVSMTRRYGGTGLGLVISKRLSKMMGGTLWVESQGIVGGNPSPRWKSRKSLSSPYSSQGSTFYFTITAQVPAVPEAEFSNSPMQLQGKRLLIVDDNLTNCQIISLQAESWEMETYAAKSAKEALAQLAQGIQFDIAILDMEMPAMDGITLARQIRRQSGCQNLPLVILTSLGREETFSDFGDVEFAASLSKPIKQSQLYDVITRVLGNQPSEASITDFPLVDRHLTHPLPLRILLAEDTIVNQKVALLMLQKIGYSADVVTNGVEVLKALQKQPYDLVLMDVHMPEMDGLETARRICQEWKVGFRPHIIAITANAMRGDREVCLAAGMDDYISKPIQLQKLAQALSKCPRQRSLEVTPIVKQDRVRYLELQPLQNIFQEGQNQTLKSDKIDAKILQSLRDIVRGDRVVFAELIKCYLTETLRLVQDISTAIATRDAQTIWKAAHQLKSSSGSIGAIALAQLCKVLEAQGRSSELENTIELLPQLYQEYEQVKTALEKELAKETP

SEQ ID NO: 17452 - protein, 327 aa, Nostoc punctiforme
MAETLFFNALREAIDEEMARDSSVFVLGEDVGHYGGSYKVTKDLYQKYGELRILDTPIAENSFTGMAVGAAMTGLRPIIEGMNMGFLLLAFNQISNNAGMLRYTSGGNFKIPMVIRGPGGVGRQLGAEHSQRLETYFQAVPGLKIVACSTPRNAKGLLKSAIRDDNPVLFFEHVLLYNLKEDLPEEEYLLPLDKAEVVRQGKDVTIITYSRMRHHVLQAVKTLEKQGYDPEVIDLISLKPLDFDTIGASVRKTHKVIVVEESMRTAGIGAEVIASINDRLFDELDAPVLRLSSQDIPTPYNGNLERLTIIQPEQIVEAVEKMVALRV

SEQ ID NO: 17453 - protein, 452 aa, Nostoc punctiforme
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 17454 - protein, 577 aa, Nostoc punctiforme
MANEKGLADDPEIKSLLSPDLPVQPEECYSWLQAYLKNHSSDKDFQELYQVLNSLMYSDGELDSQEKELLAELVNAKVENVPSYQLTLKCRFMSMMLNSKFLASVVQMKQSSVVNQTALVTGYYTRVPYQVLSRFSVNENNKAINYELSKLYLTDNFAPIHQEIFAENLAVIGKLPEELQGTFLRNGPNLQFQPLGLYHWFDGDGMLHAVTINNGRASYRNRYIRTQGFELEQSLGRAVWPGLLNLPRFDAPYGLMMKNPANISCVWHNGQLLALWEAGAPHIIQLPDLETLGVQTFNNKLASTFTAHPKVDPVTGEMMFYGFAPIAPPYLEYSVVSADGELKQTVPIDLPVPVMIHDFAITENYMIFLDMPLLFKLMQSITGHLPIKFEPKRKSRIGILPRHGDNRTIRWFEVPSCMVIHTANAYEDGKEVVLIACRMDYFNLLIPSYSDSGEITNFDLETLKLFCWRINLVTGVVKQEVLDDVPSEFPQINNQFIGRKSRYIYTSRVAPYMKPKPVFDGLIKYDLGTNNSQRHEFGRGRFGGDTTFVSRPGATAEDDGWLLTMVWDTVWSSNLSY

SEQ ID NO: 17455 - protein, 329 aa, Nostoc punctiforme
MGKKYDVYGVGNALVDIEYEVSPELLQELKIDKGVMTLLDEDSQNHILENLKNLHCHKSCGGSAANTMVAISQLGGKAFYSCKVANDEFGDFYIEDLLNSQVDTNLKNGDRQSGITGKCLVLVTPDADRTMNTFLGITEKFSTQELVSSALADSEYIYIEGYLVTSPTAKEAAIKAREIAEKAGVKTAMSLSDYNMVKFFKDGLLDIIGPGLDLIFANESEALELADTQDFQVAVDKLKTLSKKFAITRGSKGSVVFDGQELIEIAAPQVKAIDTVGAGDMYAGAFLYGITQSMSYEEAGKLASTAASKIVTSYGPRLKTEELKALVSA

SEQ ID NO: 17456 - protein, 764 aa, Nostoc punctiforme
MSNMNVDDFSRQIEILRSQVMKLLQSTASERYSQQELTTEAFAELQIALEEMKIASEELQATRIAVEKERQRYQELFDFAPDGYLVTDTYGTILEANQATTILLNISQRFLIRKPLVSFIGQSDHQAFFNYLTQLQHLDRGGEWEVCLQPREKLCFDVALTVVTVCNDLGKPVALRWLMRDISKRKRLESEREQLFEREQAARIAAEAAQRRSNFLAEASRVLASSLDYRNTLTTVAQLAVPTLADWCIVDVVENNSAAFNNPVIAASDPQKEALVRKLRQRYPISIDADYGLPKVLRTGKPELVANILEYSLQRKAWNDEYLNLLQVKSYMVVPLQVRQHKLGTIVFASTQLGRYYTTVDLAMAEQLAQRAASAIENAQLYWQAQEANRIKDEFLAIVSHELRTPLNSMLGWVQIIRHRKLDEAITSKALETIERNAKLQSKLIDDILDISRIVQGKIRLNLRKVDLVIVINTAIEAIYPTSEIKDIQVESNLDSSVGEIMGDAERLQQVVWNLLSNAVKFTPSGGRVEVCLKQVNSNAQISVSDTGKGISGEFLPYIFERFRQADSTTTRVDGGLGLGLAIVRHLVEIHSGTVYAVSEGEGLGATFTVLLPLIEPQSEQLIKESQVKVNNLLALDGLQILLVEDSADTRELIAFVLEQSGAKVTSVSSVGEALEALMRLRPKVLVSDIGMPDEDGYSLIRQVREQEALRGEKILAVALTAYARDEERNLALEAGFEVHLSKPIEPDKLVKVVANLVKSSKEV

SEQ ID NO: 17457 - protein, 439 aa, Nostoc punctiforme
MLESLGRIKNPLVRSIAAAATVSSVITLSAAVVIGVSNAKAKSAYQFGVYSSLFGTASGAVFGLVYTNKASGNKSTPDLKTLDSHVWQDWRNFVVVRKVKESEEITSFYLQPEDKGEITNFQPGQFLTIKLDIPGQDKPVIRTYSLSDYPENCEYYRLSIKREPAPNGLDVMPGIASNFMHDRIQEGSVILAKPPNGKFVLDVQKSIPAVLISNGVGITPMISMAKACSLLNPTRPIWFVHGARDGKFHAFRDEVREISRQNHNLNVHFRYSRPTPEDRGKYHSVGYVDAALIQELVRQEAEYFLCGSPSFMQSIMQGLKESGVPDSRVFFESFGKPMKSVSEKQTQTVTGDDKFAEIVFAKSGKTLTWQPSDGTILEFAEANDINPPFSCRVGVCGTCMCKIREGVVAYQEEPTATTDQGSVLICISQPGTSKLVLDI

SEQ ID NO: 17458 - protein, 265 aa, Nostoc punctiforme
MKLEGKVALVTGSSQGIGQGIVLGLAQAGANVVINYRSHPEGAEDTLAKVEAIGGNCHIAQCPKSHGYTVQADLGSVDEVRQLIAESINHFGKLDILVNNAGIEKHAPFWDVTEADYDAVMNVNLKGVFFATQAFVQHLIETKRTGKIINISSVHEELPFPNFTAYCASKGGMKMLARNLAVELGALGITINNVAPGAIETPINTKLLNDPEKLGALLKNIPLGRLGQPQDVASLVAFLASDDADYITGSTFFVDGGLLWNYQEQ

SEQ ID NO: 17459 - protein, 523 aa, Nostoc punctiforme
MALDSTTSEVVIAEQLKQFLLVLSVSLGVATLPQIFSWLRRIPYTLLLVIVGLGLAFVNVRLVNLSPELILMIFLPPLLFEAAWNLKWSDLKRDLFPICLYAVVGVIISIAGVAIGLHQFAGLELSIALLVGASLSATDPVSVTALFRELGASKRLRTLMEGESLFNDGMAVVAFGLLVALPLGNAKLDLQSALLEFFQVVGIGISVGGLIGFGISYLTQRFDLPLVEQSLTLVSAYSTYLITEYLGGSGVIGVVTTALILGNFGSRIGMNPRTRFIVTEFWEFLAFFVNSIVFLLIGDQIRFAVLGDNLKTIAVTIAAMVVGRAVSIYALSSLSNWLAKSNIPLSEQTVLTWGGLRGSVSIALALSVPAILPQREEIIATVFGVVLFTLLVQGLTTQPLLEKLQLLGSQPLHQKYTEAIARQVALQRALEYLETTQKRPGIQPEFYHYQKTLLSGEITFLQEEIDKLLDEYPNLQEFTTEELRGELLAIEADTYAEFVRAGKLNKELSPFLQTTHDVTDGKE

SEQ ID NO: 17460 - protein, 1423 aa, Nostoc punctiforme
MTNREELMKNESTSASNADVNFLIGGGEMGARMREWDWSKSSLGPTQQWPQSLKTAVRIMLTCRQPMFVWWGEELINLYNDPYKAIIGGKHPEALGQPASCVWREIWDQIGPRAESAMLKNEGTYDEALLLIMERNGYPEETYYTFSYSPVPNDQGDTGGIICANTDDTQRIIGERQLALLRELAARTADARTFDQACTLSANCLESNPYDLPFAMIYLVDPDEQQVFLTGTCRIGQNHVAAPETVDLDSDCVWPFAEVIETHQAKLISDLEVSFSSLPCGIWERSPHQAIAVPIAPSGQTGKAGILIAGLNPFRLFDDNYKRFIDLVAAQIAASIANAQAYEEERKRAEALAELDRAKTVFFSNVSHEFRTPLTLMLGPLEETLANCATLLPAHEREQLEMVQRNGLRLLKLVNSLLDFSRIEAGRVQASYEPTNLATFTAELASVFRSAVERAGMELSVNCPSLPAPVYVDREMWEKIVLNLLSNAFKFTMTGKIAVSLQWANDHIEFAVKDTGIGIPAEEIPHLFKRFHRVKGAQGRTFEGSGIGLSLVQELVQMHGGTVKVTSVLGAGSCFTISIPTGYAHLPPARISAPRTLASTALGATPYLEEALRWLPEEERETRGGGDKGSVAKEFSLSPYTLIPLSSSSARILLADDNSDMRDYVKRLLSQQYEVESVADGLAALDSARGRVPDLVLTDVMMPGLDGFGLLQELRANPQTKKVPIILLSARAGEEARVEGLEAGADDYLIKPFSARELLARVEAALKMAHLREEAMQREQGLRIEAEVAKAHLETVLAGIQDQFFVLDREWHYTFVNDRVAEVVGIQKEELLDRIIWELFPDVAKSEFYTQVHRAMAEQTVVQFEYFYPAWQRWFENRVYPFGEGVSIFVTEISDRKQAEKALRESEEQFRNMADNAPFMVWVTDTNNYCTYLSRSWYDFTGHNEETSLGFGWLNAVHPEDCDEVRNIFLEASKRCEAFRMEYRLHRKDGEYRWTINAANPWFGVDGQFKGYIGSVIDITERKTAEAERDRLLELEQVARTEAETANRIKDEFLAVLSHELRSPLNPILGWARLLQTREFQPAEIKKAIATIERNAKLQAQLIEDLLDVSRILQGKLNLKMFPVNLVLVIEAGLETVRLAAEAKDIQIQTMLDASLGQVLGDSDRLQQVIWNLLSNAVKFTPEEGKINIQLERIDSQAQITVSDTGKGISPEFLPHVFEYFRQADGTTTRRFGGLGLGLAIVRHLIELHGGTIWAESLGEGQGAIFRVRLPLIKKELTPKQQINIDPINASSTTEILTGIQILVVDDDDDTREFHTFVLEQAGAKVMAVASAKEALQALAESEPDILLSDIGMPETDGYMLMRQIRALQLKQAKQIPAIALTAYAGEINQQQAIASGFQRHLSKPVEPDELVKAIATLIGRNG

SEQ ID NO: 17461 - protein, 465 aa, Nostoc punctiforme
MMAPAFRRAKETHQRQVLEISVHRTGGLPKLSIQSLMSMELSQVAVFILSDITERKRASALLQEQNDRLNQLMISLQQQTEQAQQANRIKDEFLAVLSHELRSPLNPILGWAKILQTSRQDAAKTQYALETIERNAKLQAQLIEDLLDVSRILQGKLSLNTVPVGLTFTIKAALETVRLAAEAKSIQIQTIFEPNAGQVLGDSGRLQQVVWNLLSNAIKFTPQGGQVEVRLERIENELDTHPSEYTQISVSDTGMGISADFLPYVFDYFRQADGTTTRRFGGLGLGLAIVRHLVELHGGSIQAASPGEGQGATFTVKFPPIAAAKLNQADTAFHNCSDFNLNGLQALLVDDDRDSREFIAFLLEQYGAQVTEAESAHEALSTLGQAKFDLLISDIGMPDMDGYTLIRQIRKQPSDRGGEIPAIALTAYAGEIDQQLALAAGFQQHISKPIELDVLMQTILTIVGV

SEQ ID NO: 17462 - protein, 143 aa, Nostoc punctiforme
MDEFMEAAIQEAKQGREEGGIPIGSVLVKDGKILGRGHNKRVQDGDPVTHAEIDCLRNAGRVGSYRGTTLYSTLMPCYLCAGAVVQFGIKKVIVGESQTFPGAKEFMVSHGVEVIDLNLDDCEQMMSEFIETNPELWNEDIGN

SEQ ID NO: 17463 - protein, 444 aa, Nostoc punctiforme
MEETLKILVVENDEVDRMVVRQALTIAGIQMELSEVGDGNDAFSALSSTAYDCVFLDYDLPNQGGLTLIQRLHFSEIKVPLVVLTGQGDEQMSVQLIKAGATDYLSKSRISPENLAQVLRSAIRIYRAEMQAALAEEQLRESHEKLIRKNQELERQQEQIQMQNFKLLEASRLKSHFLATMSHELRTPMNAIIGFSQILLRPKFGQLSNQQADMVERILNNGKHLLMLLNEVLDFSKLEIGRLDLKAEIFDVSKVINLAVGEMRSLADAKKLSLLVQNDLQNPFIFNDPVRIRQILTNLLSNAIKFTESGEIWVEVKELPTNQVAIIVRDTGIGIASRDFKRIFEAFRQVDQTITRKYPGTGLGLAIVDSLVRMMGGKIFLESKLGIGSMFKIELPRQITLQNVVDDPPHLQLESDGVFGRAKNPHQPSSQARQAPIGYPKFKL

SEQ ID NO: 17464 - protein, 374 aa, Nostoc punctiforme
MSVVENNKIYRILAVDDTRDNLILVQAILESEGYEIDLVSDGIKALRQVEKSPPDLILLDVMMPGMDGYEVTRRIRNNPAISYIPILLITAFHESSVVEGLDAGADDFIRKPFDTDELLARVRSLLRLKHSLDEQQKMTRQREDFVSRLTHDLRTPLVAADRMLNLFEMETFCKISPEMKQAIAVMIRSNQNLMDMVNTLLEVYRFEAGKKTLNWEVCDLREISEEVVSELSPLTNEKGLTLTIDTSKLNPLSKNAGIIMGDRLELRRVLNNLIANAIKFTDTGGISIRIFETSPSPENQDSVTIEVQDTGYGIAPEDQATIFERFRQGKHKRSGSGLGLHLSHRIVEGHAGTIQVASEVGKGTLFTVQLPKNI

SEQ ID NO: 17465 - protein, 384 aa, Nostoc punctiforme
MSSKVAKELADFLLQIEQRSQFHAGYPYNLSCDYSAIGKFFNHLLNNAGDPYIEPDFGLHSRKFEQEVLSFFAHLYKIPENQFWGYVTAGGTEGNLYGIFLAREIYPNGILYSSQDSHYSIPKAAKLFRIQHNVVNSQINGEMNYDHFEQLLSENRRYPAIINLNIGTTVKGAIDNLDKVLEILERNQIKDYYIHCDAALSGLILPFLDGAPQVNFQKPIDSVAISAKFIGSPLPCGVVLTKKKWVEKVETEIEYIGSKDTTILGSRNGHTPLILWYAVQTRGYDGLAKEAKTCIHNAQYLFQQLQIREYPCMLNNFSNTVVFQKPSQRLIKKWQLAVFENWAHMIVMQNIVREKIDIFINELLLEQGLLNNAKNFQLQPVLQH

SEQ ID NO: 17466 - protein, 466 aa, Nostoc punctiforme
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 17467 - protein, 989 aa, Nostoc punctiforme
MVLQVQTSSYEAKTQEIAKQLLAATQENRSFFSSLRDQMRWDDKLLAWAMSNPGLRVQLFRFIDTLPALHSKSEIASHLQEYLGDESVELPAALKGMLNFANPDSMPGQVAATTVGTAVETLAHKYISGENIKQVIKTVERLRKEKMAFTIDLLGEAVITEAEAQSYLERYLELMQQLVEASKNWAAIPAIDEADGEPIPKVQVSVKLTAFYSQFDPLDAKGSEERVSDRIRILLRRAKELGAAVHFDMEQYAYKDITLSILKKLLLEEEFRQRTDIGMTIQAYLRDSEQDAKNVISWLKERGYPLTIRLVKGAYWDQETIKASQKHWKQPVYNDKAATDANFETITQLLLENHQYVYSAIGSHNVRSHSRAIAIAESLNVPRRRFELQVLYGMGDKVAKALVDRGYRVRVYCPYGELLPGMAYLIRRLLENTANSSFLRQNLENRPIEELLAPPIVKEGKSLTPNSHFLGAADTDYAVEEIRTKAAQAFQSVRQQLGKTYLPLINGEYVNTPEFVDSLNPSNFSEVVGKVGLISVEQAEQAMQAAKAAFPGWRKTPAKQRADILRKAGDLMELRRAELSAWIVLEVGKPVKEADGEVSEAIDFCRYYADEIERLDKGVNYDLAGETNRYIYHPRGIVVVISPWNFPLAIACGMTVAALVSGNCTLLKPAETSSVIAAKLTEILIDAGFPKGVFQYVPGKGSQVGAYLVNHPDTHVIAFTGSQEVGCRIYAEAAILKPGQKHMKRVIAEMGGKNAIIVDESADLDQAVVGVVQSAFGYSGQKCSAASRVIVLEPIYEAFVQRLVEATKSLNIGEAELPSTQVGPVIDANARDRIQKYIEIGRQSAEVALELPAPKQGYFIGPVIFSEVSPNAVISQEEIFGPVLAVIRVKDFQEALAVANGTNYALTGGLYSRTPSHIQQAQTEFEVGNLYINRNITGAIVGRQPFGGFKLSGVGSKAGGPDYLLQFLEPRAVTENIQRQGFAPIEGAD

SEQ ID NO: 17468 - protein, 262 aa, Nostoc punctiforme; identical to SEQ ID NO: 703

SEQ ID NO: 17469 - protein, 684 aa, Nostoc punctiforme
MQMEPKVNILLVDDKLENLLALEAILEKLGENLVRATSGEEALRCLLHQDFAVILLDVQMPGMDGFETATLIRNRGRSRHTPIIFLTAFSTSDQMLFKGYALGAVDYLLKPLDPNILTSKVTVFVELFKKTEAIKQQAAQLVAMNAELRQSEERLRSLSTCSPVGIFEIDTEGGCRYTNPRYQIICGLKATESLEKSWLESVHPEDRERAVASWSNYICEGRDYSEEFRFQTAQGIIRWVQVRSSPMLSGQGELLGYVGTLEDITERKQAEEVRAQVIREQTARQEAEAANRMKDEFLAVLSHELRTPLTSMLGWSKILRSKKLDDKATSRALEAIERNAISQMQLIEDILDVSRIIRGQLRLNVSAVNLISVMEAALEAVRPLAEPKEIQLNTVLDTSVGSVYGDPARLQQIVWNLLTNAIKFTPKGGRVEVNLSIVYGEEQQTTQKYAQIQVIDTGIGISSEFLPKVFERFRQADSTTTRSHNGLGLGLAIVRHLVELHKGTIFAQSPGSGQGATFTVRLPLLQDNRGNRGNRENREAAEGISSSVASTPLAGLKVLVVDDEADTRNFLSFMFEEYGAIATAVASVDEALAVLEQAKADILISDIGMSEQDGYTLIRKLRSLEPEKGGCMPAIALTAYTREEDRLEALAAGFQQHLSKPIDPTKLIAMVASVLKLSVQVPVS

SEQ ID NO: 17470 - protein, 460 aa, Nostoc punctiforme
MPTIAVNPYLDRNFAPIREEITTDKLPVIGELPLDLSGMFVRNGPNPQWTPIGQYHWFDGDGMLHGVQISNGVATYRNRYVQTSGWKKEREAGEALWSGLLEPPRMDNPHGPRKNTANTALVWHAGQMLALNESGKPHAIKLPELETIGEYSYNGKLISAFTAHPKVDPVTGEMIFFGYSVFTPPYLQYSVVSAQGELLRTVPIDLSIGVMMHDFAITENYTIFMDLPLTFSAERSQRGEPVMMFERDRPSRFGIVPRHGDNSNIRWFESPSCYVFHTLNAYEDGDEVVLIACRMSSTTVLISDDSQPDPEGNIPRLYRWRFNLSTGTVREEMLDDVTSEFPRINENLLGRQTRYGYTNKIANSPVPLFEGIIKYDFSSGKSQTHKFGQGRYGSEAVFAPRPGAIAEDDGWLVTFVHDENSNTSELVVVNAQDVTAEPVARVIIPQRVPYGFHGTWVAQE

SEQ ID NO: 17471 - protein, 104 aa, Nostoc punctiforme
MSIYVGNLSYQVTEEDLKQAFAEYGTVSRVQLPTDRETGRPRGFAFVEMESDTQEQAAIDALDGAEWMGRDLKVNKAKPREDRSSSPRGSWGGGNARRNNNNRY

SEQ ID NO: 17472 - protein, 1211 aa, Nostoc punctiforme
MFNRLKIGTKIGVSFALSLATLTTIGLISYQSTNDLIETSRKETHTYQVLSQLEDLNLQLTNAETGQRGYIITGEQRYLEPYNAAIQLLNQKFKELQKLTADNPNQQNRLDILQPLLTERMAVMKDVIELRQSEGLEASQKAILTDQGKQLMDQIQKVIQAMKTEENALLKQRSERARAAGRQTIASIIYSIPLFSLILGLIGFALTRHISAPLKQVSDLAEKMADGDLSVSLPDSDRYDEIGVLTRTFNQMIVNLRNTTQKNEEQNWLKSNLAEFTQMLQGQRNLETASNLILSNLAPLVGASQGVFYAMASIDDQLVLKLLSSYAYKERKNLANQFRLGEGLVGQCALEKQRILLTEVPSDYIRISSGLGEAPPLNIIVLPILFETQVSAVIELASFGSFSHLHLTFLEQLSENLGVFLNNIASQLQTQQLLEESVALTEELQTQQEELQQSNQRLEEQAHELEESQFLVKQSNEELQQLNEELEEKAELLEVQNREVARKNQEVERARKSLEEKAEQLALSSKYKSEFLANMSHELRTPLNSLLILARLLADNSLNNLTDKQVEYSRTIYSAGTDLLELINDILDLAKIESGTMSLDIEQIAFADLETSLEQTFRQVAHNKELSFTIELDSKLPPTIYNDSKRLQQVLKNLLANAFKFTERGGVKLEITMSSDAAQIDNPMVAFAVSDTGIGIPAEKQKVIFEAFQQADGTTSRKYGGTGLGLSISRELAQLLGGRIELVSKPGQGSTFTLYLPRRQEKNSQSTFTPPQPITIRQASTIKEVPLAENRPTTVDISPTAKVLTTFPHEIPDDREIIQPGDRILLIIEDDEKFARILLDMAREQGFKAIVALQSKQGLALAQQFKPDAIMLDIYMPEMDGWTVLDRLKHKPDTRHIPVHILSVDERQQRGLQLGAITYLQKPVSPEALTQVLTDIKGFIERQVRNLLIVEDDPVQAQSIIELIGNGDVQSTAVGTGAEALLILRSQHFDCMVLDLGLPDMSGFALIEQIKQEPRLLKLPIIVYTGKELSRQEETQLRGLAETIIIKNVRSPERLLDETALFLHRVQANLPQPKRQMLEQLHQNDPVLANRKILIVDDDLRNIFALTSFLESYQMQVLFAENGRDGIERLQTNPDINIVLMDIMMPEMDGYETTRAIRQQQQFRSLPIIALTAKAMPGDREKCIEAGASDYITKPVDTEQLLSLLRVWLYR

SEQ ID NO: 17473 - protein, 800 aa, Nostoc punctiforme
MLSVKLFVLHSSLFSYSRYSSFDAPGQQRRIFMEMNLQFPGINLISLKEAPIHISSQIQPHGVLLVLEEPELKILQVSTNTLKVFGIAPENMLHKKLEDLLDPFQIERIKTGLSGENLDFINPTKVWVRKKGDEYVVFDAIFHRNIEGFLILELEPAITQENIPFLSFYHLARASINQLEKTANLRDFCQVIVQEVRKITEFDRVMLYKFDDDGHGSVIAEEKLESLEPYLGLHYPESDIPKPARKLFAANSIRIIPDAYSQPVKLFPVNNPISDRPINLTNSILRSAASCHTEYLHNMGVGASLTISLIKDQKLWGLIACHHQSPKYVSYELRKACEFLGRVIFAEISAREETEDYYHRINLTHLQSILIEYMSQEENFIDGLVKNPQHLLDLASAQGAAVCFAGNCTVVGETPREEDLNFLVQWLKNNVEEEVFYTDSLPQIYPDAESFKNVASGLLAIPIAKRTYVLWFRPEVIQTVNWGGDPNKAFEVSQSEGNVRLCPRKSFELWKETVRLTSLPWKDVEVKAALELRKAIVNIVLRQADELAQLAQDLERSNAELKKFAYVASHDLQEPLNQVVNYVQLLEMRYSEELDEDAQEFISYAVQGVSLMQTLIDDVLAYSKVDMQAIAFQMNDVETALMRGLGNLRQRINETGATITHDPLPTVMADSTQLMQLFQNLIGNAIKFHSDQPPQIHVGAERIEDAWLFSVRDNGIGIDPKFSDRIFVIFQRLHTRDEYTGTGMGLAICKKIVECHRGRIWVESELGQGATFYFTIPVGGRELERRNGRKTQNHLFGRGQ

SEQ ID NO: 17474 - protein, 826 aa, Nostoc punctiforme
MTTISKNTLSPSAQERSLILWFDEVGIADIPLVGGKNASLGEMIQQLTPKGINVPTGFATTAYAYRHFIKSAGLEAKLRKLFADLDVEDVKNLRERGKKARSLLIHTPFPVELREAIATAYQSLCEIYHTETDVAVRSSATAEDLPDASFAGQQETYLNVVGVEGVLAACHKCFASIFTDRAISYRHTKGFDHFSIALAVGVQKMVRSDLATSGVMFSIDTETGFKDAALITAAYGLGENVVQGSVNPDEYYVFKPTLKAGFRPIIDKKLGSKELKMIYDDGSKFTKNVSVSASERGKFALSDEEILQLGNWTCLIEDHYSQVHGISTPMDIEWAKDGITNQLFIVQARPETVQSQKTGNVLRSYRLVWGNREKSSHSSLHDSQSPIPLVTGSAIGEAISQGKARLILDVQKLEQFQVGEVLVTERTDPDWEPIMKRASAIVTNSGGRTCHAAIIARELGVPAIVGCGNATEILKPGQEVTISCAEGEEGKVYAGLLPFEVEEVALENLPRTHTQILMNVGNPQEALSLSAIPNDGVGLARTEFIIANQIQIHPMALINYELLKDEFAKAKIAEITSLYDDKPQYFVDKLAQGIGRIAAAFYPKPVIVRMSDFKSNEYANLLGGRQFEPHEENPMLGWRGAARYYDEGYREAFALECHALKRVREEMGLTNVIPMIPFCRTPDEGRLVLAEMAKNGLKQGVNGLQVYVMCELPSNVILAEEFAEVFDGFSIGSNDLTQLTLGIDRDSALVARLFDERSPAVKRMVKMVIEAAKKCDRKIGICGQAPSDYPEFAQFLVEQGIDSISLNPDSVLKTMLEVAKAEGTNS

SEQ ID NO: 17475 - protein, 1297 aa, Nostoc punctiforme
MSEALPQKRLIKSMTANETQRLSALHRYRVLDTPPEVAFDRITRLAARLFNMPTVLISLVDESRAWFKSCVGFDAREVPRDDTLCNFAVLTDEPLIIPDARLDDRFACNPFVQSEPGVRFYAGAPLLSQDGFNLGTLCLLDSQPHDPLSVEQQATLVDLAAIVVDELELRLASHKIAQVDAALLEITQGVATVTGGAFFDALVQHFANVLDTDYVYIGLVESDDPKRLRTIATCAHGRIVENFEYLLQDTPCWEVLEQRKVCCYPRNVQAQFPNAPLLKPLAIESYVATPFFDSNGTPLGLLGVMHGQPLENVHLAESLLTVFADRIAIELERQQTEITLRESEELKQRILDSSRDCIKVLTLNSEIVYISPGGLCLLEIDDPTSILNTIWVDRWQGEDYENAQAALAAATLGNIGQFQGYLVTAKGTPKWWDSRITPVRDASGQVVQLVAISRDITDFKQAEAERLQAELVLRSAHVQLESALAAGSVYTWRWNIPADRVVVNAAFAHLFNVDPADATTAGLPIEFFINSIHESDRPRVSAAIQQAIETGEEYTAEYRVHTATGEERWLTARGQVEYDAAGNSIAFPGALADITDHKQAEAAIAADLRDTQLLHGLSVQLTNETDIQVLYDEIMATAIVLTGADAGTVQILDTATQDLVLLATQGFEPNLTEYFHRVNASSNTSCGIALKNGNRTFIDFDVPESEDPDGSLRIHVEAGYFFGQSTPLIARSGKPIGMVSTHWQEYRQPSDRELRFLDLLARQAADLIEQRQTQAALRDSENRFRMAIESAQLGTWDWNLIANQLIWDEGCKAMFGLLPQAESSIEVFFAGLHPNDRQRLEQAVQWTLNPASSGKYDVEYRTIGIEDGVERWIAARGQAYFDAGGNPQRFVGTVLNITEQKRIEAEREQLLVREQAARAEADRANRIKDEFLAVLSHELRSPLNPILGWIRLLQNGKLDLPRQTEALKTIERNAKLQSQLIEDLLDISRIMQGKLTLTAAPISLTFVISAAIETVRLAAEAKNIQILLDLSTTVSYVSGDANRLQQVVWNLLTNAVKFTPRGGQVIVELKQLDQLAQIRVSDTGKGIDPQFLPYVFEYFRQADSTTTRKFGGLGLGLAIVRQIVEMHGGTVKAESLGEDRGAIFTVQLPVIQQTIPTIAELVQAKAEKTKNPLSNLQILLVDDDTDTREFQAFLLEQSGARVIAVASGLEALQVLDRFIPDLLVSDVGMPEMDGYMLIRQIRSRPPHQGGTIRAIAVTAYARDFDRQKALQSGFQGHITKPVEPEILVKTIVDLLDF

SEQ ID NO: 17476 - protein, 364 aa, Nostoc punctiforme
MSLTKSVKKDKILAVDDVFDNLLVLEAVLEDEGYEISLVEDSKIALAMVEESPPDIILLDVMMPEIDGYEFTRRIRQNPALPFIPILLLTAHYQSSVVEGLDAGADDFIRKPFDPDELHARVRSLLRLKHSIDERDQMANLRADFVSRFTHDLRIPLVASNRVLKLLLEGRFCEVSPQLQEIIDTMIGSNQDLLEMVNTLLEVYRHEAGCKTLKIAPCNIEELVSEVSQELTPLAEEKGLALNIERDETASTVMGDRLELRRVLTNIIGNAIKFTDKGSVDIRCHLTPADVTIDIQDTGPGISKQDQAILFERFRQGKHQRSGSGLGLYLSRCIIEAHQGTIDVASEPGQGSTFTIRLPVAADN

SEQ ID NO: 17477 - protein, 500 aa, Nostoc punctiforme
MLKKLFSFSDRYRILHQTWFAFFLTFVCWFNFAPFATTIGKELHLAPEQIKTLGICNLALTIPARLIIGMLLDRFGPRITYSILLMFAVVPCLATALAQDFNQLVISRLLMGIVGSGFVVGIRMVAEWFQPKEMGIAQGIYGGWGNFGAFGAEFALPILAISTSFFSGGASNWRLAIALVGIITAIYGVIYYNTVQDTPRGKVYKKPKKNGSLEVTSIKSFWAMMISNFGLIFALGLLAWRLEQKKIHFLTLSQMYLTWLVLAGLFAYQSYKAWQVNRELLTGKKTYPVSERFQFGQVALLEFTYITNFGSELAAVSMLPAFFEKTFGLEHVVAGMIAATYPFLNLVSRPSGGLISDKFGSRKWTMTIISVGIGVSYLMAHFINSNWPIPVAIAVTMFAAYFAQAGCGATYSIVPMIKKEATGQIAGNVGAYGNFGGVVYLTIFSLTDAPTLFSTMGIAALICAFMCAFFLKEPKGSFAPAYEGEASETATKSSVFLTEE

SEQ ID NO: 17478 - protein, 1123 aa, Nostoc punctiforme
MFNQLDEYNSQLFELCPVGLVLCRTDGTLININPAYAAILGRTVPETLNLNYWQITPENYAIADQATLENLEQTGRYGPYEKELIHKEGHLVPVRISGLMIEKDGEQLIWSSVEDISDLRSFQQERQHTEQILKQSEARYRSLVTANTQIVWVSTPQGICFELASWIAYTGQSLAEAQNGGWIDAVHPDDRAYTGEVWSAAVANLSMYQIEYRIRGKDGNYRYFWVWGAPVIEEDGSVREWIGTCTDIHKRKLAEAENQRLQERYRSLVTATSQIVWAATPEGLGISNEMLTWMAYTGQSEAEVEVWGWLDPIHPDDCARSTEVWNAAMTNRGIYQTEYRLRGKDGTYRYFSVCGAPVLEEDGSIREWIGTCTDIHDRKLAEAENQRLLDMLNHSSDAIIVRDMSDKISHWNQGAERLYGWTREEVKGQCIQAFLKKTFPKPKEEIIAELLEQGNWEGEVQHLTHFGKLITVQSRWTLQRDISGQPCAVLEINTDITARKQAEIALRQLNQELEARVVERTAALQNTLAEAQGLNAILDNLADGLLVADTAGQITHFNPAFLTMYGLTATALKGHYRELPISGLAELVARTQSHPEEVFSAEVALTKERIGQAVATAIFKKTVEQEPLACFGSALLIRDITAEKEIDKMKTDFISTVSHELRTPLTSVLGFASIIKEKLETDVFPIISTEDRKLQKTIKRVADNLNIIVSEAERLTSLINDVLDIAKMEAGKVEWQMQPLDPSELLDWATNSTAGLFETNGLQLVSEIEPGLPQIVGDRNRLLQVLINLISNAVKFTESGCVTCRVKQGHDGVCISVIDTGIGIAPEDQPKVFEKFRQVGDTLTDKPKGTGLGLPICKQIIDHHGGRIWVESEPGKGSVFSFIIPTYASDPKTTANLNLDTLVKQLKEHVITTNPVVNQNRKTILVVDDDANIRELLRQQLENEGYNVREGKDGVDAIHQIKTARPDLILLDVMMPQINGFDVAAVLKNDPQTADIPIIILSIIENKERGYHIGIDRYLTKPINTEKLLNEIGSLLYQGTSSKKVLVVDKNASALKTLSDVLEAQGYSVIEASNPQECINKALSAKPDMIIIDSIFSQEADFVKTLRFEKELENVFFIMLSDQ

SEQ ID NO: 17479 - protein, 738 aa, Nostoc punctiforme
MQVVSARDIAEQNQSQEALQIRENSRRKQSQTLVQLARSKTFQQGNLNAVLKEITETAAQTLLVKRVGVWLYNEERSKIECIDLYDVNTKEHSFGNSLSQENYPAYFQALEEERTIAANDAINDTRTQELSQPYLCVLGITSLLDAPIWLEGRLVGVVCHEHIGELRQWTLEEETFAGSIADFVTLAIEASERNVVQEALRQSEAKFRAIFERSSIGIGLIDMKAQIVDTNPVLCEILGYSREELYAKRFTDYISIQKGDLKLYKQLVSEIGKNSGKTSRFGFQISKLEEQAVDKHRIEMERRCLHKDGSLVWTHISVSVIPDSNGEPEFFLAMIEDITERKETELKLRASQEAAEAASRAKTEFLATMSHELRTPLNAIMGLSQLLQQEIVGSLNEKQNEYVSCIYSSGEHLLALINDILDLSKVEEGKEELLLSPLPVSDLCNYAIWTVRDRASEKGLKLTYKIDLQEDICIADERRIKQMLLNLLTNAIKFTPVGNVSLVVKKVPQGITFTVSDTGIGIDPNQFQFLFEPFKQLDSRLNRQYEGTGLGLALTRKLARLHGGDVTVTSTLGEGSQFTLFLPNPVPSKAVEDGKNEVDEGDEGEEFTFFSSPDIPKNKTILVVEEEEKTATVLQEYLESIGYKVKWIDNENDFLKQVQSLKPDLVFFDFQLTKKTSILNLLNILRQNPSWKDTPIVIMTLSEPIEKEINKLPASANDYLVKPIRTVKLESLLMRYLS

SEQ ID NO: 17480 - protein, 989 aa, Nostoc punctiforme
MKILIVEDDGLNAYTLTNLLTNQNYAVEVATDGDAAWDCIQAYDYDLILLDVVLPKLDGISLCRKIRSNNLQMPILLMTGRNSSHEKAIGLDAGADDYLVKPFDIEELVARIRALLRRPAVTSPPVLESGKLRLDPSSCEAVYARNLLPLTPKEFALLELFLRNSRRVFSCGMILEHLWSYEDTPQEEAVRTHIKGLRQKLKAVGAPGDLVETVYGIGYRLKPLEEDKHRGAGAGEQGSRGAEEQGSRGEVDRVKSPIPNLKSQQQALMAVAEIWQRFQGRVEQQVRVLEQAIATLNQNNSLNPELLSLAAKEAHTLAGSLGTFGLPLGSKWARNIELLLSYDQTLSKSEIGNLQIWVNLLRREIEGNDAGAISGSSISQVETVTQPLQNHPDAETKILVVDDDPQIQALLQTLLSPWGLRAIALENPLQFWETLEAVAPDMLILDVELPYINGIELCRLVRNDSHWSELPILFLTVHSDAEMVNQVFSIGADDFVSKPIVGPELVTRIVNRLERMKLRQRVTQGSRGAGEQGSRGAGGAEEVNSPPSFSHRAINELELRVAERTAELISVNQQLQSQLDERQQTQEELRFSQARFARILDIADDAIISINGFHNITLFNQGAEKIFGYCAQEVIGQGLDLLLPQRFFQAHRQHVADFGQSPNVARRMGERREIYGRRKDGSEFPAEASISKIDMGDEIFYTVILRDVTERKQIERMKDEFVSVVSHELRTPLTSIYGSLGMLASGLLPTDSEQGKRLLQIAADSTERLVRLINDILDIERIESGKAKMEAEICNIVDLITQAVNVIQPLADKAGVTLSISALSGQVLADCDRIVQTLTNLLSNAIKFSSAGSTVWLGAQQEGDEVLLTIKDTGRGIPTDKLESIFERFQQVDSSDSRNHDGTGLGLAICKSIMQQHGGRIWAESILGEGSTFYVTLPLFGTFPHTDLQNSSNIPVIYSRHDQIINSHASQDAEFLTKGRITPRNLNND

SEQ ID NO: 17481 - protein, 816 aa, Nostoc punctiforme
MQTSSSSGVAMSELLQAVLDSEERSDLRSFLSELRQQEKKYLLRNDILNVYSEYCSKSQKPEAYYTTSELGKLIYYTQEIIQEDSNFCFIIRSKIASQEVYWLTSDLSIEPMTVQDLLDLRDRLVNKFHPNDGDLLELDFGPFYDYTPIIRDPKNIGKGVQFLNRYLSSKIFQDSKQLLENLLNFLRLHHYNGVQLLVNDRIQSQQQLSEQVKKAIGFVNNRPDDEPYEQFRFQLQSMGFEPGWGNTAARVRETLNILDELIDSADPQTLEAFISRVPMIFRIVLVSAHGWFGQEGVLGRPDTGGQVVYVLDQAKSLEKQLQEDVLLAGLEKLNVEPKVIILTRLIPNSDGTLCNQRLEKVHGTENAWILRVPLRDFNPNMTQNWISRFEFWPYLETFAIDSERELRAEFQGTPDLIVGNYTDGNLIAFLLARRLKVTQCNVAHALEKSKYLFSNLYWQELEEKYHFSLQFTADLIAMNAANFVVSSTYQEIVGTPDSVGQYESYKCFTMPELYHVTNGIELFSPKFNVVPPGVNENNYFPYTRTKDRVESDRQRLAETLFTLEDPTQIFGKLDDPNKRPLFSMARLDHIKNLTGLAECYGQSKELQEHCNLILVAGKLRVEESGDNEERDEIIKLYNIIDEYNLHGKIRWLGVRLSKTDSGEIYRVIADRQGIFVQPALFEAFGLTILESMVSGLPTFATQFGGPLEIIQDKVNGFLINPTNLDETATKIVDFITKCEQNPNYWNEISQRGIDRVYSTYTWKIHTSKLLSLARIYGFWNFTSKENREDLLRYLEALFYLIYKPRAQQLLEQHKYR

SEQ ID NO: 17482 - protein, 475 aa, Nostoc punctiforme
MRGWIPGIKLNTIYAKLLGRYLMLTAFGTSLMAGYILWSFHDYFMRSRQVDLDNWTSALSESVADRLEEKDIKQVKVLVQRYGAPQTITLRVFNPQGSLLATSDPRLDSQVKDWSQVPGIREALQHRVKQGVAKGVLSNSDRLYITRPIERNGQLLGVIRMSMTLEQFQRQFARVIWSILGTLAVTILLCALISSRFARSLSKPIEIMQNFAIRLGGGHFGDKLTIHENNELDQLAAELNRMSERLASLDKERRVFLANVSHELRTPISNVQVTVDALKAGASEEPELRDRFFQTIENETKRLSRLIHDLLDLGRLEAGVFELEKQPISLHGLINRAVNALEPRMLSLGISTQVNVGNLMIQGDPERLLQAILNLLDNAIKHSPANSQVSISGYSQGKQAIIQIQDQGKGIKEGDLPRIFEQFYTTDPARKGSGNGLGLAISKRIIEAHQGSIIASSTSNQGATFTIYLPIIRNS

SEQ ID NO: 17483 - protein, 363 aa, Nostoc punctiforme
MAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 17484 - protein, 345 aa, Nostoc punctiforme; identical to SEQ ID NO: 873

SEQ ID NO: 17485 - protein, 161 aa, Nostoc punctiforme
MLTKYTEYLIHQEWMSCALELAKVAGDAGEVPVGAVIIDSTGKLLAQGENRKERDKDPTAHAEILALKTAATTLQNWHLNECTLYVTLEPCPMCAGAILQARVGQLVYGVDDTKTGAIRTVINIPDSAASNHGLQVIGGILESACREQLQAWFATRRRRVN

SEQ ID NO: 17486 - protein, 263 aa, Nostoc punctiforme
MGIILSFCFQSLNYQRKSQQSMLLTDLRTIFERDPAARNWLEVLFCYPGLQALVFHRLAHWLYKIGIPFIPRFISHISRFLTGIEIHPGALIGQGVFIDHGMGVVIGETAIVGDYALIYQGVTLGGTGKESGKRHPTLGSHVVVGAGAKVLGNIQIGDRVRIGAGSVVLRDVPSNTTVVGIPGRVTRQNNLSTNILDHDKVRDVEAEVIRALFERVKALEKQFEELQDQSSFSATELGDEQTYNPKSNKSDGMIEDFLDGAGI

SEQ ID NO: 17487 - protein, 713 aa, Nostoc punctiforme
MSEIISEFWTNFFTSGSFIPHGHCYLWQTNLVWLHILSDAFIALAYYSIPATLFYFVRKRQDLPFDWIFLLFSAFIVACGTTHLIEIWTLWHPTYWVSGFVKAVTAMISVITAVQLVSLVPQALALPSPAQIEQANQELQTQIAERLRIEKVLRKYQNHLEEMVAIRTNEITKTNEQLQQEILERQRILEVLRQSEERYRYLAEAIPQLVWTTNANGECDFFNQNWCEYTGLTLEQSLGSGWLAALHPDDIQNADQIWSNAVKNSTTYNNEYRFKRASDGSYRWQLARGLPLKDEQGIVVKWFGTCTDIHEQKQILEERAHLLELEQIARAKAETANRIKDEFLAILSHELRTPLNAILGWSKLLQSRRLDQEKTSQALATIEKNANLQVQLIEDLLDISRILQGKLTLDITKINLKSTILSALETMRLAAETKLIEVSTVFEPNVGQVMGDSTRLQQVVWNLLSNALKFTPKGGKIEVRLEQADGYAQIIVSDTGKGISPEFLPFVFDYFRQADSTSTRNFGGLGLGLAIVRNIVEIHGGIVKAKSEGEDKGAIFTVSLPLLPDESRSLTDKQNSAVFLTSNSLALSGIRVLVVDDDTDSRDFIAFVLEQDGAFVIAVSSAYEALQTLAEIKPDVLVSDIGMPEMDGYMLIHQVRTLIPEQGGRIPAIALTAFARNDDQQEALKAGFQMHLSKPVNPEELIAAITRIVETKV

SEQ ID NO: 17488 - protein, 451 aa, Nostoc punctiforme
MTLETETLQATSSTSTFETPENQQEFNWRQSWYPVCFLQDLPTNRPYTFSLYEEPFVLFKDQNGQLICLTDRCSHRAARLSDGQIIDGKIECSYHGWQFGNNGQCLHIPQLASDAKIPVNACVPSFKVLERQGIIWMWAGEAETAIDELIPSLPDWNKPECFNLDYVRDLPYDQSYFIENIIDPAHVPISHDGIIGSREDAQALDIEVIESNIQGIKGRWQRTRTPNLPWISLDFIAPNLILYKFANVQQGKFWGTALYSIPLGKNRCRILIRNYSNSFPQKTKLMPPWLDHILIRNKILEGDLQLVVEQKAQIERLKKNLKEVYLPLKTSDTLVVEYRKWLDKFGSSLPFYQGYSTSKNVGNSESDEKLITLDRFSQHTIICHSCNQAYQVTNKVRQSCIGVAIALAAIGILADDSRIRIAAISVSITAIVISAMAQTLKTHFERSYTRH

SEQ ID NO: 17489 - protein, 480 aa, Nostoc punctiforme
MNTLASLNLVKSLENSASETPNSQPVYALISVHGDPTAEIGKEGAGGQNVYVRELGLALAKRGCQVDMFTRREYPDQEEIVELAPGCRTIRLNAGPAKFITRNDLFEYLPEFVEAWLNFQQRTGRSYTLIHTNYWLSAWVGLELKSRLGLPQVHTYHSIGAVKYRNMENPPQISAIRNCVERAILEQADYVISTSPQEAEDLRQLISQHGRIKVIPCGINTEHFGSVSKEVARQQLGIASDSQIILYVGRFDPRKGVETLVRACANLPSAFQLYLVGGCREDGADFKEQQRIESLVNDLGLEAVTVFTGRISQALLPTYYAAGDICVVPSYYEPFGLVAIEAMAARTPVIASNVGGLQHTVVHGETGFLVPPRDSKALAIAIHSLLQNPTLKESYGNAAQNWVQSRFSTQGVAARVHELYQSLTLDTFIQEIIKTKKLTPDLERQIQNLLKSKVLKSNEIKALEKLIDSFSNDIVQWATS

SEQ ID NO: 17490 - protein, 257 aa, Nostoc punctiforme
MKLLLVIELDNTLVGNNRAIAALNQRLEAIRNQIYLVYVTGRSYASSRRVIAQEQLLKPDYLIASVGTEIYQQGVLLEKDWANQISKDWDWDAVWTIASYFPALIPQPDSEQTPYKLSFWLDMDAPLEVIHDLQDLLTFTGLQSEVIFSNGRDVDIIPKNSNKGEAAAYLQELLQAQLDATVICGGSGNDISLFQQPSAGIIVGNAQTELLWWYYKTHYPWHFLAHYPGAAGILEGLIYFNILPFPNSWKAMGYAPP

SEQ ID NO: 17491 - protein, 701 aa, Nostoc punctiforme
MWGLTRRSQLQGYGIAFLTVLLALLLTLLLWQLHRLNSIYPLFLAAVMVSSWYGGLNPGLLATFLSAIVCAYFLLPPFYSLAITGFSVVGLLQFVLVALLISLLNTALRQARSQAQMNAVAALQNYERLRESQDSLRQSEERYRLLVEGVTNYAIFMLDPNGNVTTWNIGAERILGYQEAEIIGQPFERVFSPEAIKQGLPKQVLRKAVAEGFSRENRWHIRKDGTFFWAHCLITPLLDDDGNLRGFSKIMQDITERKQAEEEKEQLLLREQAARAVSEAAQSAAEAANRSKDEFLAIVSHELRTPMTAIIGWAGMLQTGVLDEAKATLALEIIERNANLQMQLIEDLLDISRIVRGELSLSIDLVDLVEVITAAIEVVQSLANAKDIQLETILDTSIEKIWGDSDRLQQVVLNLLTNAIKFTPNGGRVEVRLSKEMGSREEFSQPAIPNYLQIEVTDTGKGISPDFLPHVFERFWQADSTHTRSNKGLGLGLAIALHLVELHGGTIDAQSQGIGQGATFTVKLPILEESRGAALRLRSVTEEQGSRGAGDNNLHFFSQSPAPNPQSPVPNPLSGLRVLVVDDEADVRQWITAVLEECGAEVSAFSSTGQALEALEKLHPDVLISDIGMPGEDGYALMRKIRKLEPELGGRIPAIALTGYARVEDYKEALAAGFQLHVAKPVRAAELIAVVASLGKMSGKL

SEQ ID NO: 17492 - protein, 620 aa, Nostoc punctiforme
MAGEPQEFLIRIQDRGGGIPHLEDVLAGRYASDTGMGLGIVGSQKLMDFFEIESLPGQGTTVVMSKRLSKRTPNFTDLQLQQIRESVMERSPQNPYEEIQRQNQELLRAMAELRKREEELTQLNRELEDTNRGVVALYAELDEKADSLQKANELKTRFLSNMSHEFRTPLNSILSLSRMLLARMDGDLTAEQEKQVTFIQKAASGLSELVNDLLDLAKVEAGKIEVRPSSFEVSDLFATLRGMLRPLLVQGSSVALNIEEPEGIGQIYSDEGKVAQILRNFISNALKFTEQGEVRVTSVQRGHTVIFSVSDTGIGIATADRERIFEDFVQIESSLQKQVKGTGLGLPLSRKLTELLGGSISVTSKLGEGSTFTASIPIIYPYATEFPTLLQPMTSGRSETIASLEPTGLPILAVEDHPETLFIYENHLQQSTYQLIATRTLAQARQVLQQVRPAAIMLDIMLEGQNGWTFLREIKGDETTRNIPIVVITIIDNEKQALALGANGFLIKPVDRLQLLNKLNTLINQNKPQKILLIDDDPAYRYLVKQLLINTQLSILEAMNGWEGLNLAQREQPTAIVLDLEMPELSGFDVLKQLKSNPVTQSIPVIIYSSAQRDAETQSQ

SEQ ID NO: 17493 - protein, 709 aa, Nostoc punctiforme
MFTTMRRVDTQRETVMTTGQPIRAETEYNTVDGVHCYEYILAPLYNPEQAIAGVIAVSRDIGERKRTEQALRQSEQRLQMAQRAGKIGTWEWNVATGEVFWSEGIWEILGLEIGTEEPGVKPWVDFIHPNDRPRVMEGVEKVLAEGKEYYDEFRIVRRDNTVIWVASKGQIIRDAEGQAECFLGVNIDISERKQAEEVRQESEERFQAFMAHSPAAAWITDADGKVIYLSPTYVNTFQLFTQDAIGKTAFELFDLEIATQLLNNIQTVAKTNQVLETIEMAPRLDGTIGDFLVYKFPIAHLSGQSLVGGVAIDVTSRRRAEEEREELLLREQAAREAAETANRIKDEFLAVLSHELRTPLNPILGWIKLLRTHQLSEEKKAIALETIERNAKLQTQLIADLLDVSRILQGKLTLNISSVDLAATIAAANETVALAAEAKSIQIHTEIAPDVQLFMGDASRLQQVVWNLLTNAVKFTPTGGEVKIKLESTNTYTQIQVSDTGKGITPEFLPYVFETFRQADSATTRKFGGLGLGLAIVRHIVEMHGGTVHADSKGEDQGAIFTVRLPLITTFLQPNQNKSLPKISLNLRGVRVLTVEDEQDTRELLVFMIEQYGAEVTAAASGREALKILKQSQPDILICDIAMPEMDGYMLIRQVRSWPKGQGGQIKAIALTAYAGESDQKQALAAGFQRHLSKPIDPEELVEAIASLI

SEQ ID NO: 17494 - protein, 379 aa, Nostoc punctiforme
MTSQSSRSGKILVVDDSPDNVFLIKTILEEEGYTISTAENGISALAELKASPCDLVLLDLMMPDMDGYEVTKHIRGDMKLPQYIPILLITAHDAPNVAHGLDLGADDFIRKPVTVDELLARVRSLLRLKHSMDERDEIARQREDFVSRLTHDLRTPLVAADRMLMLFQQGALGTLSPQMHEVITIMARSNINLLTMVNTLLEVYRFEAGRKSLAFQPVNLGRLLEEVTGELAPLAQDKTLSLNLDFTEESNTVMGDRLELHRLFTNLIGNAIKFTNSGSVTIRFTSQRQLDKSSQSQLSGKSNSVEYISIEIADTGPGIPTEEQATIFERFRQGSHKSSGSGLGLYLARRIVEAHQGIILLNSELGKGSVFIVLLPATT

SEQ ID NO: 17495 - protein, 763 aa, Nostoc punctiforme
MSNIKRRHFLQFSASTLAMLGLSQFDIMQQANSVGKVLAQSTGRKLALLVGINDYPASNGLDPLKGCENDVKLQEYLLIHRFGFKQEDIRILLNQQATRQGILTAFENHLIAQAKRGDVVLFHYSGHGSQVQDPDRDSPDGLNSTLVPIDSPLPTGFPAFGGAVKDIMGHTLFLLMSALKTDNVTFVLDSCFSGGGTRGNLRVRSRSGGEKLQPSQEELDYQRQWLNKLGLSQQEFIQKRRQNVAKGVVITSAKRDQYAADVPFSGFHAGAFTYSLTQYLWQQTGNESVNRAIANIGRSTKELASENGNDQDPEFESNLSEENANTPIYFIPVQAIPAEAVVTQVTENQAQLWLGGIDSQSLEAFNSNSVFSIVDGLGNEIGQVQLQSRQGLVGRGTLKYTTSKGKLHPGNLLQERIRIIPRNATLKIGIDESLDNKTAQQAIQAMKALKRVEPKSLTKEELQYIFGQMTKTKHQELQKKGVSKLPVVGSFGLFLPSQDQIIPASFGAASEPITEAVKRLQPKFKSLLAARVIKQILGNTNSSRLNVTVSMNIAGSNELLAETFPIRGVAKKPQQPNSSTPVSSIKFSDAGLRQLPVDTQIAFQIKNNESQPLYVSILVIDAEGEMTIIFPNKWSDSENAALVEAKQTQLIPQADDEFTLTIVTPLGVSEALIIASTTPLKTALQALQTIASRSTDTKSRNVPLPVTNELLDVTNNLLDDLDAGTRSGNSVNNIQLPSSDRGVDTTKLAAMAIAFEVIASSSS

SEQ ID NO: 17496 - protein, 316 aa, Nostoc punctiforme
MLSPTTDSVRSYLKEIGRYPLLTPDQEITNARLVQQMMAVEEQRSNLALQLNRQPTDLELATSLGQNEAELQSVIQQGQKAKQKMVTANLRLVVSVAKKYQNYSLDFLDLLQEGALGLQRGIEKFDPNKGYKLSTYVYWWITQSITRAVADKSRTIRLPIHINEKLNKIRRVQQQLSQSLGRPPVVAEIAESLNLSPNQIREYLQISKPLVSLEKRVGDEGESELADILPMDGISLDEQITLESLQQDLAKLLALLKPRQREVLTLRFGLSDNQQLTLSQVAKRLNLSRETIRKTEHLALSILRSHQNKIKDYLLN

SEQ ID NO: 17497 - protein, 507 aa, Nostoc punctiforme
MHIGFLNPQGNFDSNNSHITKHPDFGGQLIYVKQVAIAIAEKGHKVDILTRQIIDPEWPEFAQAFDTYPGIDNVRIIRLPAGPKEFLPKESLWTHLISDWVPNILKFYQQQGGLPDAMTAHYADGGLCGVLIEQDTGIPFTFTAHSLGAQKMDKLEVTSENLLEIDEQFHFKYRILAERLSMNRSVVNITSTRQERFQQYSHRVYRSAVDVDNDNRFAVIPPGADFSIFGAKARSENEKATEEFIQERLARDIEEARRDLPVIVASSRLELKKNILGLVQAFAISPTLQERANLMLLTGGLDNPLREEASDSIAEEVLAPIREVVKENDLWGKISAFGLLDQSQESLAAAYRFMVKRRSVFALTALYEPFGLAPLEAAVAGLPVVATKNGGPSESLRQGNKEYGILVDPEDPADIARGLERVLCDAQEWDYFAQAGQQRVLKTYSWESTAENYLTLLEQILSLPETRPRAELLPIHPYFRNPESQTDISLEELSDLYFGSNQKVLST

SEQ ID NO: 17498 - protein, 1105 aa, Nostoc punctiforme
MPDAEKSQNQLANEKLLHRQVSKKANYSLLASGEEGMVLQLADGTIQACNATCDRILGLTTEQLVGQNLLDSKWQFLHEDGSPLPNETHPAIAAQKTGKPCLNVVCGFYKPNGQLVWLLLSSQPLFQGGVDTPFAIVTTFLDITEFKQAQLEEKGNCTEDTQQVEEESWLQPEAKSIVPLASVIDVNGSQQLWDSQRLFQQIAGTLPGILYIYDLIEQRNSYVNDEIAQGWGYTPAEIQAMGKDLFTQLLHPEDLARLPTYFERFNSAHPGEVLSFEYRIRHVNGEWRWFCSYDTVHSRTVEGFPKYLLGIAFDITERRHIEISLRQSNERFELAAAAVNCLIYDWEIHRSSVERTQGLTQVLGYTQQEAEPTFEWWQQLIHPDDQQRVNNQFMASMANGNRYSIEYRIRHKDGRYVWVQDQGFAVRDTNGQVVRVVGASADITEQQAILREQQAALRDRQQIETNLRESEERIRLATSAAELGMWFWNITTNELVWTEKCKELFGLGPEVEMSYELFLNCIHPEDRQRLNEAIARCFQEKVEYDIEYRSLWSDGSIHWIAAKGRVFYEADDQPGRMMGTAQDITGRKQIENDLRQRETQLRRLVDSNIIGIMFATPDHITEANEAFLEMVGYTREELLAGKVRRKQMTPPEYHALDEQGIEQLLTVGVCNPFEKEYIRKDGSRIPILIGGALVEKDPPSWICFILDLTPRKQLEQTLRQQTEELKQANQNKDEFLAILSHELRSPLNPILGWSSLLKSRKFDEATTNRALETIERNTQLQIKLIDELLDVSRIIRGKLNLTFATVNLASVIDAALETVRLIAESKSIQIKIQLDPNVGKVSGDYYRLQQVVGNLLSNAVKFTPPNGSVEVSLSSSGELASHSALIQVKDTGQGISPEFLPHVFEYFRQADSSRTRKFGGLGLGLAIVRNLVELHGGTVTAASPGEGQGAIFTVRLPVMKESRGDEETGEGREKLNSLAIAGLRILIVDDDADTREFLHFFLQQNGALTTVAASVTEALAVIVKTIPDVLISDLGMPEMDGYSLIKLLRAMPKEEGGEIPAIALTAYAGESDRNRVLAAGFQKHLAKPVKPTELIISIADLVSQR

SEQ ID NO: 17499 - protein, 1175 aa, Nostoc punctiforme
MTHSFLERLRSPDSPVLVFDGAMGTNLQTQNLTAEDFGGPQYEGCNEYLVHTKPEAVAKVHRDFLAAGADVIETDTFGSTSLVLAEYDLADQAYYLSKTAAELAKRVAAEFSTPEKPRFVAGSIGPTTKLPTLGHIDFDTMKATFAEQAEALWDGGVDLFLVETCQDVLQIKAALNGIEEVFAKKGDRRPLMVSVTMESMGTMLVGSEISAVLAILEPYPIDILGLNCATGPDLMKPHIKYLSEHSPFIVSCIPNAGLPENVGGQAHYRLTPLELRMSLMHFVEDLGVQVIGGCCGTRPEHIQQLAEVAKDLKPKVRQPSLEPAAASIYTTQPYDQDNSFLIVGERLNASGSKKCRDLLNAEDWDGLVSMARAQVKEGAHILDINVDYVGRDGVRDMHELVSRIVNNVTLPLMLDSTEWEKMEAGLKVAGGKCLLNSTNYEDGEPRFLKVLELAKKYGAGVIIGTIDEDGMARTADKKFAIAGRAYRQAVEYGIPPTEIFFDTLALPISTGIEEDRENGKATIESIRRIRQELPGSHVILGVSNISFGLTPASRMVLNSVFLHEATTAGMDAAIVSANKILPLSKIDARHQEICRQLIYDERKFEGDVCVYDPLGELTTVFAGVTTKRDRSLDESLPIPERLKRHIIDGERIGLEEHLKKALEEHPPLEIINTFLLDGMKVVGELFGSGQMQLPFVLQSAETMKAAVAFLEPFMEKSESGNNAKGTFIIATVKGDVHDIGKNLVDIILSNNGYKVINLGIKQPVENIIKAYEQHKADCIAMSGLLVKSTAFMKENLEVFNEKGISVPVILGGAALTPKFVYEDCQNTYKGKVVYGKDAFSDLHFMDKLMPAKATGNWEDLQGFLNEVETAEVSTNGHKEPKTKTAEETSAEPKVVDTRRSEAVAVDIERPTPPFWGTKLLQPSDIPIEEIFWHLDLQALVAGQWQFRKPKEQSKEEYQAFLAEKVYPILETWKQRIIEENLLHPQVIYGYFPCQSEGNSLHIYDSENQSQQITTFEFPRQKSLRRLCIADFFAPKESGIIDVFPMQAVTVGEIATEFAQKLFADNQYTDYLYFHGMAVQVAEAVAEWTHARIRRELGFTAEEPDNIRDILAQRYRGSRYSFGYPACPNIQDQYKQLELLQTDRIKLYMDESEQLYPEQSTTAIITYHPVAKYFSA

SEQ ID NO: 17500 - protein, 609 aa, Nostoc punctiforme
MQQYSSLPDQNSQIDATPKLLTTIQQLRAKLWLESSLNQLQSRLNHYLLSACNNVLQAGAAESEVLQAVVNEINSVMSSTNLALTDYAVGIAMFQPQETVATVSYVSRSPSQNSQPLFVDVLTAEKKLLLRLQEVIELKDLQQLENQQPPSAWRLADDSGSVMGWLIIAAAPLSSDRESLIESKAQLRSQLMSRSANYCTTALVQLRHILSWQQQYQQLSNSNQELERTNQLKNQFLANTSHEIRTPLSSIIGFTNLLLAPGYEPTIERQREYLNIIQSSGKHLLALINDILDLSKIEANQLEVQWECVDVPLLCSNVLALVKEKAANKDLRLCLEIDPDITTLVADSLRLKQMLLNLLFNALKFTSKGSVGLQVVAKGISVHFTVWDTGSGISQEDQTQLFEPYFQIAKAVAGGAEGTGLGLAVTRKLAQIHGGSVKVESEVDSGSRFTLVLPLQQEAGAGIDKRDEGDEEAKYSSSLLPFIPSSSVDVLLVENDLPNADLMQIYLRKLGYQVTWVKNAAEMWEALTQLDPAVILMDVYLPDGNGLNLVRQLREHEQYQTIPVIVQTAMAMKGDRETCLTAGVNDYISKPIDLPLLASLVAKYSKPPI

SEQ ID NO: 17501 - protein, 222 aa, Nostoc punctiforme
MVLTLYHSPISPNSRRVWITLLEKGLEFELVDIKLDGEQFQPEFLAINPFHHIPALVDDDFNVVESLAILDYLEAKYPTPAMLPKDAKDLAIARMVQLVTVNELLPAATTFLPQILGLPGADPEKIEKAKHKIATVLKFFENLLDDRPYFASHNLTLAEVVAGTVVNVLPSVGIFLSEYPKLNAWHDRLIVRPSWQATESTPEAMEAFKSVIVARNTRQTQT

SEQ ID NO: 17502 - protein, 635 aa, Nostoc punctiforme
MHLSEITHPNQLHGLSVRQLQQIARQIRDKHLQTVAVNGGHLGPGLGVVELTLGLYQTLDLDRDKVIWDVGHQAYPHKLLTGRYDRFHTLRQKDGVAGYLKLCENKFDHFGAGHASTSISAALGMALARDLKGEKFKAVAVIGDGALTGGMALEAINHAGHMPKTNLLVVLNDNDMSISRNVGAIPRYLNKMRLSQPVQFIKDNLEEQFKQIPFVGESLSPELGRIKEGMKRLAVPKVGAVFEELGFTYIGPVDGHNLEELITTFQQAHQIQGPVLVHVATVKGKGYEIAELDQVGYHAQSPFNVATGKAIPSNKPKPPAYAKVFSHTLVKLAEQNPKIVGITAAMATGTGLDKLQAKLPNQYVDVGIAEQHAITLAAGLATQGMRPVAAIYSTFLQRAYDQIIHDVCIQNLPVFFCLDRAGIVGSDGPTHQGMYDIAYLRCIPNIVIMAPKDEAELQRMVVTGVNHTSGPIAMRYPRGNGHGVPLMEEGWEPLEIGKSEILRTGDDVLIVAYGTMVYPGMQAAEILSEHGIEATVINARFVKPLDTELILPLAKKIGRVITLEEGCIMGGFGSAIAEALMDADILVPVKRFGVPDVLVDHAEPNESKTELGLTSHQIAERVLQAFFKQQVSAVV

SEQ ID NO: 17503 - protein, 1224 aa, Nostoc punctiforme
MLEFWKSLFAYKQFIPHGHCYLWKPELVGLHIVSDSLIALAYYSIPIALVYFVRKRQDFPFNWIFLLFATFIITCGTTHLMDIWTLWYPTYWLSGCIKAITAIISLYTASELIPLIPKALALPSHAQLEIANQELEREISIRKQAELALQEREAMLRRISDNLPNGAIYKVIRELDGSDRFDYISAGIERLMEVRVEDVLKDSSLLYRQFIPEDVPLLQAAVDESRRNFSVFDIQLRIQTPSARLKWLHFRSTPRQLQDGRVVWDGLVVDVTDLKRVEETLRKSEALLEESQQVARLGNWEFELATGKITWSKQLFDLFNRDPELLEPNYQENLQLYCPEDAGKLAQATERAMSTGESYQLILRASPIYGSTIYIEGIGHAEFNADGKVIRLYGTAQDVTERQAALNKRKQAEEELRRSETLLATAQKIAHLGSWEWHLGSEKQIWSAETFRIFGLNPAESVPTQATFLQMLYPEDRPVLQRHLLQAIANGNPFNLEYRIVQPDGSLRYLESRAEVAYDTQGKTVRLYGAILDITERKQAEIALKQSEIRYRAIVEDQTEFIARYLPDGTITFVNQAFTRYFGRSPEQLIDSCYQPIIFEADRERVAQLIAAMNADNPVAIIENRVILEDSVRWTQWHNRMLFDEQGCFIEFQTVGRDITALKQIEETLFQEKELAQVTLQSIRDAVITTDAFGRIQYLNPVAESLIGCSEASAKGVLLEEVFRIVHETTREKVKNPIEQALQENRIVSLANHTVLITGRDQEIAIQDSAAPIRNREGQVIGAVMVFHDVTQNRLLSRQLSWQATHDALTGLVNRQEFERRVEQALHVAKLDYQVYTLCYLDLDHFKIVNDTCGHVAGDELLRQITVLLQEKVRKTDTLARFGGDEFGLLLTQCTLEEALRVANNLLSCVQEFRFVWQEQVFSIGVSIGLVVIDTNSESLAEIISTADAACYTAKNRGRNRVYVAQTDDQERLQQRGQMQWVGRISQALEVIGFCLYVQRIAAIIPTDQNGDHYEVLLRLRDEQGKLVLPMAFIPAAERYNLMHLIDRWVIRTLFKNWSRVVDNKQSIYAINLSGSSINDDRFIDFLHEQFTLHPISPQHICFEITETVAIANLLKARQFIQKLQRMGCRFALDDFGAGMSSFAYLKSLPIDYLKIDGSFIRNIVENPVDNAIVTAITRISSVMGIQTIAEFVENDAILERITALGIDYAQGYGIAVPHPLGKI

SEQ ID NO: 17504 - protein, 937 aa, Nostoc punctiforme
MMPSNNKNSPNKGNLPLRLVLVLPFVLQIFAAVGLTGYLSLRNGQQAVNDLASRLQREVSDRIDQHLDSYLNTARQLAEINGDAIDLKLLDTQDLEQLGHFFWKQMQLYNVGYISFGSKISEFASSGKFFDDGRITVSEVSQRRNGDRDEHLYNADAQGNRVSLAIVNKNYNFAKESWYADTVKAGKPIWSKIYQWETSPETLSVSANRPVYDRDKNLIGVIGIDQRLSQISNFLRSLKASPSAKTFILERNGLIVASSSTEQPYKLINGKPKRLQASDSSDLLIRAATTHLIEHLGNFSNIKENQQLDFILNHERQFVQVTPWRDEWGLDLLVVVAVPESDFMGQINANTHTTILLCLGALTLATILGVYTSRWIARPILHLSQASESIAAGELNQQVEIPSVNELGRLAQSFNRMAQQLRDSFTTIEQTNQQLAKTNEELESRVEERTHELKEAKLTADAANHAKSDFLANMSHELRTPLNGILGYAQILARTASDEKQQRGIDIIYQCGSHLLTLINDILDLSKIEAGKLELQLVPFYLPAFLQSVVEICRIKAEQKSIEFIYQPPENSAMGIVADEKRLRQVLINLLGNAIKFTDKGSVTFRVEVLLGDITNLRFYIQDTGIGMSPQQLEKIFLPFEQVGDSKRQSEGTGLGLAISQRFVELMASKIQVESQLGVGSKFFFNIDCAIATDWVQANSLTSSGRIIGYAGVGKTSVKENRKKILIVDDRWENRSVIVNLLEPLGFEVIEASNGQEGLEKITRDRPDTIICDLAMPVMDGWEMLKQLRQSETLRDAIVIVSSASVFENDRQKSLDAGGNDFLAKPVQADELYAVLAKQLQLDWIYKDTNIKYPIDTAASTKTIVIPSSSDLKGLLEHVETGYFRGIREELDRLAQLDEQYQPFIRELRELVKGFNIQTVRHFLQESINQSQESTKI

SEQ ID NO: 17505 - protein, 1177 aa, Nostoc punctiforme
MKSQANSKPKILVVDDEPDNLDLLYRTFYRDYKVLRATSGPAALDLLAQEGEVAVIISDQRMPMMSGTEFLSLTATQYPDIIRIILTGYTDVEDLVEAINAGKVFKYVTKPWEAEELKAVVRQALDTHNVLKARTRELTRTLRQESLLNTVTNTIRSALDYRQILQAIVDTVGHMLEVDVCLLRPFQDEQLTDKGFIYQKALSEEAGEHTPAEVQANNSSAVSLSPSTPLTVLAQTVWETREVQVIHDITDDERIHGNTPELRERGEAFAAANICSSLVVPLICQQELMAVLALHQCSVPRFWGEDEVQLVLMVADQAALALSQAYAYEQVRALAKRESLINTITSAIRSSLDPQDIFAAITQQLGQALQVDGCVLSLWTEEDEFVECVALYDSFQHLESLRRHSPPQASPAPDNNHLSPQRLPYSQSSIQENPILQQMLQTHEPVVIGNVSHSPSDIQGFNLPLKMPARSLMFVPLLADGKCIGSITLHEGKKVRQWLPSDIDLAKAVAAQAAIAVQQSHLYQKTRQQAERLLELDKQKTEFFQNISHEFRTPITLIQGPLESAVAAGEGLSYSQSAIALRNSRRLLRLVNQLLDLQRLDAGRMQPSFHPCDLVEFVSQIVESFRPYCEKKRLHLATQLDECSPVYLDMEKFDKVVYNLLSNAMKFTPEGGTIGVRLKSEQDRCILQVQDTGIGIVKEQIPHLFERFRQAEGSANRSYEGSGLGLALVKELVELHGGHVTVESVYGQGTTFSLWLVTGNGHLPVQQVLETPAEVNTSRASVELADLELVESTTDNIEDITINLSPNIDTQDSALKTQHSILVVDDNPDLRTYVSEIFRRNGYYVRTARNGYEGHSLAKEIIPSLIVTDLMMPLVSGLEMIQMIRNEEKLKGTPIILLTAKVDEETRIEGTEHGADAYLAKPFNDRELLAEVRNLLALKENERRIVELNTYLTESVLKRFLPAVLVQKAATGDLTLDLRPEPRLITVLFSDIVGFTQLSNTLRSRRVAELLNEYLEAMTKVVFGNGGTVDKFMGDAILALYGAPEELTPNEQVRRAINTARAMHRSLADLNQRWREQGVFDGDRLTSVQFRCGIHQGTAVVGMFGSAERADYTAIGPSVNIAARLQAAALPGTILVSAAVADYLQEEEITKGSPLELKGVDETVLTFAVTPEVMVNR

SEQ ID NO: 17506 - protein, 339 aa, Nostoc punctiforme
MSNLTSPPTEVQKTKKKSLAADKKPRATDDIVRSYLQEIGRVDLLTREQEVIFAQQVQLMMNLLAAKEELAVKLDHEPTLQEWADRVELGAEVLELQLSQGHQAKQKMIQANLRLVVAVAKKYQHRNLEFMDLIQEGTLGLERGVDKFDPALGYKFSTYAYWWIRQGITRAIAQQGRTIRLPIHVFEKLNKIKRVQRELSQQLGRVPTTAEIANALSLTPSQVRECLYLARQPFSLEARVGEQQDTELQDILEDDGPSPEDYAVEESLHQDLQDLLAKLSPQQREILTLRFGLTDGYELSLAQIGDRMGISRERVRQIEQKALSLLRRQKEQVRSYLAS

SEQ ID NO: 17507 - protein, 482 aa, Nostoc punctiforme
MSNSVLPQEGSQQQVTSQTKVLQEFPAGGLDPDSFDCQEVWYPVCYIEDLNKSQPTPFTLLEQNIVLWWDKNEQTWRAFIDQCPHRLAPLSEGRINHEGWLECPYHGWAFSGTGKCEFIPQQIQRTKAEVSQRACVATLATAVYQGMLFVYPGRAENAAKTKVPIVEPLEQDPDGWICLNTFRDVPYDALTLMENVLDTSHIPYTHHRTVGNRANVSPIDLEIIESGKWGFKGTWAEGPRKGTLGRQDTTFIAPGLMWHDLTSKQYGRTLTVVYATPIRKGECRLFARFPFKFSSNLPGLFLKLTPRWYSHIGQNRVLEDDQIFLHYQERYLEKLGGSANFTKAFYLPTKADLFVFQLRSWVRQYKAEPFKVECLPPPLSKEVLLDRYHSHTKKCASCRPALNQIQRLRAVVAVTTALIWGVLPFLMLIQNQISIITVIVSSLVMIVGVLIWLGLGKLEQQFYQGGEIPPRNLPEKNQQNFR

SEQ ID NO: 17508 - protein, 362 aa, Nostoc punctiforme
MKMGLRTRLFFSHLVVMIVGVASLVSISKISSPRLFVLHLERLENQGFDLIDVRTELVTGFELAWRRSTIWSVLVGTTAAGGLSYWVSRRIMQRLTEMEQITQKFAAGQMDARLPMSDIPELNGLGASFNRMAASLEGVEARRREVIGDMTHELRTPLTVVRGYLEELADGEIEASPEIYRRLAKETRRLERLVNDLQELSKAEAGYLPINIQRVNLRPLLESLVEKFTDQLLEDGPVLLLQCPSVLPLVLADIDRTEQVLVNLLGNAVRYTNEGSITIRVGTEASLLWIAVIDTGIGIAPENLPHVFERFWRADQSRDRHSGGTGIGLTISRRLIELQGGQIQVESELGVGSTFRFFLPLA

SEQ ID NO: 17509 - protein, 416 aa, Nostoc punctiforme
MPATSFYADAPYNTKKSRQALDSDLTVDESELSVDDLQELEIASVDNANFAASTNRRSTDLVRLYLQEIGRVRLLGRDEEVSEAQKVQRYLRMRIVLANAAKLGDEVIIPYLRLVEVQERLTSELGHRPSLERWAATADIVLSDLRPTLANGKRRWAEIAKLTVEELEQVQSQGLQAKEHMIKANLRLVVSVAKKYQNRGLELLDLVQEGTLGLERAVEKFDPTKGYRFSTYAYWWIRQGITRAIATSSRTIRLPVHITEKLNKIKKAQRKIAQEKGRTPTLEDLATELEMTPTQVREVLLRVPRSVSLETKVGKDKDTELGELLETDCVTPEEMLMRESLQRDLHHLLSDLTSRERDVILMRFGLADGHPYSLAEIGRALDLSRERVRQIESKALQKLRQPKRRNLIRDYLESLS

SEQ ID NO: 17510 - protein, 683 aa, Nostoc punctiforme
MLSSPDLSFSRTLPIVVFNQLGELLEQMAQTVGSATLVLTEAVLARISIPVEWQRQRFTLVVSGQFSALLLGNFEEGQGSRGAGEQGGSTSLRDAARTTTLSDQGAGGQEIHSLLSTQNSALNARLTFNLEAIASFLHELRDLFECDSYTHQNLERFCQIIGPNDATLQSKFSLLLLEYLLTQPNQEIIAPPSPTAPAVYICQPVEDALKKQISQERLLNQVTTQIRKSLDLPVIMATAITQVREFLELDRLVIYKFEASKVKTQEYQSSTDEDNGKGSTSISVNNQSLLEDYQQHRGYIVYEARATDAITCVLNYTEKNCFMRTSQCWEKYRQGFTLAVDDVEKTYALEECLLNFLRESQVRAKLAAPIILENKLWGLLIAHQCNEPRQWIDSEKNLLIAIAEQLAIAIYQAELMQTLTQEKQTLEQRVIERTIGLRDALLAAEAANRLRSEFLATISHELLTPLTYVIGMSSTLLRWPLGELSQRQRDYLQTIHDSGEHLLEMINDILDLSQIEAGKTALNISEFSLVNVAEKALESLRNKATSEQINLNLDLQIDPSRDRFTADAERVAQILSNLLTNAIKFTPESGNVTLRLWVEDDTAIFQVEDTGIGIREEQLPLLFEKFQQLDTPYRRRYEGTGLGLALTKQLVELHRGRIEVESTISIGSIFTVWIPTQAMRVLS

SEQ ID NO: 17511 - protein, 574 aa, Nostoc punctiforme
MPTQKPTLIDSSSESKKVSAEEPSTDELPTIEFPSRGKLKASSWRIHQKIGYGYFVAIGIGFFGALTGLVIANYYRGREVRQFNQAYEQGQLLSNYRDAVVGAQLHSSNLVAVLENSQQLQTKKADFLKNVEKAKQLESKISGFIDSKPKRLAATSSTLQTLLLDYKNNLKAYVEQIEVVLQKIDSQPAQPQQISTARSQLLTIMRGETAMRLDQLSESLANILQTAEDQEQERQKAVEQAKIVERFIVIISMLVSVAIAAIVAWRTSRAIAEPVITVTQVAEQVARKHNFDLRAPVTTEDEIGLLAKSLNRLIERVSERTKELQQAKELAEAASKAKSVFLANVSHELRTPLNAVIGLSQLLEDDATDLGLSADFITDLETINSAGKHLLHLINEILDLSKIEAGKMTLYPETFEIATLINNVVLTVKPAIEKNANVLEVHFDEQLGTMYADQTRMRQVLLNLLSNASKFTTNGKVTLTVKREKEELRLDAPLGMITFTVTDTGIGMSNRQQQQLFQPFTQGDTSTTKKYGGTGLGLAISRHFCQMMGGEIIVKSQPGLGSTFTIRLPMTVQD

SEQ ID NO: 17512 - protein, 185 aa, Nostoc punctiforme
MLKLYGGARSRASIVQWYLEEIQVPYEFVKLDMQAGEHLKPEYLAINPVGKVPAIIDGDFQLWESGAILLYLAEKYGKTPPSLEERAVFSQWVLFANATLGPGIFVEASREREMPRLLTPLNEIFSKQPFLLGDEFTVADVAVGSILSYIPVMLKLDLSSYPSVLNYIKQLSERPAFQKSIGGRA

SEQ ID NO: 17513 - protein, 423 aa, Nostoc punctiforme
MFQNKKHRIALISIDGDPAVEIGQEEAGGQNVYVRQVGYALAQQGWQVDMFTRRSNSEQSAIAQHGPNCRTIRLKAGPAEFIGRDNLFDHLPEFIEEFQKFQQRQGFHYSLIHTNYWLSSWVGMELKKQQSLIQVHTYHSLGAVKYRSIGDVPVIAAQRLAVEKACLETIDCVVATSPQEQKHMRVLVSSKGNIEMIPCGTDTDKFGGIQRTAAREKLGIAPDAKIVLYVGRFDRRKGIETLVRAVAKSSLRGEANLQLVIGGGSRPGQSDAIERDRIASIVTELGLENCTTFAGRLDETVLPFYYAAADVCVVPSHYEPFGLVAIEAMASQTPVVASDVGGLQFTVVPEVTGLLAPPKDEVAFAAAIDRILINPTWRDQLGEAARQRTEIAFSWYSVGFRLTQLYTRLLAQTASNTRPRIAA

SEQ ID NO: 17514 - protein, 595 aa, Nostoc punctiforme
MTITANSQLPNVFSQNLESITSKTDGLLPTLGAELVYTQDGAGRYLTFHWQHSELLGLNTEKIVEELNQTQTFAPVDKVNYVERLHRILTSLVPERFQCWFSYHQELFELDLVISPIMPSLGTTATTVLVMGRLVQATLNKKQARVASKTPTQIELALRSQQHQKLVNRITRNIRRTLDLDIIWQQTVDSLGKALRLERCIICPYQPSSSKVKVKAEYRQPELRSMLGLEIDVASEPAFAQALTTLEPVVMEVPGCTESGRQKTLVVATCYQDQANGLVALNWQDECYTLTESELELAKEAADQLGTAIAHATLYEELEVARQKAEEASRLKSEFLANVSHEIRTPLNGMIGFLKLILEGMADDPEEQNQFLAEAHNLSIHLLNIINDILDIAKIEAGKMELTYAPVKLNELFSDVESFMRPQAEMRNLSFRMQMPATSDEIIVQSNYQRLLQVMLNLLGNAIKFTHEGGVTVSADLVLKKSKLQDQQFPGLVRVRVADTGIGVSLDKQDKLFQLFSQVDGSRTRQYGGTGLGLAISQKLVEAMGGEVHFYSLGEGLGSTVTFTVPLYQQPVMVSSSDSDSTDSAVSDSEAFSPL

SEQ ID NO: 17515 - protein, 996 aa, Nostoc punctiforme
MAVSAWYGGMEAGLLATALSTLTVSYFFLEPVFSLSVASLDNIRRLGLFVLVTTFITLLNSELRTAKQHLQMSLQKLKVSEAKFRRLVESNIIGIIVANMDGAIAEANDAFLRMVGYSQEDLLAGRVRWRDMIPPKYIEANNSAIAELKAKGVCQPFENEYIRKDQNCVPILLGSALLENNSNDIISFVLDLSERKQVELALCQSEERYRAFLEQSSEGIWCIELEVPISPDCPEDEQIQHFYQYVYLAECNNVMAQMYGCSRAEEIINARLGDFLIPSDPHNIAYLRNFIRSNYRLIDAESHEIDKQGNSKYFLNNLVGIVENGLLVRAWGTQRDITERKQAEAALNQQEEQLRLITNAVPVQISYVDIQQLYRFNNKGYEDWFGLPASEIYGKHIREIMGESVYQSILPYVEAVLSGEEVTYETQLPHKDGTHHYINVSYVPQFSEQGKVEGFVALITDITLHKLAEAALKQSEKRLKTLTEKVRIIPWEVNATTGNFTYVGPQTVEILGYPLSDWYIDDFWQKHMHPEDREWAIQYCQESSLSLNNYEFEYRMLAADGRVVWLYDIINVVRDENGPQLLHGFMLDITDRKQAEQEREQLLEREKAARADAESANRMKDEFLATLSHELRTPLNAILGWTQLLRNRKFDEATTARALETIERNTKSLAQLIEDVLDVSRIIRGTLHLSIHRIKLVPLVEAAIDTVRPAAEAKEINIKCKFDPEVGIVVGDTNRLQQVVWNLLSNAVKFTSKGGSVDVQLERIESSVQIRVSDTGVGIAAEFLPHVFERFRQADSSSTRSHGGLGLGLAIVRHLVELHGGTVSVESLGVGQGATFIVNLPMKAVYVEANTAEQPSSLVDVPEANNYLPRLDDLRVLIVDDEADARHLLTTILGQYGAQVIAAASACEALLALQQFRPHILVSDIGMPQQDGYALIRQVRALPTDQGGRIPAVALTAYARAEDRTQALLAGFQLHVPKPVNPSELAVVVANLTGRT

SEQ ID NO: 17516 - protein, 1504 aa, Nostoc punctiforme
MSQQQRTLLIIDGSPEDRELYRRYLLRDREYSYTFLEATLGQQGLELWQQHQPDAILLDYRLPDIDGLEFLAKLQTSTQQPCLPVIVVTGQGNEAIAVQAMKAGAQDYIVKKQITAQGLQIAINGAIETVRLRTQLQQRIERERLVAQITQQIHQSLNLDEILQTTVAEVRQFLHTDRVLVFRLNPDGDGTVMAESVGTEWRSLLSSTIQDPCLAESYTTSNRPQVRYDPALLKNYIERYYQGQVTAVSDIHDSSIDSCHGELLAQFQVKAHLVVPILQDNQFWGLLIAHHCTSPRFWQPLEIDLLKELATQMSIALRQAELYQQAQHELKERQQVEAELCQSEEHLRLALSASRMGTWNWNIQTGKITWSDNLEALFGLQPGEFDGSFEMFAARVHPEDRDRVLATVNRAVATGEEYDIEFRVVYPNGTIRWALSQGKVFYDQHGQPMQMAGIDIDVTERKRSAEALRESEERFRQLAENIDAVFWIREVSENRVSYVSPAYERLWGLNSEELYQGQQSWIDRIHPEDREATQKAFHEKAVAGKFDEEYRVILPDGSIRWVHDRCFGLRDKTGEIYRFAGIAEDISARKHSLAALQESEERFRTSVENMLDCFGVYRAVRNEQGQIVDFVTEYVNDAACLNNQMTYEQQIGRGLCELLPSHRHSGLFDDYCQVVETGQALIKDSLVYEDEYGEQRLVKAFDIRVAKFGDGFVATWRDITVRQQTEEALRRSEEFKNRILDSSSDCIKVLSLDGRLLYMNTGGLCLMEIDDLNSYLNTEWLCFWSGSYRQQAEQALAATKAGEISIFSGYCPTVKSTPKWWEVVVSPILDASGQLERILLISRDITDRKKTELLLQQSEARLKLAYKATRSGLWDWDIIRNSAHISEEYCHLFGFDPTTKSITYENWLSCLHPDDRTSTNETVNRTIQQQQEGYEDDFRILHPDGIRWLAAKGQVFYDTVGNAVRMLGNVQDITERKQVEEELRQSEERYRCLAELIPQLVWTANPEGRLLDVNQRWLEFTGLTLEQAHTSGWREVVHPEDVLILVKEWSKAVQQGTSYQAEGRMRRADGVYRWHLHQAIPQKDRQGEIVKWFGSATDIEAQKQLEVERDRLFQLEQAARAEAERANRIKDEFLAILSHELRSPLNPILGWTKMLQSRKFNETKTAQALASIERNVKLQTQLIDDLLDIAKILRGKLSLDVTPVNLLFVIESAIDTVNTAAIAKSIQLHPVLPNIGQVSGDSNRLQQIVWNLLSNAIKFTPKGGRVEIRLERVDEQAHIIVSDTGKGINPEFLPHIFESFRQEDVSITRKYGGLGLGLAIVRQLVEAHGGTITADSPGEGLGATFTVQLPLLNLQPEIKQTDDLLQPGLELTGIRVLTVDDDPDARELLTVLLAEYGAQVLTVPSATEVLANLESFQPDVLVSDIGMPEVDGYNLIQQIRALTPEKGGQIPAIALTAYARVDDSQRAITSGYQRHVTKPLDPEELVQAVVALAQIKIGKSESSQ

SEQ ID NO: 17517 - protein, 252 aa, Nostoc punctiforme
MKPFLFVTDLDDTLVYRTTGDDSALPELNQLLKRHRQEYGTKIVYSTGRSPVLYKELQAQKNLLQPDALVLSVGTEIYLNGADTPDSDWSEILSPGWEREVVLSITRKYRELVRQPDSEQRAFKVSFFLEQEASANVLPQLEAELQKSKLNVKLIYSSGIDLDIVPHSSDKGQAMQFLRQKWKFAAEQTVVCGDSGNDIALFAVGNERGIIVGNARKELLQWHNEHPAEHRYLASCFCAGGIIEGLNYFGLL

SEQ ID NO: 17518 - protein, 938 aa, Nostoc punctiforme
MAAELEQQLQRVLDTGEPLLNVEISGETREQSRRYGYWLGNYYPVNNSMGETVGIGIILADVTAAKQTEVALRESEERFRAMFNQAAVGITLVALDGKFIQVNPALSEITGYSPEELMQITFEEITHPDDLAVDLENARRVLAKEINGYSLEKRYICKDGSIVWVNLTSSAVWDTNGLPKYALGIIEDISDRKRVETTQQFLVEASTLLAASLDYEIALESVANLAVPTLADWCIVDVFQEDWSSKQIAIAIADPTKLNTLDEIRRRYRPKTRAKQLVRQLQLGISVFYPELSDSHLLQMAEDDEHLQLLQSLGICSLMVIPVRSRGQLFGAISFFTAESSRHYKQTDLALAEDIARRAAIAIDNARLYQETQQAKQGAERSVNRTILLQRITAALSEALTSQQVADVVVNQGIAALEATGGSVVLLTEGDTSLKVVQAIGYSQALIDTWSNFPVTAPNQIAETVRTSEPIFLENLAAMIARYPNLAEVVALTGNNSWASIPLIAEGKVIGALGLSFINEQIFHEEDRGFMLTLGQQCAQAIARAQLYEAEKTARAQAETANRIKDEFLAVLSHELRTPLNPILGWAKLLRTRNFDEATKIRALETIERNAKLQTQLIGDLLDVSRILQGKVRLNLYAVDLKIAIAGALETVRLAAEAKSIQIQTVLSNDIGKVLGDSDRLQQVMWNLLSNAVKFTPTEGRVEVRLEQVGLDAQIQVIDTGKGIIPEFLPYVFDYFRQADAKTTRVFGGLGLGLAIVRHLVELHGGTVQAESLGEGQGATFTVRLPLLKNSELRVSSDEASQLELSTDDTLLAGVQILLVDDQADVREFFSFALEQYGATVTAVESAAEALEILMQSKPDILLSDIGMPLMDGYMLLREVRKLPPEQGGQIPAIALTAYAGEINYNQAMAAGFQKHLPKPVDPSELATAIDNIIRNSS

SEQ ID NO: 17519 - protein, 1559 aa, Nostoc punctiforme
MKAPLPDNEIQRIESLLEYKILDTHSEAAFDDLTHLASYICGTPIALISLIDSDRQWFKSKVGMEALETPRDLAFCAHAILQPEVFVVPDATQDERFATNPLVTSDPDIRFYAGVPLTNPEGYALGTLCVIDRVPRNLSPEQVEALRIIGRQVIKQLEMRRNLASLVLVTHTRKQAHKRRKQFFKTVAGGFGLASAILVLIGVISYQNTRILIDASNQVQKTQGKINKLEELLSEMKDAETGQRGYILTGQESYLEPYQAVVVNIDQKIVELKDLIADQPSQQNQFAALESLIAAKFAILKQTIYLRQNQGFEAALQVIQTNHGKYIMDDIRKVIHEIENEDKRLLQQQSQAAKASANNTVLTLAIAICLGFITLAIVYYFIYREVKERKLTEETLNQERNFISAVLDTASALVIVLDTQGQIVRFNQACEQTTGYSFDEVRGRHFWNLFLIPEQVEPVKAVFEQLRTGEAPKEYENYWVAKDGSLRLISWANAILQDHEGCVEYIVATGIDISDAYDELRLRKRAEQHLKAQYSTTRVLAESTTISEAMPQILQGICESLEWDLSEIWMVNQRVNLLSLLNSWYKMSSEMQEFEILSQQIIFAPGIGLPGRVWVSSEPVWIVDVVKDKDFIRSQMAVQAELHGAFGFPIHSGKKILGVITCFSHEIQQPDPDLAKVMNSIGEQVGQFIERKQAEEELQRQNLRSQLFTEITLKIRQSLKIQEILQVSVTEVQKILHSDRVLIYQPLTDGSGSTVVEAVVSGWLTIKEKKLTDSYFQAEYTQQYYLQQYRQKRNLELADLDIVEIQKRHIELLQQFGVKSNLVIPILVKEELCGLLIVHQCGSSRQWSSFETHLLRQIADQVGIALAQAQMLYAETQQRRELEVARHQAELASKTKSAFLANMSHEIRTPMNAVLGMTGLMLETPLNSEQQDFIETIRISGDALLSLINEILDLSKLEAGEMALETLDFDLSTCLEEVLELLAPSAHNKGLEIAALIYPNVPTQLQGDAGRLRQILMNLISNAIKFTSNGEVVVRAELRSLSSTTATIYFAITDTGLGITFEDQCRLFTPFTQVDASNTRKYGGTGLGLAICKQLVSLMGGEIGVESRLGKGSKFWFEVTFAQQLYPISSESERELLINRRLLVVDDNATNRKIIHHQATRWGMLVDQAASATIALKAIEETAKQKNLYDIAVIDMHMPEVDGMTLGEQIKANSAIAGLPLIMLTSTNQRDEIQRALKIGFAAYLVKPVKPSRLLDTIMTILGTQIKEETEVRSQEFKLKDYENNSNDHSSSSRLLARDFHKLRILLAEDNLVNQKVALKQLQSLGYSADVAGNGKEVLQLLEKIPYDLILMDCQMPVLDGLETTKEIHRWQESSFVSSRRPVVIAMTANAMKEDQQMCLDAGMDDYLSKPVIKEKLAAALQRWGSVIFQAKEIYVLEQKKGSKTDVGSVDLPIDWERLHQLSENNPEFELELLEIFVEDMQPRLEIIKIAIADNDYEQLALQTHQIKGASANVGATTMHLAAQKLEQLAHNQERRGTTHLISELEDFVKCIQEFLITR

SEQ ID NO: 17520 - protein, 2370 aa, Nostoc punctiforme
MMIALPGFKIVTLLKAGVKAVIYRGIKVKDQCPVIIKGLRSEQCTPNNIEQLKHEYAIAQKLNIAAAVQVYALEMHQGIPYLIMEDFEARSLDQLLDQFQEPVSFLKIAIEITSKLAQIHTHHIVHKDIKPQNILVNLETNQVKIADFGIATFIPYQQQIVSSSSRIEGSLPYLSPEQTGRMNRGIDHRSDLYSLGVTFYEMLTGQLPFQGKDPLEWVHCHIAQSPPSPKKLNSDIPQMLCDIIIQLLSKVAEQRYQSALGLQFDLERCLKQLETTGEIQSFVLGEQDISERFQIPQKLYGREQEIAKLLQAFERVVTQGKPEVVCVSGYAGVGKSSLVKEIHKPIVRERGVFICGKFDQYKRDIPYSTIVQAFQTLARQILTQPEDQLANWKKRIQAALGNNGKLIADVIPEVELIVGEQPPIPELGPAESQNRFNLVFQNFISVFAQKEHPLTVFLDDMQWADSATLNLIQSVMTESNIQYLCFILAYRNNEVDVVYPFSLMIGKVCQYGARITEILLTPLNLVYINQLIADTLHSSAERVESLAQLIIQKTDGNPFFVNEFLKTLHQENLLIFNLSQSSLSKEESRGEWQWDLAQIEAQGITDNIVSLMIGRMQKLPTATQEMLKLASCIGNRFDLKILAVVGEQSIEETANALVEAILRGLIIPIESDETAHKNYRFYHDRVQQAAYSLIADESKSAVHLRIGRLLLKNASYEKVNEQIFDLVNQLNFAVDLIIEQAEKDELIRLNLIAAKKAKASTAYTPAKKLFSIAMNLLAENAWIEQYEQTFTLFRELAECEFLTGNLGQAQELFEILFSKAASYMDKSNIYMLQIRLYQVAGRYEEALILGLEALKLFGVTFPDTNEEVQAAIAIEKNQVLTNLGNRQVSDLINSIVIQDPNIKTVISLLTTLGPPTYLGRPDLFPLVVLKAVNYSLKFGNTEDSCFAYSMYAMLLVSIFHDIPTGYAFSEMTIQLNEKLHDLKLRGVVLHIHGSHINVWCNHIATDIPFLERGFIGCVEAGDVTMANYNGYQGSWQIIQLGFPLAETYKSLEKYTAFARQSKHETVYQTIKLQQMLLMNLRGLTHHNLTLSNDEFNESSALSIITDADFVSGTIFYHIIKLIIFFTYGKYTEAFNSALELSNFPVKTLASLIETDYILYYSLTLTALYPTVSGQEQEQFLQSLESHQKQLQYWANHCPENFLHKSQLVAAEIARIQGRNLEAMRLYDQSIASAREQGFVQYEALAHELGAKFYFERKFELIAKTYLQESKNAYIRWEASAKVKHLEESYPQLLPRQQLVSNGTFFSTGEHLDFLSIVKASQTISSEIVLSRLLKTLMQIVIEQAGAEIGYLLLEHEQNLVIEVEAKVNPQAEKLNVSRPVFQGEISQLIPQSMLNYVQRTQETVILQNATEQNLFSGDEYVIQKQPKSVLCLPIARQFKLLGILYLENNLIPSAFTQEKLSVLDILTVQIAISLENARLYQGLENSQEQLNLALKSGKIGVWSWDIANNLFDWDEQVYQLFGLTPETFVATSETILARLHPDDRSLLAQSLSRTISEGVEHDLEYRMIRDDSSIRYLACRGKAFFNKAGKATHMSGVVLDITDRKQAEAERIQLIQEQTARQEAEADRQRAAFLAQVSATLASSLNYESTLASVANLVVPYFADWCSVDLLQDNQSINRVAVAHRDPEKVKLGWELHQRYPRKLDEPVGVPKVLRTGIPEMVTEISDALLAKGIPDAEHLRIIREIGLKSCMMLPLMARERIFGAISFFTAESERRYSTVDLSLAEDIAHRAAIAIDNARLYQEAQQAQKTAEIALERIARLQSITAALSESLTPAQVSEVIVEQSMAALGANSALVALLNENKTELEIVQTVGYNQDLVDAWRHFPIDSPSPLAEAVRTGQPAWAESRQNRIARYPHLAEAYAQYDIDAWISIPLMVEGSAVGGITLGFAQLQEFSEEDRAFMLAVAQQCAQAIARAHLYEAELTARNAAESANRIKDEFLAVLSHELRTPLNPILGWTKLMRSRKLDQATSDRALETIERNAKLQTQLIEDLLDVSRILQGKLNLNFGPINLVSVIEAAIETVRLSAQAKSIEIQTIFEFGVGSVLGDANRLQQVIWNILSNAIKFTPSEGQVKIKLEQVGSQVQICVTDTGKGIAPEFLPYVFDYFRQADGATTRQFGGLGLGLAIVRHLVELHGGTVQAESLGEEQGATFTVRLPCLQNESKGIKDKINTFSLLPEQSLPLFGLEILVVDDDADMREFLPFMLEEYGASVTVVASAIAALTALSQSQPDLIISDIGMPEMDGYMLMRQIRSLKPEQGGTIPAIALTAYAGEMDYQQAIAVGFQQHISKPVDPEELVKAIGLLIKSL

SEQ ID NO: 17521 - protein, 1098 aa, Nostoc punctiforme
MPSFTLQLSKLTKNVQLRHILVVPFVLQISLAVGLTGWLSIHNGQRAVNEVAIQLRNEITARIQQYLKVYVETPHKINQLNANAIKLGELNIQKLSTLEQHLWYQLKTFDTVTAVYVGSEYGEHVAVQRADDGQFEVKLSGKSTGNEIRIYAADQPGHYTQLLRSKPNYDPRTRPWYQSAVKSKTASWGGIYKLFTTPKYVLNASLPIYDDGGNLLGVAAVDFSLTGISQYLRTLKIGRTGETFILERQTGLLVGSSATQQPYIIANSTAPIIDQNPVRVQAIASSDILTRRTADFLQQHFVDLTQITEKQQLDFDIEGQRQFLQIVPMKQQGLDWLIVVVVPERDFMDQINANTRSTILLCLCAFALATGLGILTAHWITQPILRLGSTAKAIAAGNLDQKVSVNSTTELNSLAESFNLMAHQLRESFLALARTNEELESRVTQRTTELGEKNAQLQREIRVSEAAQRGRRQVEEALKTSEAELRLMFAAMTDMVVVFDAEGRYQKYVQTKYVLTQSFAYKPDMDRIGKKVDEVLPKEIANLILDAIQQALHLREEPRNPDGSRKNVFVEYHLSNKNRETWFLASVSPLSDNTVLWVARDITKLKKTEAALKQAKETADAANLAKSQFLSNMSHELRTPLNIILGFTQLLLRNRSLNSQQQEYLDTINRSGEDLLTLINDVLEMSKIEAGRVILSETNFDLYGLLDRLQQMFALKAQSRGLQLILERSPTIPQYICADESKLRQVLVNLLGNAIKFTRIGQVTLRVETPNQNITPDEPITLNFSVEDTGCGIADSDFNRLFEPFVQTEAGQKAQEGTGLGLPISQRFVQLMGGDIRVNSTLGKGSIFTFDIRTRAVIMDTLPTPAPSRQVIGLEKGQPSYRILIVEDKLENRQLLVELLTPVGFEVREAVNGQAAIELWQNWSPHLIWMDLRMPIMNGFEATKHIKAAGAQTPVIIALTGSAFEEDRLTALSVGFDDFVRKPFRTTIIFEKMAEYLGVRYVYADEREKQEKASWPSNASFITPKLTVADLSVMPSDWIEQLHQAALRINAKEILMLIKQIPEQHAHLIVALTNLVDCFCFEEIIALGTTQKINDPKM

SEQ ID NO: 17522 - protein, 270 aa, Nostoc punctiforme
MSYSPYLLKGQKALVTGASSGIGEAIARYLAASGAAVAINYHSEAESAQKIVDDIKAANGEAFAIQADVSKEDQVKAMFSLTLKQFGTIDILVSNAGIQKDSAFIDMTLDQWNAVIGINLTGQFLCAREAAKEFLRRGVKPDISCAAGKIICMSSVHEVIPWAGHVNYATSKGGINMMMQSIAQELAPHKIRVNSIAPGAIKTPINKSAWDTPQAEANLLKLIPAKRVGNVEDIAKAAVWLASDDSDYVNGTTLFVDGGMTLYPGFTDNG

SEQ ID NO: 17523 - protein, 321 aa, Nostoc punctiforme
MSNLTFSDTKASNTNKATTDTVRAYLKEIGRIPLLTQEQEIIFAQEVQQLMTILAESEKLTIELKRTPTLSEWANQMQLSEQELLQQLNQGKKAKHKMITANLRLVVSIAKQYQRRNLELMDLIQEGTLGLERGVEKFNPALGYRFSTYAYWWIRQGITRAIAQQGRAIRLPIHINEKLNKIKRVQRELSQTLGRIPTSTEIANALSLKPSQIREFLLLATRTISLDIRVSSEKDLRLQDLIEDYKYSSNSYITEESLNQEVNSLLSNLSRQQQEILNLHFGLTDGEELSLQQIGQRLGISRERVRQIEKQALKLLQQQLS

SEQ ID NO: 17524 - protein, 595 aa, Nostoc punctiforme
MTNEEVEQIYLDDILITQELSRRIPRTTDLKQENDVLHTLIGQLVEQPQILLKKLVKIITQLCQAESAGVSLLEVTPNGEDICHWFALAGMLEAYERTSTLYSFSCCGICLERQTPLLYSYPERYFTYLQQFKPTIVEILVVPLLIANQPLGTIWIVSHDEHRQFDREDLRLMKSLANFTASALYNSNARQAAEESARREQAARAVSEAAQNAAEQANRLKDEFLAVLSHELRSPLNPILGWAKLLQTRKLDEAKTAYALATIERNAKLQSQLMEDLLDVSRILQRKLSLKISSVDLSAVIEVALDTVRLAAQAKSIELKTEFEPNIGQVLGDPSRLQQVVWNLLSNAVKFTEDGGQVEIRLERVGTQAQIQVSDTGKGINPEFLPHVFDYFRQADNTTTRTFGGLGLGLAIARQIIELHGGAIQAESEGDDKGATFTVLLPIKSVEPQTSEDKGLANDSPNLEGVNVIVVDDEVDTRELIVFTLQQYGASVRAFASASLALDAFRVEKPHIILSDIGMPEMDGYMLIREIRRREAACRQTSLPPEQGGEIQAIALTAYAGEINESKILQAGFQKHLTKPIEPVKLAMVIASLVK

SEQ ID NO: 17525 - protein, 681 aa, Nostoc punctiforme
  unsure (1)..(681): unsure at all Xaa locations
MANRIRQSLNLQEILDATVVELRAFLQTDRTKVYRFDRDGHGHVVAEASAPNRLPSLLGLHYPADDIPPQARALFVKARTRSIVNVSEQRIILNSLPTPTTTAIGDLTVEEVQEQPLEDILSRPVDPCHVDYLTQMGVQSSLVVPIIYQQELWGLLISHHAEPREITSEDLLVVQLLADQVSLAITQASLLSQVQEQQQRDAIVNQIATMLHAPLTPEEILHNVLEQAVKASGSSGGRLYLTSPDEALPAHLYTYGNQPAPSEQEQPHLLENHPLWQEVRKIPAPIGTTLTQKDKPALRVVINLQQEPRLHQLIESFQTTPIRGLIVQPLYYSKEFLGYLTFFRDQISTKNLWPGYEEADERQQRPRQSMAQWQALKEDKAHPWSIEEMELIQSLNIHLSLAVLQNRLYHRERQQRLIVEMHNEALSHARAAAEEVSRLKSNFLASTSHELRTPLASTLNYLKLLKERLYEDEDELREYIDGAYQSTQNLVTIINDVLDIAKIEDGRIALDLETVYLQQLLQEQCFLSGAESRYKAIPLTLDCEIETVFADKIKVRQVMTNLLDNAFKFTDEGQIDVRAVVDSTGTMAQISVHDTGIGIEMENSEQLFSPFVQADGSAQRSYGGTGLGLTICKRLVELMGGKIWLESPGLGQGNTVTFTLPLNEQSQVAGQGSLFEGQAXX

SEQ ID NO: 17526 - protein, 112 aa, Nostoc punctiforme
MKKVEAIIRPFKLDEVKIALVNAGIVGMTVSEVRGFGRQKGQTERYRGSEYTVEFLQKLKVEIVVDDNQVDMVVDKIIAAARTGEIGDGKIFISPVEQVIRIRTGEKNTEAV

SEQ ID NO: 17527 - protein, 425 aa, Nostoc punctiforme
MTATSPRLKHEVKDLGLAALGRQRIEWAGREMPVLKQIRDRFAIEKPFAGLRLVACAHITTETAHLAIALKAGGADALLIASNPLSTQDDVAASLVVDHEIPVFAQKGEDNATYNRHVQIALDHRPNIIVDDGSDVVATLVQERQHQIADLIGSTEETTTGIVRLRAMFREGVLTFPAVNVNDADTKHFFDNRYGTGQSTLDGIIRATNILLAGKNIVVVGYGWCGKGTALRARGMGANVIVTEIDPIKAIEAVMDGFRVLPMAEAAPQGDIFITVTGNKHVVRGEHFDVMKDGAIVCNSGHFDLELDLKYLAAQAKEIKEVRPFTEEYKLKNGKSVVVLGQGRLINLAAAEGHPSAVMDMSFANQALACEFLVKNKGKLQPGLHSIPVEVDQEIARLKLQAIGITIDSLTADQIEYINSWTSGT

SEQ ID NO: 17528 - protein, 775 aa, Nostoc punctiforme
MSQPENTTTQATALTNHDRKPIHIPGSIQPHGILLALSTQLEIVQVSNNTQVYLCKAPEDLLGRPLSYLLEPQPVEIVKQCLVKKVGSANAFKVLINTLYGEIYFDAIAHRTEEAVILELEPTDSEFEVSFLNFHSFASEAIAKMQRTSNLGEFLHLVAQEVQKIISFDRVMVYQFDESEAGSVVAEVKREDLSPYLGLHYPATDIPAQARELYTRCFLRFLPDLTAEPVKLVPTENPTTHQHLDLSYCLLRSFDWCCAEYHQNMGVKALLVISLIQEQKLWGLISCHHQTPKYISYEVRKMCEFLGQIVSSELAHKISSSEWDYKVKLKSLQSEFLESISQADNFIDALIKPEIRLLDFVSASGAAVCLDNEINLVGTTPNIDEVRALIEWADTQVTDNLFSTDSLPKLYPEALIFKDTASGLLLLRISKVRRYYILWFRPEVIQTVHWAGNPQESIKAEGDGSYTLSPRKSFEQWQETVRLTSLPWKGCELESAIALSNAIVGIVLSKADELAKINLELERSNQELASFAYAASHDLKEPLRGIYNFSTVLLEDYAQVLDDDGIECLQTVVSLSVRMETLINALLRLSQLGQAHLREQATDLNELLNQVIDVFRASRQDSGLVDIRIPRPLPTIQCDRVLVNEVFSNLLGNAFKYNDKAEQWVEIGYLSQEEGQGVGSRGQGAGGAGEAIIHQSPIPNAPCPIFYIRDNGIGIPQHHLETIFRLFKRLHSQEKYGGGAGAGLAIVKKIVELHNGQIWVESTLGVGSIFYFTLE

SEQ ID NO: 17529 - protein, 839 aa, Nostoc punctiforme
MAAIAIVIVSHSKQLALGVRELAAQMVRGQVSIAVAAGIEDPENPLGTDPIQVYEAIASVFSDDGVLVLMDLGSALLSAEMAIEFLPEAQQQKVYLCEAPLVEGAVAAVVAAAAGKNIHQVMAEARGALLAKATQLGVSPLSVVSDNIEVRNSELPVKEIRLIVSNRLGLHARPAAQFVGTSARFQSQILVQNLTRNTGLVRGDSINQVTTLGVRQGHELVITATGSDADEALAALQALFANNFGEDNVVLNSPPVFHHEVTPATHGELSGIAASAGVAIAPVVNYQPTHITITEYHVDNPESEWQRVQAAIHTAKQEIQAVFSQASLQIGDTEAAIFDAQLLFLEDPVLLEAAHQRILDHYINAEAAWQAVVDEVATSYRTLEDAYLQERVEDVVDVGQRVLRLLAGNAPANLHLSEPAILVATDLTPSDTARLDPRMVLGICTTSGSATSHSAIIARTLGIPAVLGVDSQVLHLADGTLMALDGESGKAWVEPESHILDLLEAKREAWQTAQEEARATAHQPAITLDGRQVSVFANIGSINDVQVAVASGAEGVGLLRTEFLYLDRTSAPTEEEQLEVYQAIAQVLDNRPLIIRTLDVGGDKPLPYLRVGFPEANPFLGWRGIRFCLDHLDLFKTQLRAILRASVGHQIKIMLPMIATVTEVRAAKVILGEVQAELNQAGIPFDAAMKVGIMVEVPSAVAIADQLAAEVDFFSIGTNDLSQYVMASDRTNPRVANLVDALHPAVLRMVQQTIQAAHAAGISVGLCGELAADTLATPILLGLGLDELSVNPQSIPGVKQAIARLSIVESEAIAASALQQDSAVHVREIISTSIIPPTN

SEQ ID NO: 17530 - protein, 461 aa, Nostoc punctiforme
MITSFSWTKQWYPITPVSYLEPSYPTPMTLLGKKLVIWRDKHQKWVAMDDSCPHKLAQLSLGSINENGNLMCRHHGWCFDGAGKCTNIPMLSDEKALKAACNSERSQVTTYPTQVLQGLLWIWADNSPTAFKDSTSKQPALMPESQLDSSLTDWFMSEVPVGYTVSVESSFDPSHAQFLHKGIAGFSPERAIPIQNFEVFGEISAEDGFTLEHSGYNIFNKDMDATRKFTPPCSNTTSYKYSNGKSALFQLYFVPTKSGYCKQIGKFIADSLPQKGNFWFELLPKYLQTGLKHSSSYKLSNQDLSMMHSQAVNESVVNKTWQKSYFMPSVADIGIVTFRKWLDEFAGGKPALQGVAEAPFQELSDEQLYDIWHRHTKHCPSCRQSLVMIDKVKSFCQTLTLGLTILALLLIVINLPINIVITPVLIGILSLICSYKLDSIRERFLSSIPKKGLPVVELYEN

SEQ ID NO: 17531 - protein, 311 aa, Nostoc punctiforme
MDLLIMIPAFTNHPPSLMAILQLIEPEVKDLGGFVARRSLPYLHRQMVGPFIFFDHVGPSVLPPNKGIDVRPHPHINLATVTYLFDGALMHRDSLGTVQEIQQGAVNWMTAGKGIVHSERSPDSDRQKETTIHGIQTWVALPVEYEEIDPSFTHYPAQTLPTWEENGAIIKLIAGVALGYTSPVKVFSPILYLDVILSANAQFTIPTGYSERAVYSVTEGLSINEQPLEPYRLAIVEPADEIRVSAAAPARCIVIGGEPLGTRYKWWNFVSSRPERIEQAKADWQDCRFANVSEETEFIPLPEVVTEANPF

SEQ ID NO: 17532 - protein, 332 aa, Nostoc punctiforme
MTLPPNPSLPKSSAMKTAQTATDLVRTYLREIGRVPLLTHEEEIFYGKQVQRSCTLHESRESLATQLGRQPTLEEWAKATKLEPVELNEAIADGEIAKRKMVEANLRLVVSVAKKYIKRNVDLLDLIQEGSIGMQRGVEKFDPTKGYRFSTYAYWWIRQAITRAIAEKARTIRLPIHITEKLNKIKKAQRQLSQKLGRAPTAGELAQELELTPKQVREYLEKARLPLSLDLRLGDNYDTELGEMLEDPGASPEEFVMQSSLSYDLDRLMGDLTPQQREVITLRFGLTDGQALTLAKIGEILNISRERVRQIEREALTKLRKSKANMGEYLAS

SEQ ID NO: 17533 - protein, 254 aa, Nostoc punctiforme
MLSILRADFRIIFERDPAARNWLEVLFCYPGLQALLFHRLAHWLYTVGLPFIPRLISHLARFLTGIEIHPGAVIGKSVFIDHGMGVVIGETTIVGDYALIYQGVTLGGTGKECGKRHPTVGENVVVGAGAKVLGNIQIGNNVRIGAGSVVLRDVPSDCTVVGVPGRIMYRSGVRVSPLEHNNLPDSEAQVIRALVDRIEALEEQIQTLQRTNSSEKTPVLVGCLATKEDEPTHDPRWCNLKDKTIQQFLDGAGI

SEQ ID NO: 17534 - protein, 396 aa, Nostoc punctiforme
MDFSQVLAEKTDTIIDKWVTAVRKDRRIESADDLSYTAVKDHIPDVLQAMVTVLSKSQDSDIQSIVTASFQHGAIRAEQGFDPAEIAREYHLLRTVIFDAIHADLLKGTPVDIIRSMRLIDAIIDEAIARCFKSYVDERLRELQQLQLSLTLHNEELTRLMSANQEYLSQLAHELKHPLTSIIGYSDLFLRQQRRKTQIKDTSANLEHIERVLRNGRQLLHLINDVLELSRYEAGQIKLQLAPTDVSELINNICEMLEPLAVGKNLKVVVDCDRAPKELIIDPFQCQQIITNLISNAIRYTESGTIIIMCQVLENQRWAIAVSDTGIGIAPENQAQIFEPYFRVSFSDRPYLPDSTGLGLAIVSRLVKLLQGQINLVSEVGVGSTFTVIFPLQIES

SEQ ID NO: 17535 - protein, 667 aa, Nostoc punctiforme
MSSVSISDNSSKFSGNSRSLLKKRTLLFRYLAEINLIFGIWYLQWRVTHSINFDALWISIPLLIAEIYSYFGGVMFVIGLWRPLVRQVKSLDQMTPPLPRSDWPTVDVFVTCYNEPPKIVEETAKAALVMDYPPTKLRVYVLDDGNSADMRAMTERLCIEDLQSPQLQQEANRIDAEHSSLLQRLKELENLTPNTQGAEQWLQTSSSEPVVNQLATEFVQSLRQFILWLPPTHQSISDSPVETLRDRLTTERKALEETIRKKELELLELSRFRYIARPKTPGVAHHAKAGNINYAIFSGQTAGNFIVTLDADHIPKQNFLKRVVPYFYTYNLSTGRYDQNQIAFVQTRQDFYNIPPGDPFGHRANLFYGPLQQGKDGMNAAFYTGTNAILRREALVSVGLQNFADEFAKDEKRLDEFDLVGGVSSNSITEDMNTAMRLHSAGWKSIYHNELLAEGLAPDDLSSTLKQRLRWAQGTIQVLVRENPLTKSGLTFWQRLQYFKTMYSYFSGFATLVFISCPIIYFFTDIVPVKTYGSDFAIHFFPAFIINRLTFLAATWGIPATEVWRSEQYAIALFPLLIQAVWSVFTGQKLNFQVTPKQRQSGIYLRLVWPQLVIFILTILGILWSLYRFAIGHLNNPLVHLLNGAWAIYNLLLLSAIIRASVWQPPK

SEQ ID NO: 17536 - protein, 1235 aa, Nostoc punctiforme
MLSKLQSVKSLNCLVGRVYARMPLKYVLIVPFILQICGAVALVGYLSYQNGQKAVRELASQLENEICDRIEQHLNNYLTTPKQINQINLDAVELGMLNLSDFKTTGNYFWKQMQVFNVGYNSFANPKGEFIGIERLDNGKLLVNEVSQQHGIGKLYIYDSDLKGNRRQLQQVKDYDPRVEAWYADAVKAGKPVWSQIYQWEDKPEVLSISSSYPVYNKNHQLIGVISVDLILSQISNFLTKLNTEQSGKTFILERSGLIVASSTEPPYTIINGQIKRRSALESRNSLIRLTTQSLIERFGSLGFVVGKQQLIFSADGMRYFVQVKSWKDELGLDWLIVAVIPEGEFMEQINENTRITVLLCIVAFLVATRIGILTARWVIKPILQLNTSAKKIAQGEWEQTPEIQRSDELGELAESFETMAKQLQASFSVLEAKNAQMQVLNEALSESQSRLTQFLEAMPVGVFIIDAEGKPYYINHIGQQILDRGAMSKDKPFSTRGCANGFGGSQDARGLANATLTTGTAKTATPSPLRVYAEVSGEQLSEVYQAYLAGTDRLYPSDRLPILRALLGESTRIDDMEVRHIDKIIPIEVLGKPIYDESGNLTFAMATFFDITQRKQAENLLAEYNRTLEAQVKKRTEEFQQVIEQLQATQEELIQSQKIAAQEQQAAVREAARSAAANLAKSEFLANMSHELRTPLNAILGFTQVMSQDYSLSSEHQENLAIINRAGEHLLNLINDILEMSKIEAGRITLNRSSFDLIHLLNNLEEMLYLRAASKSLQLVFEYAHDIPQYIETDENKLFQVLLNLLGNAIKFTDIGGVTLRLRWEQEEENLSYNPRLFFEVQDTGCGITPQEIGLLFEAFEQTEIGRKSQQGTGLGLAISRKYVQLMGGDITVSSTPGMGSTFAFDIQIGLACPREMPINQIKSQILSLAPTEKAYRILVVDDAKESRLLLVKILTSLGFEVREATDGVEAVSNWESWQPHLIFMDMRMPIMDGYEATRIIKGKQVGYETANRLRRFPKFKQLTSSGSQYFNGGLSNSGDYEVLKTVYKASPTPEVAGVMEHNRDASGAAILRSPKALAPCFDLLETGQGCLNKHTIVIALTASAFEEERQKILSIGCDDFIRKPFTQEVLLEKLSQHLGVKYTNQVEKPNTAVAEQATQIFVSFAELLSHLSQMSPEWLQKIHYAAASCSDELILELIKQISSDNVQVSQVLRDLANNYQFEKIMELTRTNVE

SEQ ID NO: 17537 - protein, 422 aa, Nostoc punctiforme
MNSTTEKRIALISVHGDPAIEIGKEEAGGQNVYVRQVGEALAQLGWQVDMFTRKASLEQDSIVEHSDNCRTIRLKAGPLEFVPRDEIFEYLPEFVENFLKFQVKNEIQYELVHTNYWLSSWVGMQLKKIQGSKQVHTYHSLGAVKYNTIENIPLIASQRLAVEKQVLETAERIVATSPQEQQHMRSLVSTEGNIDIIPCGTDIQRFGSIGREAARAELEIAKDAKVVLYVGRFDQRKGIETLVRAVNESELRDSKNLKLIIGGGSTPGNSDGIERDRIEQIVHELGITDLTIFSGRLSQDILPTYYAAADVCVVPSHYEPFGLVAIEAMASGTPVVASDVGGLQFTVVNEQTGLLAPPQDVGAFASAIDRILFNPEWRDELGKAGRKRTESQFSWHGVATQLSELYTQLLEPSAKEPALLVK

SEQ ID NO: 17538 - protein, 437 aa, Nostoc punctiforme
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 17539 - protein, 455 aa, Nostoc punctiforme
MAIATINPATGETLKTFEALNDTEILAKLDLANQAFEKYRQTDFSERSQWLQKAADILEQDKAEFAKLMTLEMGKPFKAAIAEVEKCAVVCRYYAEHAPSFLADVSVKTDASQSFVRYQPMGAILAVMPWNFPFWQVFRFAAPALMAGNVGLLKHASNVPQCALAIEDIIRRAGFPEGAFQTLLIGAAKVADLMADDRVKAATLTGSEPAGISLAVAAGKQIKKTVLELGGSDPFIVLESADLETAVVTATTARMLNNGQSCIAAKRFIVAEAIADKFEKLLLEKFEALKVGDPMQSDTDLGPLATPGILQDLDQQVQAATKIGGKVLTGGHPLSDRPGNFYPPTIIIDIPPDTPIAKEEFFGPVALLFRVPDIDAAIKLANDSPFGLGASAWTKNDQECDRLIEEIEAGAVFINSMVKSDPRLPFGGTKRSGYGRELSIQGIHEFVNVKTVWVK

SEQ ID NO: 17540 - protein, 353 aa, Nostoc punctiforme
MQLKLSASRLPFAPLLLIAPFFLWGTAMVAMKGVIPHTTPLFMAGVRLIPAGMLILIAAAFMGKPQPKGWAAWLWIALFALIDGTLFQGFLAEGLVRTTAGLGSVMIDSQPLAVALLSLWLFQEHIGFWGWLGLGLGVTGISLIGLPDEWILHILDSGANITIGNWQDLFASGEWLMLLAALSMAVGTVLIRFVCRYADPVTATGWHMILGGLPLWGISSVLESQQWENLGGSDLVALSYATVFGSAIAYGLFFYFASSGSLTSLSSLTFLTPVFALLFGNLFLSEVLSPVQWVGVFLTLISIYLINQRDALGAQNDTITVGEIANIQPPVLDSSAKKLNPVSLAVRESEPEI

SEQ ID NO: 17541 - protein, 759 aa, Nostoc punctiforme
MLKDLRHSAFLEVQRGDSEIEEWLHVRQVEVETLANTSTVRSLNWSVAELYLKAEVKRINEFFFFQIATPDGSYSNTKVGRSNKNIQDRDYFQKAIAGKSDISDPFISRSTGIPLIAISTPIRSNSTSSTPIGAFQGNVRVDRIAEVVNSLHYGTSSYAFALNSQGQAIVHPNSALMSTVEKPAPSLLKIGDRNLNAIAQRMVNKQQGIELMEIDGTKQYVAYLPLQAANWSVALVIPRQNIESRLQFLDLIALIVGGLTLTMITVLWQVQAFEQRELKKSKAAADTANHAKSEFLANMSHELRTPLNGILGCAQILLRSPALPKQELYHVNIIEQCGSHLLTLINDILDLSKIEAKKLELYPDDVHFPSFLQGIVEICHIRAKQKGILFVYKPGINLPTGIHVDVKRLRQVLLNLLGNAIKFTDEGQVTFNIEVIDRAPNDVQIIKHRLRFTVEDTGIGITPVELSQIFLPFEQVGEKKRQAEGTGLGLAITRQLVQMMGSDIHVHSQIGQGSSFLFELEIPEATDWVQSAIATSEKQIIGFEGGPYTILMVDDRWENRTVITNLLQPLGFNVVEASNGKEGLEKAIALKPNLIVTDLLMPEMDGFELIKHLRHTPEIQDVLIIVSSASVFEADRNRSLQAGGNAFLSKPIQVDELLHQLEQYLNLVWIYKQSQPDGEKAKDGTTATAQLILPSPQVLQELVILASRGNFNGIIKWADQLEETDTTFAPFANELRQLARQFDEDLIINFLTKYAVETV

SEQ ID NO: 17542 - protein, 878 aa, Nostoc punctiforme
MPNVDKINSKLTDELAVLRQRVAELEQAEIFYQQRQVALEEQLRKLATSAQSSHISVLEYEIECHLEQEKSTGFNVTTDVAMTLEQFQQEIAQRQQLEVILKDSEERLRLALDVSQMGLWDWNILTNQVIWSENYELLFGLIPSSFDGPYETFQKCVYPEDKQSVMQGIGQALAQKTDYNDEFRIIRSDQSVHWISAKGKFIYDEQGQAVRMIGVCMETTVCKQAEESTRELTTQVQEQANILNAILTASVDHIYIFNRRGCYQYVSSDAASILGFQPQDIVGKTLQDLDLPTDLVEQVDNQLKAVIKTGQPIKDECKYVTADGVHYYEYIITALRNLNQSIEGVIIVSRDITEHKRAEKSLRESEARFRRLFESNLIGVAFWNVDGFVIDANDAFLQLAGYTHEEFTLLGKVNWQEFTPIEYKYLDDRAILEVQTTGVSKIYEKEYIHRNGKRVPIVLGIALLNDSQEHGVAFVLDITDRKLAEKECDRLLQCERTARQEAEIANQIKDEFLAVLSHELRTPLNPILGWSKMLRTRKFDQQTTNRALETIERNAKLQTQLIEDLLDVSRILQGKLNLNICPVNLVMVVEAALETVRLAAQAKSIQIQTIFDASLGQVMGDPNRLQQVVWNLLSNAVKFTPTGGRVGIRLMEASNQIQIQVSDTGKGINPDFLPYVFDYFRQADGTTTRTFGGLGLGLAIVRKVVEMHGGKVQAESPGDGLGATFTVEVPLLVRSEQVRREENESLDSQPESSLLSDTQILVVDDEPDIRDLVSFILQDYGVQVTAVSSAQEALQALSESIPDVLISDIGMPRTDGYMLIREVRSRSPQEGGRVPAIALTAYAGEMNQQQALAAGFQMHISKPVDPDVLVKAIVDLIQ

SEQ ID NO: 17543 - protein, 853 aa, Nostoc punctiforme
MKAGQIDTEMARLEALRQYQILDTEPEEAYDNLAQLAAFICGTSISLVNFIDENRQWFKAKVGLDVSEMPRCVGLSYLCQERRNVVVVPDTLADEELANNPVVTGYPYIRFYAGVPLITPKGHMLGTLCVIDQVPKELSQKQVEALVALSRLVIDQLELRRYVTEVSEVTEKLMAQEQAARVQSEAARTRINNLLESITDGFFALDKKSRFTYINGQAERLLRKKQNELLGKNIWEVFPEIIGTTFYREYHRAILEQVSVEFEEFYPPLNCWLQVHAYPAKDGLSIYFQDITERRRTVEALRESEERWQLALHGNNDGIWDWNLKTNEVFLSARWKEMLGYKDHEVSNGWDEWKKRIHPDEQDWVLQAFQDHFAKKTPFYVCEYRVQCQDGSYKWILDRGQALWDALGDIVRMVGSYTDITDRKQADEELKRQNLRSQLFAEITLKIRESLQIDEILQTTVTEVQKLLQADRVLIFRLEADGSGTVVQEAVLPGWPVILRKNLFDPCFKEEYIERYRQGRVSAMEDIETAHIQPCHREFLQQFAVRANLIVPILVRDRIWGLLLAHHCAAPRKWNNFETELLKQLANQIGIALSQAELLEKETQQSQELARSNAELEQFAYVASHDLQEPLRMVTSYLQLLERRYKNQLDANADQFITYAVDGARRMQTLINDLLNYSRVSTRGQPFKLVDCDVILQQAIANLQIAIADSKAIVTHEPLPEVMADTTQLTQVFQNLIGNAIKFCQNQQPQIHIGVAKANANLDGESLNSIPLADEWLFSIRDNGIGLESQYAERIFIIFQRLHGRDKYPGTGIGLAICKKIIERHGGRIWVESKPGQGSTFYFTIPDRAGKQS

SEQ ID NO: 17544 - protein, 389 aa, Nostoc punctiforme
MNQANNVLESIYQPDLEIMNQPELELEELLIDDEEDLLIIDEGDDEFLEPQSDEDDAKSGKAAKSRRRTQSKKKHYTEDSIRLYLQEIGRIRLLRADEEIELARKIADLLELERVRERLSEQLDRDPRDSEWAEAVQLPLPAFRYRLHVGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVTRERIRQIEAKALRKLRHPNRNSVLKEYIR

SEQ ID NO: 17545 - protein, 517 aa, Nostoc punctiforme
MDVTELVKVSIILLLLATGVALLSRRLRIPYVTGLVLAGLPITELLSRPIGLNPTLVLNLFLPILIFEAGINTDVSRLRSTFKPIALLAGPGAVLSSGIIAALLKFGLGLSWIPALFVGVILANTDTVSMIAVFKEIPVPSRLSTIVEGETLFNDAAALVSFNLILQVYSTGSLTFVEGIQQLLFISLGGCLVGLVLGYLSIPVFARLDDALSSLLLTVAVALGTFQVGQFLGVSGAVAVVVAGLIFGNLGLSQNTSASSRITLLSFWEYASFTVNTFIFLLIGVEIDLVTLWRTLPAIIFAVLAYQVGRVLTVYPLLAGIRLIDRPIPLRWQHLLFLGNIKGSLSMALALSLPETLPGRDVLIALVFGSVLVSLVGQGLSLPWVVKRLQLSKFSEVQQQVEELQAQLMTGKAAQDELDSLLKSGVLPKAVYEEMRSAYQVRIAGAEKTLRELYNRRPDDVNGKSNSSGKLDAIRRRLLLAEKGALNEAMRKRILSEEIVRGRIQNLDEQLLKLDDD

SEQ ID NO: 17546 - protein, 515 aa, Nostoc punctiforme
MVVESAIAEEVITNNLKQFLLVLSVSLGVATLPQVFSWFRNIPYTLLLVIVGLGLAFVDVRLVTLSPELILFIFLPPLLFEAAWNLKWSELKRDLVPICLYAVFGVVIAIAGVAIALNQFIGISLTTALLIAASLSATDPVSVTALFRQLGVGSRLTTLMEGESLFNDGMAVVAFSFVVALSLGTVELEFQPILLQLFTVVGIGVGVGAFIGFGISYLTQRFDLPLVEQSLTLVSAYGTYLIIEDLGGSGVIGVVTTGLILGNFGSRIGMNPRTRIIVSEFWEFLAFFVNSIVFLLIGDQIRFASLGENLQIIIVTVIAMILMRAVALLILSKLSTSITRSDISLPEQTILWWGGLRGSVSIALALSVSTILPEREKIIATVFGVVLFTLLVQGLSIKPLLEKLNLLGDAPLREEYLELVARHIALERVLQHLQADKRPGIDPEFRRYQETLIKSELADLRTKIDNLQDEYPNLQSFTTEQFRGELLAIEADTYAEFVKSGRLNKELASMLEDVL

SEQ ID NO: 17547 - protein, 429 aa, Nostoc punctiforme
MSKFLDTAIEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 17548 - protein, 312 aa, Nostoc punctiforme
MANEKDGGNKCPIQYSITKKKPMAKSKEKKEQTLQPPQQQEVPGVESEMTPKPKADDAQYRGSGKLQDKVALITGADSGIGRAVAIAFAKEGADVAILYLNEHDDAKETKHLVEKQGRRAVTIAGDIGDETFCQQAIQQTVGEFGKLDILINNAAEQHPKQSIEEITKEQLERTFRTNIFSMFFMTKAALKHLQTGSAIINTTSVTAYKGSPQLLDYSSTKGAIVAFTRSLSQNLVSKGIRVNAVAPGPIWTPLIPSTFPEEKVESFGKQVPMQRAGQPEEVAPSYVFLASDDASYVSGQVLHVNGGEVVNG

SEQ ID NO: 17549 - protein, 669 aa, Nostoc punctiforme
MSISTSVLSDLLKSLPYLRPQLYFKASLTALSHAMEDQVLAATLAQPLVIASFQRERFYRQEAHRYLRLALRSNQIYVLAAPETDFANSSENYEKIAFEPTDGLSQEWHLVVIADNYATCLVCRESLGSIAKNKQLPELSPNLDIDTARRFEGVWTSERGVSLKAAELLLDRILVYRPELASKINEARQRFSIGEPRSHSGAEQINEYACDIDTDPFVQRLVTYLQASQYKLHKAYRSIAAQARKERLVNSISTAIRRSLDPHEVLQVAAQELGEHLEACRCLIYRAQATDSQAIIEHEFLNPGILSVRGQTWELEKNSLFRDIVQQGEGVCISDTLNDPRVNNSPGLSLIAKKFAIRSWLMEPVFYQGRLLGIVELHYCKMPPHECQPGELDLVEAIATQVGAALIQAEAYANLEELNQQLEALDRTRSNLIAITGHELRTPLSTIQVCLESLASEPDMPLELQQIMLNTALSDSERMRKLVQDFLTLSNLESGRVQWHPESLTLQECVDLALSRNRTRSATEKPPQIKTKIAENLPLVRADGDWLVEVLAKLMDNACKFTPPEGEITIKAFSNSHQMVEVTVADTGRGIEPNRLEVVFDRFYQEEGALRRTTGGTGLGLAICRQIVNGWGGEIWAESTGKDQGSQFHFTIPIVQNSHEEKRTKVKSK

SEQ ID NO: 17550 - protein, 252 aa, Nostoc punctiforme
MRMSSQLYGKVALVTGASSGIGKATAIAFARAGAKVVAASRRTTEGEETAHYIQEIGGEAIFIKTDVSKAADVETLIEKTIDIYGRLDCACNNAGLGGAASPIADMSEKDWDQLVDVNLKGTWLCLKYQIRAMLKQGSGAIVNIASAAGVVGFPGFTGYCATKGGVIALSRAAAMEYAKAGIRINVVSPGAIATDMLATLPTDVLAQLTAMHPIGRIAKPEEVAESVVWLCSDGSSFLVGHNMMVDGGYTAQ

SEQ ID NO: 17551 - protein, 719 aa, Nostoc punctiforme
MVCRCKVRHSMTNSRQSSFRRILVTRILLLFVPVLLIGEIVALNKARSSILATARQNLTESAISKGEKIGDAIAILKASLLSVSKTTVIASGSPIQEQEILTQLKQQLPANIDCIQLTDLLNQKIIASSCGDQAIEKLTFPLPSDGIDVKTIFPPKAGMTGKRNAQNQLQLVLSAPVSDSRKNLVYSLSIQSALYQQTRNPPGSLTGVMVVIAEDGTILAHPFTDWVGTNINQHPNASQLKSIIKNALAGRNDSINLSFKEGNELVAGYTAIANPLTQQQQQKWIVLAVTSVDNALFGLEEIKLILIVLTVGLIGASLLASLYLAPYLARPVEELRDYALNIHSHHAAQPVPHNFQIREFNQLAQALDQMVERLKAGAEELEIAWKEAKNANQIKSQFLATTSHELRNPLHTIINCIRVVEDGLCDSREEEMEFLKRANETTIHLLNIINDLLDISKIEAGKLSVVITPLDLRQILLEVINLQSVNVQQKGLQLKCELDPQPIPIKADAAKLKQVLINVIGNATKFTDTGSITIATEIQSSNGKSQVVVIVTDTGIGIDPNQQHKLFRPFVMVNGTTTRQFEGTGLGLAISRNLIELMGGSITLESTGLHQGTTLKITLPLIDVSLLPVDNKKENVANVGLSSENKGAKASQYSSLQQSVGSPSLGSSKSVKVGVDKEKSMKFQVLLGNETYEISFSPQQTILVSIPKTEVYANGTSER

SEQ ID NO: 17552 - protein, 909 aa, Nostoc punctiforme
MRITTKCIGSSAIVLGLVASTQIGGDLFIRQAEQKAQDTQAKNTQALTTILQINVSLNNEVAALKDMILLRRDASNLVKYQEALSGFTKNLAELKNLKPEINSELVKISDRHSLLANLIIELTNQSNTEKPLELAESQQDFRVINAFSRDIELYLKLLTQKLQQQDSFAKQEFNNFKQTTQLARQILLLSILVVFVGQLLLILLPVIRSIQKLQQGAAKIGDGNLEYRLNIQTEDEIQELAEAFNRMAGTLAESYRSLELKKELADTANRAKSEFLANMSHELRTPLNGILGYAQILQRDKTLTDKQQDGLRIIHQCGSHLLTLINDILDLSKIEAQRMELYKSDFHFPAFLQSVVEICRIRADQKGISFIYQPTSELPIGVWADEKRLRQVLINLLGNAIKFTEKGGVRFTISSVDQLLTNESNQKPIHKIRFQIIDTGIGMSQEQVAKIFLPFEQVGEVKKQSEGTGLGLAISQRIVQLMDSTIQVKSEIGQGSTFWIDLDLQESVDWMQSARVISAGKIVGIATGKRRILIVDDRWENRSVVMNLLDEIGFEIIEASDGQEGLDKAMQFLPDLIITDLTMPVMDGFELTRRLRQQQEFQDLTIIVSSASVFESDQHKSLGVGADDFLPKPVHADDLLQKLEKYLQLEWVYETVPEKSVNETQNTIHSPSSSVVTAESTIVGITGNKRKILIVDDNLENRSIVVNLLGDLGFEITEAINGQDGLDKAVELKPDLIITDLSMPVMNGLEMIRQLRVLPFENLPIIVSSASVFESDQHESLEGGGNDFLPKPVQANELFQKLQKHLQFEWIYDVIQSQEGVKENQNLKVTSADSLVSDTCLISPPPEEIEKLFELAMRGNIKGIREQAQKLKLLDDKFILFAEQLEQLAKSFQIEKIREFIQQYRGEEQ

SEQ ID NO: 17553 - protein, 498 aa, Nostoc punctiforme
MTTPLSCRNYINGQWLNAVGEATLESRNPADKTEIVATYPRSQVNDVDTAVASARKAYRSWRTVPAPARAEYIFRVGEILLQHKEELAQLISREMGKPLTEARGDVQEGIDCAFYSAGEGRRLFGQTTPSEMSNKFAMTVRMPIGVCALITPWNFPVAIPCWKAMPALVCGNTVILKPAEDTSACATKLIEIFQQAGLPPGVINLVHGVGEEAGKALVEHPNVDLVSFTGSSETGAFVGATCGRTHKRVCLEMGGKNAQIVMEDADLELALDGAVWGAFGTTGQRCTATSRLILHRDIKEKFTTMLYERTSKLRLGAGNDTDTDIGPIINEKQLQQVSKYLDIAREEGAKVLIGGEIASEGSLKNGYFFQPTILDRVTPDMRVAREEIFGPVVALIEVSSFEEAIAILNDSNYGLSSSVYTRDINRAFTAMRDIEAGITYINGPTIGAEVHLPFGGVKQTGNGHREAGTTALDVFTEWKSVYVDFSGSLQRAQIDNRS

SEQ ID NO: 17554 - protein, 262 aa, Nostoc punctiforme
MDLQLRGKVALITAASKGLGKATARQFAREGAKVAICARSESIDTTAAEIASETGTEVLSLRADVTSQADIERVINTTVERFGGLDILVTNAGGPPAGTFDDIDLATWETSINLTLLSAVRLVKFALPHLRQSTTPAILTITSTSTKQPVENLVLSNSIRLAVIGLTKTLSQELGSDKIRVNSILPGWTYTERVEELINARIAKSGETKEAEIARVSATVPLGRIGTPEEFANVAVFLSSPAASFVNGVMLEVDGGAIQGTF

SEQ ID NO: 17555 - protein, 727 aa, Nostoc punctiforme
MYLIKRRHFIQFASSTFATLGLSQIDIMQKGNRYAQVLSQSTPRKLALLVGINNYLNNERGDNLRGCITDVDLQEKLLTHRFGFEPNNILKLTSDPADKQPTRKNILEAFEEHLIKQAKPGDVVVFHFSGHGSRLPDPDPIQQCRNDNYNSTLVPSDDGANGVTQDIMGRTLFLLISALKTENVTVVLDSCFSGGGTRGNFIVRAASNDNLQPSPEEIAYQEHWIKQLNIPLEKLISLRCASERKGIVFAAAKREQIAADATFDGFSAGAFTYLMTQYLWQQTGSAGSMISQITSSIKSLSRQEPLIDGDENKPVYFIKNKVFPTDAVVIKSEGKKATLWLGGIDKESLEAFTPGATFTVINNQGQTSATVKLISPRRGLIAEAELVDNRGINSLRPGMLLQESTRVIPADLKLSIGLDPSLAGDTNAAKEFVEAINRIAAITAQNQKPPYPNGVQYIFSRMTDSYRRQLQQQVTENLPVVNSLGLFTAGQELVLQSFGDAREAVKDAVQRLEPKLKSLLATRILKKTLNTNSSELDVEVCLNLVEQPSKIIAKTATSRSQKNRQVSQKIYSHKLPLQQLFQFQVTNNESTSVYISILLFDSSGDLLVIFPYKWSAPEESMQLAPQQTLVVGNPQELKLQAIEKGSGEALIIVSRKPLKNAVKTMRALAAEQKRDAGVVELKGSSTSPDEVIGDLLNDLRDVRGGGIVATPVSNSDMATLSIAFEVN

SEQ ID NO: 17556 - protein, 401 aa, Nostoc punctiforme
MTNPKLNRVLIGVGGGIAAYKICELVSTLFKTGVEVRVILTRSAQEFITPLTIATLSRHPAYTDDDFWKPTHSRPLHIGLGEWADVMVIAPLTANTLAKLAYGMADNLLTNTVLASTCPVLLAPAMNTDMWEQLSVQRNWQQLLLDSRYHGMNTASGLLACDRIGAGRLAEPPEILAHIQSLLHTQGKRDLAGKRVLISAGGTREFLDPVRFIGNPSTGKMGLALAQAALHRGANVTLVHGPANWDVPLGVQAIPVVSAEQMQQAMLEYLPNADVIVMSAAVADVKPRDYSTEKLPKRSLPQALPLEPVPDIVAQLAQHKQPYQILIGFAAQTGNIVKPALEKLQSKKLDAIVANPIDQPDSGFGSDNNQAIFLDRQGNQVAIAPCSKLEMAHYLFDFAIT

SEQ ID NO: 17557 - protein, 266 aa, Nostoc punctiforme
MSLELKLLGKTAIVTGGSAGIGLATAKALYSEGVNVAIAARNQERLENAVAAIQSLPTSGAKVIAISADLTKAEDVEKVVSTTLAQFNQIDILINNAGSARAGSFLESTDDLFLDAWNLKLLGYIRLVRAVVPHQKSRGDGRIVNIVGGAGRTPRPNFLAGGTSNAALLNFTKGISKELAEYKIRINAISPGATATERAETLALQNAQAQGITVEQVKAQNIQSIPLKRIAQPEEIAALALFLVSDLAASITGTEIIVDGGSTPGI

SEQ ID NO: 17558 - protein, 911 aa, Nostoc punctiforme
MYKPADQRSRGVVLTTIRTGRESGLMNKNIGQNGVFPLFKGVPLRRILVALFVLQIFLAVGLTAYLSIRNGQKAVNEVASELRYEVANRVEQNLQAYLSTPRQVLRGNQNIIDIGLLKMENLATWESYLIKQLEIFPDAVALTASNEQQEHLAVEKLNDRQYLLRKADKSTGYDLYTYKIDRQGQRTQLPEVIKNYDARSRPNYQAAVTAKKFSFSQIFTPITKPTLLISASQPIYNSQGELLGVNSTLTHVSQIGDLLQNIKVGKSGQVFIIERSGLLVASSTTEEPFRLQNGKPIRLAASQSGNAFTQASAKYLETKFSNFDQIQSLQQLDFSFDGKRQFLEIRPLQGEPNVNWLIVVAVPEADFMGQIDRNTQTTIFLCLGALGLATLLGIITARWITQPILYFSTATKDLADFTKGEDSVVIVPGIKEVEILGESFNEMMQHLRKTFTAQITKNEELELQVKQRTQELQQEIQKSINSEQKLEKHNRALAELANHRTISEGNLETAFKVITEKAANALEVERVSVWLFNSDADGRLRQRTKLQCISLYERSNQKHSAGLERDRADYPIYFKSLTSARIIAVTDTRTDLRIQELWDELLETKNIVSLINTSIWVGGEVVGTILSEQIDIPRTWEVSEQNFVSSIAEFVALTLEVCDRKSAESALREAKEAAEVANRAKKTFLVNMSHELRTPLSSILEIAEALQNEVYGTVTEEQRQFLNTLESSGKNLLELINQILELTDIESSKIELQLAATFIPELCDSSLSFVKNLALQKNIQLSVQIPEELEPIQVDERRIRQVFINLLSNAIKFTHDGGKVWIEVQPNSTNEYIFFSVVDTGIGMLSDDLFRLFQPFIQVENASTRRSAGTGLGLVMVQKIVELHGGTVHAESQLGKGSRFTVKLPWKKVGE

SEQ ID NO: 17559 - protein, 465 aa, Nostoc punctiforme
MVSTHPTGVQHSGSQYLPQRRDTNPNLSPNQELLPLTARVHNHDSLEIGGCDVTTLVKQFGSPLYILDEETLRSACQQYRDAFKQYYKGESQVLYASKAWNCLAVCAIAASEGLGIDVVSGGELYTALQAGVSPEKIYLHGNNKSREELILAIESGVTIVADNWYELRTLVEIAQPGQSIRIMLRLTPGIECHTHEYIRTGHLDSKFGFDPNDLDEVFTFVSQQSTLDCVGVHAHIGSQIFERQPHQDLAAVMVQWLRDAGKYGLNITELNVGGGLGIKYTESDDPPSIEEWVKAICEVVQEACAVENLPLPKLLSEPGRSLIATACVTAYTVGSSKVIPEIRTYVAIDGGMSDNPRPITYQSVYRAVVANKMSSPVTQTVTIAGKHCESGDILIKNALLPKTEPGDILVVMGTGAYNYSMASNYNRLPRPAAVVVANGEANLILQRETYQDLIRQDSLPERLKI

SEQ ID NO: 17560 - protein, 332 aa, Nostoc punctiforme
MNNLSHQYLEESNKKEKLLYTADTVRAYLREIGRIPLLTHEQEINFAKQVQKMMALLATKEKLAIQLKRQPTQKEWIENINIGEKSLLQQLHQGQKAKQKMIQANLRLVVSIAKKYQRHNLDFLDLIQEGSLGLERGVEKFDPTKGYKFSTYGYWWIRQAITRAIAEQGRTIRLPIHITEKLNKIKRIQRELTQKLGRTPTAVDIAEELSLDPKQIRDYLLLARQPVSLELRVGSDKDIELQDMLEDNGLSPELYADHKFLQQNIQNLLSKLNPQQRQILTFRFGLTDGNELSLAEIGQRMGISRERVRQIEQQALGSLRRHKDKIHSYLAS

SEQ ID NO: 17561 - protein, 293 aa, Nostoc punctiforme
MSSLSSDMVRIYLQEIGQYPLLKPEEEIAYGRQVQQMIAIEQSKNELIQQLDREPTMTELANAVAQTETQVRAALHLGQKAKQKMVTANLRLVVSVAKKYQNRNLEFLDLIQEGAIGLQRGIEKFDPNRGYKLSTYAYWWISQAITRAIAEQSRTIRLPVHLTEILNKIKKVQRESFLKLGHHATAEEIAASLNISPDKLREYLSASRTAISLNKKVGDEQETELGEILTDVGVLPEKLLTQELLSQDVVKLLEPLTPIQRQVLTLSFGLENDRHFNLAQIGVNIAKLSPGAR

SEQ ID NO: 17562 - protein, 387 aa, Nostoc punctiforme
MEIQLGRGKTARRAYGIDEIALVPGNRTLDPSLADTKWRIGNIEREIPIIASAMDGVVDVRMAVRLSQLGALGVLNLEGIHTRYVDPEPILDRIASVGKDEFVALMQELYAEPIKPELIEKRIQEIKEQGGIAAVSATPAGASKYGEAVAKAGADLFFVQATVVSTAHLSPESVIPLDLAEFCRSMPIPVVLGNCVTYDVTLNLLKAGAAGVLVGIGPGAACTSRGVLGVGVPQATAIADCAAARDDYYKETGNYIPIIADGGLITGGDICKCIACGADGVMIGSPFARAAEAPGRGYHWGMATPSPVLPRGTRIRVATTGSLEQILIGPAGLDDGTHNLLGALKTSMGTLGAKNIKEMQQVEVVIAPSLLTEGKVYQKAQQLGMGK

SEQ ID NO: 17563 - protein, 491 aa, Nostoc punctiforme
MQVCTSIIYQPKFDMHTIEKKSTTKAWAGAIVQPAKEFPSTQLPIISGKIPDGLRGTLYRNGPARLGRGGIHMGHWFDGDGAILAVNFTDAVATGVYRYVQTSGYQEEAAAGKLLYGNYGMTAPGPIWNQWQKPIKNAANTSVLALPDKLLALWEGGKPHALDLQTLETWGEDHLGGLTKGLNYSAHYKRDKQTGEIFNFGISPGQNATLNIYKSDSTGRIIKQAAYQLDGVPLVHDFVLAGQYLVFFIPPVRLNVLPLLIGINNYSDSLEWQPRLGTQILVIDRETLSVVSRGETEPWFQWHFGNGYVDASGSVIVDIARFEDFQTNQYLKEVATGETHTPAKSTLTRVHLHPQTGKVTSIQQLFNGHCEFPNVPQQNVGQASRYTYMSTSRSGTDISQEILNAIARFDNKTETLTEADFGENRYPSEPIHAQNTQNPAQSWVLTVVYDANSHTSEVWIFDSDRLDAEPVCKLGLPSVIPHSFHGTWNPA

SEQ ID NO: 17564 - protein, 126 aa, Nostoc punctiforme
MYEIMFQNHPEVKEQFSMAAQADGSQPARLATAVYSYANQIDNLPALKSMVEKIAHRHVQTHVTPEQYPIVGESLLQAMKDVLGEAATEEVMAAWTEAYQALSEVFIHREHDIYVGEDKKAQLLHS

SEQ ID NO: 17565 - protein, 100 aa, Nostoc punctiforme
MSIYVGNLSYEVKEEDLRHVFAEYGTVKNVQLPIDRETGRMRGFGFVEMESDAQETAAIEALDNAEWMGRSLKVNKAKPKTDGGSSGGRRGGDGGSSRRY

SEQ ID NO: 17566 - protein, 277 aa, Nostoc punctiforme
MRIYHLNCGCMCPIGGALFDGFSRGLTACLVCHCLLIETNQGLVLIDTGFGQRDMKAPLSRLSPFFMNLNRIKFEEKYTAVAAIEQLGLNPRDVRHIVLTHLDFDHAGGLEDFPEATVHVMLSEIEAARERQGFVSSQRYRPGQWDEVKNWKYYSAGGEPWFGFEAVRNLEGLPPEILLIPLVGHTLGHAGVAIETSEGWLLHAGDAYFYRQEIGSPKRVCTPGLRAYQWFMEVDRKARLSNQDKLRALSLDHSSEVRLFCSHDAIEFKTFSDQDNL

SEQ ID NO: 17567 - protein, 1080 aa, Nostoc punctiforme
MEQMRLCEADPPLESQSFPAVNTQEGGDAASPSEEAFFFERSLDLLSVIGLDGYFKRINPVFSQTLGYSEAEFLASPFLDLVHPDDHSATLREMEKLNTGLPTLYFENRYRTKNGCYRWLAWTASPQIDRGVMYCVARDMTQQKETEAALQRANQELEQRVAERTAQLEQVNTALRESEERNQLAMEVAWMFTFEWEPNLDTIERSPQSASILGLKSPSAQQDTGTSYFQRVHPDDRDRFLAGLQALAPENSTYKITYRFVRPDGQIVILEESGRALFDGQGQLTRIIGMTADVTERQQLEAELQESRATLHRQLTEIETIYQSAPIGLNVLDTDLRFVRINQRLAEINGFSVEEHIGRTIRELLPNIADTVEELLCAILETGEPLLNVEIRGETPARPGVQRVWLESFLPLKDGDRVIGINTVCEDITEQIQVEEALRQSEERFRSMADNALVMVWVTDATGYCTYLSQSWYEFTGQTEATGLGFGWLDALHPEDCAFARETFVSSNTRHEAFRAEYRLRRRDGEYRWAIDAASPWFGADRQYKGYIGSVIDITDRKQAEEALRESEDRLRMAITSAQLGTWDWNLITGELRWDTGCKAMFGLSPDGESSIELFFEGLHPDDRDRLQEIVQAALNPVLGGFYDTEYRTIGIEDKVERWLRAKGQAYYDAKGKPLRFSGTVLNITEQKQAEAQREQLLRQEQAAREAAERANRMKDEFLAVLSHELRTPLNPILGWAKLLQSPLVSSDKLQQGLSAIERNAKQQVQLVEDLLDISRIIRGKLTLSFGAIDLSEPIAAALETVRLAAEAKAIQLEVLLDPSVGQVRGDADRLQQVVWNLLSNAIKFNSTGGWVTVQLTSVDRHAQIQVSDTGKGIQPEFLPHVFELFQQQDSSSTRSFGGLGLGLAIARQVVEAHGGTITAVSAGEGLGATFTVQLPLMPVPSPDAPDYLNNQTLNLENLRAIVVDDEADSLELVKVVLEQEGATVRAVSSATEALRLLTQSQFDLLISDIGMPEMDGYTFIRQVRALPPQFNRDIPAIALTAYVGEMNRHKILVAGFQAHLAKPLYPQRLLDAIATVITP

SEQ ID NO: 17568 - protein, 805 aa, Nostoc punctiforme
MYELVQAVFNGDEKTALHQLIYTLSASGKRYLLRNEILQAFADYCHESQKPAYFYHSSSIGKLIQYTHEIIIEEESTWFVIRPKIANQEVWRLTANLDSFEQMTQQALLDVRDRLVNRYQPGILEIDLHPFYEDSPRIDDPRNIGQGLAYLNRYLCNQLLTDPEYWVEMLFQALQGLQHDGIRLLLSDRIPSGIHLAKQIKLALKLVNERSPHEPYEKFSLDLQELGFEPGWGNTAARVSETLELLDRLIYSPEPGILEAFVARVPAVFRVVLISIHGWVGQEDVVGRDETLSQVIYVLEQARSLENELREQIKLAGLDQLGIKPHVIILTRLIPNCEGTFCYLPLEKVQDTENAWILRVPFGEFNPEITNNWISKFEIWPYLEQFAIDAEKELLTQFKGKPNLLVGNYSDGNLVASLLSRRMKVTQCNIAHSLEKPKYLFSNLYWQDLENQYHFSAQFTADLISMNAADFIITSSYQEIVGTPDTIGQYESYKCFTMPQLYHVVDGIDLFSPKFNLVPPGVNESIFFPYSQKENRDSNLCTEIHNLLFSREDPQILGHLDRPNKRPIFSVSSISSIKNLAGLAECFGQSQRLQEHCNLILLSSKLHPDEATNPEEAEEIQKLHNIIDRYHLHSKIRWLGMRIPSSSLGEAYRVVADCQGISVHFARFESFGRSILEAMISGLPTFATQFGGSLEIIENQEEEFNVNPTDLVETAKKILDFFEKCNTHPEHWQEVSEWMSQRVHNRYNWHLYSNQLLLLAKMFTFWNFVAPENNEARDRYMETLFHLIYKPRAEKILEKHMGANS

SEQ ID NO: 17569 - protein, 1871 aa, Nostoc punctiforme
MMSAKQLEQVKQLQATLTKMEVTLRAIADAVVWVGEDRRIQWCNSHFEFLVNQPHGNICGAKLTDLLPLAQAEQPAYPDVQILNGEYETANYQYQQGERTLTLQISGSCTELTQDRCAILVIRDITLTKQTQESLQEIEERLQTLINATPDIICLKDGEGKWLLSNQANLEFLEIQGVDYQGKTDSELAEFSNFYHDALLNCNETDEQAWQLGCVHRVEEIIPRPDGTVSSVDMIKAPLFHQDGRRKALVVLGRDLSDVYRQATQRKQTQVALENSLSLLSAIFESIQDGILVVDTLSNITTHNQKFLEMWSIPPELLTEPDHPQRLGYLANQLKDPDGFLQRVRELYSQPEVVSYDCLELQDGRIFERYSCPQRIGEQIIGRVWTFRDITQRQRSEEALRQSELQYRTIFEAINDGLFITDIESEKVAEVNPAAYQMHGYSYEEFLTLHPSVYIHPSSHSVFLEFLETTRSGEQFYGQAVDICKDGTLIDVEVKGTTCIYNGKPHILAVVRDISDRKRTEEALRQSEVQYRDLVQTANCIILRWDSNGDIIFLNDYGQRLFGFDLDEIIERNVIGTIVPETETSGRDLQTLMVDICKHPENYLFNENENLCKNGDRVWIVWANKPILDAQGNLIEILSVGTDATERKRAQAALQQSELKFRSIVENANDLIFVLNLDGIFTYHSPNVTSIMGYSLEEIEGHSVVEFTKPEDLATSAAALQRAATGEKLTDIEVRLRHKNGNWRWFNFNTSTINSESGTVAILGVGRDITERKQAEEALRRSEMKYRNIFENSQVGIFRTRQQDGLIIEANQRGADILGFASAADLIGKFFTTDLYANPDDRTRMLAELEKDGEVRNFEVALQRLDGSVVWLLLSLRLNAEESCLDSVFTDISDRKQQEQALRLIVEGTAAKTGNEFFNSCVRYLAEVLQVQYALVTEFHDERKTKVRTLAFWSCGAINENLEYHLHGTPCQHTLEGNMCHYPQRVQAAFPEDADLVRMNAESFFGVPLTSSSGEIIGHLAVIDVKPMKHDPGRELIIKIFAARAGAELERKQAEAALQESELKFRTIVEKVNDVLFVISADGAFNYISPNILKTTGFAPSEIEGNSLALFTHPDDVPKCVEVAQTVLETGEGISDTEFRGRHRNGGWVWQTANIARTQDAQGNFQIVGVARDISDRKQAEAALQRRTQAESLLSSISRQFIDQNLETAINFTLQAIAQFISAEHSCIFELSEDQRRFDLIHEWCGENVEPLIDLAKGSPIESFPYFYTPIVRGNHIQIPSVADLPPDTAERKLFEGMSFQSVAAVPMLHSGKVVGFVGTAMIHLCKAWSQEDINLLKLVGEIIAIGRARHQAEEALRIAKEAAETANQAKSAFLANMSHELRTPLNAILGFSQLMERDTSLNSNQRESLATINRSGEHLLNLINDVLEMSKIEAGQIIFTPEDFDLYLLLQTLQEMFQVKAQTKQLFLKFEIAPNLPRYIQTDEGKLRQVLINLLGNAVKFTQTGGVTLRVRLGSEQGAGETGEEELLSPAQCPMPNAPCPIPNPQSPIPNARFLHFEVEDTGRGIAPEEMNNLFQPFVQTTSGIQTKEGTGLGLTISRQFVRLLGGDIYLTSTPRQGSTFSFDIQVNLAAALKVSPRLNKGRVIALAPGQPSYRILVVDDRKENRDLIVQLLGSIGFEIEAANNGQDAIAMWQTWQPHLIWMDMRMPVMNGYDATKEIRIRERNTNTNHRTVIIALTASAFEEQQASILAAGCNDLVRKPFREQVIFEKIAEYLQVRYICTEESSEDATDNNLKNIQFSILDLRSAITIMPAQWVTELNQAAVEVDAERIFQLIEQIPPTHSPLAEKLTNLVRSFCFDEIIDVTEENCN

SEQ ID NO: 17570 - protein, 835 aa, Nostoc punctiforme
MRQENTAMTQSASFLKTVATSLGTATFFALAISGVAFWSANQTLETNRQIAQHLETLNRLESLRSALKDTEKMQRQYLLTGKEDALIVFGLKMIDVDQQMRRLQPLLRNKDSEQAYAQKLEELTIFRLKQLRQGIELRQSRGIDAAIDHAPMRLLDETTLLMQQIEAIETVGLQQKQLATISTTSQAMVTFLVGIGLNLAIILWTYYLICKETMKRNQAETDLQQNNLTLQEQTNLMQLILNSMSDGVIVSDDKGKFLIVNPAAEQMFGGITESQQSEWSEQYGLFQADRVTLFPTQEIPLVRTLRGEQVQNVEMFTRHSKAPEGIWITVSGTPLKDASGTLKGGVVVCRDITERKSAELKILQAKEAAEVANHAKSEFLANMNHELRTPLNGILGYAQILQRDPATTSKQQKGLSVIHQCGSHLLTLINDILDLSKLEVQKMDLYPQDFHFANFLTTTVEICRIKAEQKGIAFRYHPANLPTAVHADDKRLRQVLLNLLSNAIKFTDFGSVKFTVEAISNEETADTRSTRIRFLVEDTGIGIPTEKWQTIFLPFEQAGKRDRNSEGTGLGLAISQQIVQMMGSSIQVNSTPGKGSKFWFEVDILAAADWLAQPASSNLKVIGYQGERRKILVIDDRLENRAVVMGMLAPLGFKLAQADDGQTGLDLALQMRPDLIITDVMMSKMNGLEMTRRLRQLSDFAVTPIIASPASLSQVDIQEALDAGCSSFFPKPLEFIGLLGELQRHLELQWIYETAPQTEEVSAEDFSSPQLVVPSPQELTTLYRAAQDGFMSDIHQEANRLKQLNPQYAPFANKLLELSQKFDDEAILNLLAPHI

SEQ ID NO: 17571 - protein, 1575 aa, Nostoc punctiforme
MSIHLTSLVNQLRAILGKMEVALGAIADAIVWTGSDGKIQWCNTAFDKLVNRSHILVLNAKLSDLLFLSLAGEEVAPESYPNMRVLGGEYEITEEYECRDGKHRSLILEISGNCVQLTGGDRSSILVIRDVTQAKHWEREGYLAQQKQAETLSLLQATVESTADGIIVVNQDFNVAVFNQKFLQMWSIPESLLLPSQNNERFKFMSEQTRDPEAFIARVKELFYKFPEQEAFDLIEMKDGRVFERYSQPQWQGNKIIGRVWSFRDITARQQVEKALSESEIKFRRIVENSNDIISLIDLEGRISYISPNLAKLTGYETTELEGIPFADFIHPDDLPSCLDAVNRVVTTGERLEIEYRARLKDGSWQWQASNLATTNDLNGNLVLISVARVITERKQAEQALLKSEQKFRNLFENSQFGILRSRIDDGLILDANQRLAELLGYSCVADLIGGTKFTTDFYANPSDRQRIITELREKGSLKNFELQFYQCNGKAHWGLFSLRLNVEDNCLEAVVADINDRKQVEADLHRSNAILKAQQEASIDGILVVDENNRVVSYNQRFCQLWQIPERFVSGNNRRLLELALEKLEQPQEFLAKVEYLYAHPDQISRDEIRLKDGRTLDRYSASVRSLTEDYYGRIWYFRDITDRKQSEEALRRSEQKYRNIFENFQVGIARIRLEDGLFLEANQRQAEILGYSCATDLIGKQFTTEFYANPNDRQQLLAEMAQQGEVRNFELQLCRRDKSLGWGLISLRRNAQDGCIDAVITDISDRKLVEESLRQSEARFRALYESTSIAVMLQENGIPLDCNRAAEELFGYSRQEFLQKHPSEFSPPFQPNGQTSASLAREQVAIAYEQGRHRFEWVHRRADGTDFPAEVWLTVFKLGERKLIQGLVQDLTERKQVEATLWHRAQVDRLLNSISRQFIDQDADTAINFTLQAIAEFMGAECSCIFEYHEPQQQFHIAHEWYNPSSILNNTTSSEPLPWFYNQILNGNPIQGLQASRIANILPEANVETELTYREIIKSVVAVPMIYAGRVVGLLELDTVNKSKTWNQEEINLLQLVSELIAIGRSRHKAEEALRIAKETAETANRSKSAFLANMSHELRTPLNAILGFAQLMERDTTLNKRQRDSLATINRSGEHLLNLINDVLEMSKIEAGRIVLNPTSFDLHRLLQEMQQMFQVRAKDKKLSLSFELAPNLHQYILTDESKLRQVLINLLGNAIKFTNTGGVTLRVSLGIGEQGSRGEVALSLSPLPLCPSAPLPLVPNSQSLISFKIEDTGLGIPTEELDNLFQPFVQTASARQVMEGTGLGLTISRQFVQLMGGDIRVHSVVGSGSTFYFDIKIELADSLDIAPPTLKRRVIALTPGQPVYRILIVDDREDNCDLLTQLFNSIGFETQAAANGQEAIALWQTWEPHLIFMDMRMPVMDGYEATKQIRATLKGQATVIIALTASAFDEERFVVLSAGCNDFVRKPFREEVILNIISKYLGVRYVYEQEPLQQDQLAKNPNLKLLSLEEILAQMPTEWVTQLHQAALCTDEKLIFSLLEQIPEESALLANTLSDWINNFRIDKVIDLTQL

SEQ ID NO: 17572 - protein, 398 aa, Nostoc punctiforme
MKAITLVGSTGSIGTQTLDIVTQYPDQFRIVGLAAGNNVEMLAAQIRQFRPKIAAICSEDKLPALKEAIIDLDPQPILLAGEAGVIEVARYGDAQTVVTGIVGCAGLLPTIAAIEAGKDIALANKETLIAGAPVVLPLVEKHGVKLLPADSEHSAIFQCLQGVPKSGLRKILLTASGGAFRDWDVERLADVTVADALKHPNWSMGRKITVDSATLMNKGLEVIEAHFLFGLDYDNIEIVIHPQSIIHSLIELQDTSVLAQLGWPDMRLPLLYALSWPDRIYTDWERLDLVKAGNLTFREPDHQKYPCMQLAYAVGKAGGSMPAVLNAANEQAVALFLDEKIRFLDIPRCIEWVCDRHQNDNRANPSLDDILAADKWARQEVLTATEKLETPSRIISLR

SEQ ID NO: 17573 - protein, 1888 aa, Nostoc punctiforme
MDAKKIKILLVDDKLENLHFLSDILHNQVYQVQSALSGELAINTALAFPPDLIVLNFLIAKINGYEVYQNLKSHHKTQDIPIIFFGVLDELSEEVNVCDLGDVDYITQPFQAKEVLLRIQNQLTLQRLKKQLKEQNSQLQEEIKERQRVAVELNLRNQQIEEIFTEIPPSLSKAFCREVYQNERLLVEAALKKSESQYRHLVETSQDMIWSVDIDGLITFVNPAVKQIYGYEPQEMIGRTLIDFISPQQVTKDKVVFERVLHGKPIFQHETTCVAKDGTLLYLMFNAIALRNEEGLVIGMTGTASNITQRRGIEKLLQESAIKLRNHNLVLTQLAQNQILYQGDLKAALGKITETAVKNIGMERASVWLYDETGLKIECFDLFEGSRNQHSEGLVLSEADYPAYFAALQQDQPIAADDAHTDPRIREFSPSYSRLNITSILYTPIRQEGKTVGVLCLEAVGVAHHWTLEDQNFARSLGNLVSLVLEAKERQRAEAARRASEEKLASAFRSSPDPIALITVPNKRFVEVNDSFCRFFGYSRSQVIDRTDQELNIWVNPEEYNFLTQMLQKTKAIRNYEIDVCTCSGEIRTTLLSAEMIEIDGKCYVLGTAKDITERKQAENESRLLLLTTQAITRANDVNSSLALVLRLICHTIGWDFGEAWIPNEDSSVLEHSLGWYGEQSNLEEFCRHSQIVKFPLGVGLPGRVWQNQEPEWIEDVSEVTEPIFLRSQQAAKVGLKAGFGVPILAGNKVLAVLVFFKRSSVLVDRRLLLLVNAVAAQLGGLIERKTLEQELALREARLNAFFTGAPVGMNIVDNQLRFVQINQVLAEINGISQEAHIGKTIHEALPKIASVVEPFYQQVLLTGEPILNQELSAASIKQPDIIRHFLVSYFPIPGEDDRLSGVGTVLVEISELQAALRERQAALRERKHVEQELRLANERLQYLLTSSPVVIYSSKKTLGNFSTTFISKNVKAMVGYEAQEFVENPNFWLHHVHPEDIELISEKFSQLVEQEYTSYEYRWLHADGTYHWFYEKMRLIRDETGNPIECVGYWTDINDAKLAELALQTGRQRYQLLAETSPACIFHTDVDGNVLYFNQRWSEISGCNLEESLGTGWTKAVHPDDREQLLLTWNQARVAKVMYKYEHRFLCDDSTVVWVICQALPEFRDDGEIKGYIGTITDITERKLAEEALRESAERERAIAQVIQRMRQTLDLETIFAATTQELRQVLNCDRVVVYRFNPQWNGEFVSESVGNGWISLIEEHNNDPNLTEGVLQQGRCLAKILDSGDNQAEDADMQAIQDGIYAQGATFRCVPDIYNAEFHPSYISLLERFQAKAYIIVPILYGSQIWGLLASYQNSDSRQWKPGEINIVVQIGNQLGVALQQAQLLAQTQRQSQALQEAVITADAANRAKSEFLANMSHELRTPLNAILGFTQIMSHDRALSTEHQQNLAIINRAGEHLLNLINDILEMSKIEAGRITLNLNSFDLIRLLENLEEMLRFRATSKGLELNFEYTSYLPQYIQADESKLRQVLLNLLGNAIKFTDTGRVMLRVAMENMGEKILPHPPHLFFEVTDTGRGIAPQEINLLFEAFGQTETGRKSQQGTGLGLAISRKYVELMGGDISVTSIIGEGSTFAFDIQIDLAAASEIQIQQIRRQVLSLAPAQNEYRILVVDDSIDSRLVLVKILTSIGFAVQEAANGTEAIALWQQWQPHLIFMDMRMPIMDGYEATKIIKAREETSIPNRKTIIIALTANAFEEQREATIKAGCDDYINKPFREEELLKKLSEYLEVKYIYQEDNYQIKNANQQITESILKLTDLVPLLSEMSPEWVKQVYTAAAQCSDDLILELIEQIPSENATLSNFIQNLAHNFQFEKIMELTSIAGVLSGL

SEQ ID NO: 17574 - protein, 327 aa, Nostoc punctiforme
MPTVNTQTENLNTRFTADMVRTYLREIGRVPLLTREQEIVYGKQVQQMMTLIDAKEVLAKKLHREPDMSEWADVVQQSETEVQQTVAQGKRAKQKMIEANLRLVVAIAKKYQKRNMEFLDLIQEGTLGLERGVEKFDPMRGYKFSTYAYWWIRQAITRAIAQQGRTIRLPIHITEKLNKIKKVQRELAQTLGRSPTPAEIAKELELEPAQIREYLNMARQPVSLDVKVGDNQDTELQEMLEDSGPSPEYYTNQEFLRQDLNNLLAELTPQQREVLALRFGLEDGNEMSLAKVGERLNLSRERVRQLEHQALAHLRRRRANVQEYVAS

SEQ ID NO: 17575 - protein, 557 aa, Nostoc punctiforme
MKNILDISISQEQNLHQSYSISSYNRLLLVVKDLACVRTIEEIIEIVRLAARDLTNADGVTFVLRDGECCHYVDENAIGPLWKGMRFPLKSCISGWAMLNKQAAVIEDIYQDARIPINAYKVTFVKSLVMVPIRIADPLGAIGAYWSRTHLATSEEIELLEILTDTTAVAIANVQLFQKLTNQNALKDKFIAMLAHELRNPVAPISNGVQLLKLKLGETGAVGETVLMMQHQIKHLSKLIDELLDVSSITYGKISLNLEKVNLVELVRQSLNDHAQAIKRSNLNVVEDLPNTPVWAYVDPTRFFQIFGNLLDNALKFSKPDGTIWVDLLYIPGENGSGSLAALSVRDSGIGIEPTILPELFEPFTQADRSLDRSRGGLGLGLSVVKSLVELHGGNVEASSRGINLGAEFKVTLPVCEEITTLDNDLETMEAAKKSLKILVIEDNDDSATTLKAVLEHFGHEVSIAKNGISGVETARELEPHVIICDIGLPEMDGFAVAQELSKDSKFTRSILIALTGYGGQEDKELALKSGFKCHLTKPVDFEILTAEIDRYFLVSA

SEQ ID NO: 17576 - protein, 365 aa, Nostoc punctiforme; identical to SEQ ID NO: 1139

SEQ ID NO: 17577 - protein, 629 aa, Nostoc punctiforme
MMQTFFNYPFQSNGFIPHGHCYLWQTGLVWLHIISDATIALAYYSIPFLLIYFISKRKDVPFNGVFLLFGAFIIACGTGHLMDIWTLWYPDYWIAGGLKALTAIISIYTAFALFYLMPQALALPSPDQLEAINRILSTEIVERKRIEKELRQAEEVAQNSSQAKSEFLANMSHELRTPLNGILGYTQILQRTESLSEKGRKGLSVIYQCGSHLLTLINDVLDLSKIEARKLELYPVDFYLPAFIDSVTEICRIRAEQKVIAFNIEIDPNLPTGIHGDEKRLRQVLINLLSNAMKFTHQGSVTFKTQVINQESNANGKTNYKIRFEVVDTGTGITPEQAEKIFQPFEQVGSQKRQSEGTGLGLAISQKIVLLMGGQIKVQSEFGKGSTFWFEANLSESKDWAKVSRVVEQGTIIAYQGKRRTILIADDKWENRSVIVNLLEPVGFTVVEASNGQEAWVQSLAHKPDMIITDLVMPILDGFELIRRLRQSGAFKEIPIVASSASVFAVDQHKSIDVGADAFLPKPVEAENLLEMLRQFLQLEWIFDAKVDAIKKNSQDSSNQHNEMIHPSKDVLQELLELSQDGDIQNILELAEKLSASDEKLNMFSQQLMQLASNFQLKRLETFIEKYIN

SEQ ID NO: 17578 - protein, 356 aa, Nostoc punctiforme
MAAENIKMAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 17579 - protein, 246 aa, Nostoc punctiforme
MQQSLDSISDPPSTKTQDSAHKSMLKNLLSGVFFEPLLSDFRIIFERDPAARNWLEVVFCYPGLHALCLHRLAHWLHGRGVGFIPRFISHLGRFLTGIEIHPGAEIGQGVFIDHGMGVVIGETAIVGDYTLIYQGVTLGGTGKETGKRHPTVGKNAVIGAGAKVLGNLQIGDRVRIGAGSIVLRNIPNDCTVVGIPGRIISRNENASLSPLEHGKLPDMEATVIRSLLSRVEQLEKQLQTLGVKSH

SEQ ID NO: 17580 - protein, 390 aa, Nostoc punctiforme
MYQTKQQSLKETMNIVELGKMEILENAADIEEPSLDSLDAVADEEPPIVVENLESDERDGDDMAAARPSGYNKTEHDDAVGAFFKEMARYPLLKADEEVELARRVRFLEEIRELQAALNLKLGQEPTKLEIASELEMTEKQLESRLYQGRVAKRKMIRSNLRLVVSIAKRYLNRGVPFLDLIQEGAMGLNRATEKFDPDKGYKFSTYAYWWIRQAITRAIANDARTIRLPIHIVEKLNKLKKAQRELKQKLCRNPTEGEMAEALDISVQQLRQLQQLRRQALSLNHRVGKEEDTELMDLLEDEDNLSPEAKMNENMMRQEIWEVLGDVLTPREKDVISLRYGLTTSEPCTLEEVGNMFNLSRERVRQIQSKAMRKLRRPHIAKRLKGWLI

SEQ ID NO: 17581 - protein, 498 aa, Nostoc punctiforme
MHLKSQESPVTEKSYTRADWQGGYQSLTQEFDYWIDDIEGQIPRELEGTLFRNGPGLLDVNGQFLHHPFDGDGMISKITFTNGRAHFRNRFVRTTGYLAEQKAGKILYRGTFGTQKPGGWRVNIFDFKLKNIANTNVIYWGGKLLALWEASEAYCLDPYTLETLGNEYFNGALSAGEAFAAHPRLQRNCEQDGGEPRLVNFSIKPGLSTTITIFELNLAGEIVRQQAHKVPDFCFIHDFVITPNYCIFFQNPVTFNPIPFALGIRAAGECIKFQPNQPTKIIIIPRFPKEGQEEIKFLETQSGFVFHHVNAFEVGEEVLIDSICYQDLPEVEPKSDFRQVDFEASSPGQLWRFYLNLKNGTVQRELIDSRCCEFPSIDPANVGHPYRYLYIGAAHAESGNAPLQALLKIDLHSGEKQFWSAAPRGFVGEPIFVPRPDSEKEDDGWVLALVYNAAHHRSDLVILDASDFSKGTIARLHLKHHIPYGLHGSFTSEVFGEI

SEQ ID NO: 17582 - protein, 199 aa, Prochlorococcus marinus str. MIT 9313
MSIFVGNLPFRAEQEDVIELFAPFGEVANCALPLERDTGRKRGFAFVEMADESAEPAAIEALQGAEMMGRPLRINKAEPRGSAPRRGGGYGGGGGGGGGGYGGGGGGGYGGGGGGYGGGGGGYGGGGYGGGGYGGGGYGGGGGGGDRGSGARGWEDRSYGGASPETSSYDEGRTRRRRGGAAPEGEGGDSYSGYGGAEG

SEQ ID NO: 17583 - protein, 181 aa, Prochlorococcus marinus str. MIT 9313
MEIHPGAKIGNGVFIDHGMGVVIGETAEVGDRCLLYQGVTLGGTGKDHGKRHPTLASNVVVGAGAKVLGALHIGSNTRIGAGSVVVSDVEANSTVVGIPGRVIHQSGARIEPLAHSALPDAEANVIRNLMGRIDLLEANMETMRRKMQAIKDGNSYNEELFGESQNLKDKEIIEYIGDKKI

SEQ ID NO: 17584 - protein, 335 aa, Prochlorococcus marinus str. MIT 9313
MADSAASKSLVKPAVVPARQLPADVDLVRSYLRDIGRVPLLSHEQEITLGRQVQELMSLEQLESELEGQTGEPASRKELAKAAGLSELQLKKKLQSGRRAKERMVSANLRLVVSVAKKYTKRNMELLDLIQEGTIGLVRGVEKFDPTRGYKFSTYAYWWIRQGITRAIAEKSRTIRLPIHITEMLNKLKKGQRELSQEMGRTPTVSELAEFVELPEEEVKDLMCRARQPMSLEMKVGDGDETELLELLAGEEELPSEKVEVDCMKGDLRTLLEKLPELQGRVLRMRYGIDGGEPMNLTGIGRILDISRDRVRNLERHGLNGLRQLSETVEAYAAC

SEQ ID NO: 17585 - protein, 561 aa, Prochlorococcus marinus str. MIT 9313
MIGSRIPRAVAMPCTTEVLPAPRGPSSNSTDKAGSRWTSAMPSHRVASRFSRIHVSSVDCPISDPEVLATSLRFPYTIPPRELSTMVAVPTSTASLQALPQYVVADIDLADFGRKELSIAETEMPGLIALRIKYGSEKPLKGARIAGSLHMTIQTGVLIETLVALGADVRWASCNIFSTQDHAAAAIAASGVPVFATKGETLDEYWAYTHRILEWGDGGTPNMILDDGGDATGLVMLGSKAESDSSVLDNPGNEEETALFASIRTKLAEDSSFYSRIKSSIQGVTEETTTGVARLYQMQKSGELPFPAINVNDSVTKSKFDNLYGCRESLVDGIKRATDVMVAGKVALVMGYGDVGKGSAQSLRGLGATVMIAEIDPICALQAAMEGYRVVRLDEVVQDVDIFVTSTGNFQVIRHEHLIRMKDEAIVCNIGHFDNEIDVASLKDYPWENIKPQVDHITLPSGNKIILLAEGRLVNLGCATGHPSFVMSNSFTNQVLAQIELFSKGDQYADQVYVLPKHLDEMVARLHLEKIGARLTELTKQQADYISVPVEGPYKPDHYRY

SEQ ID NO: 17586 - protein, 313 aa, Prochlorococcus marinus str. MIT 9313
MVSAAPKSAETQRRRSSDPVSWYLTTIGRIPLLTPAEEIELGNQVQTMMSLTQDGSVAPDDKEFTTHQRRMIRIGRRAKERMMKANLRLVVSVAKKYQGKGLELLDLIQEGSLGLERAVEKFDPTRGYKFSTYAFWWIRQSMTRAIACQSRTIRLPVHLSERLTTIRKVSLDLAHKLGAIPSRSEIAEAMDIPVDELDSLLRQALTTSSLDAPVNGEERRSFLGDLIADSSLGEPLDKVEQRIHHEQLGRWLSHLSEQEQHVLKLRFGLETHDRHTLAEIGRLMEVSRERVRQVELKALRKLRNLTRRVPNEI

SEQ ID NO: 17587 - protein, 225 aa, Prochlorococcus marinus str. MIT 9313
MSFPAACLFDLDGVLLDTEPLHAQAWSQTAAVFATSLSTSQLLMLKGRRRLDCAQLVNNWLNTPVGIEQLLAVRQPIAKHLLSQAKAMPGAEELVRWCYDHRLPMAMASSSTADAVAFKSIHHSWLAQIQTRVLGDDLSLTAGKPAPDPYLLAARRLAVKPTACWALEDSQAGTQAALAAGCHVWVLSENEVHINCDGKFKDENPRQIAQLKTVLDHLQQAWDAL

SEQ ID NO: 17588 - protein, 479 aa, Prochlorococcus marinus str. MIT 9313
MALHRSNPRSNDLEEHAIGETVDALVSPLPRTTFPQEYRPALTTFNLLKEELLLDGNSKQNLATFCQTYESQQVAELMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAVSQALDELQQRKGLDIPIHVDAASGGFLAPFCAPDLAPWDFRLPRVKSINSSGHKFGLAPLGVGWVLWRESRDLPEGLVFHVSYLGGDMPTFQINFSRPAGQVISQYYDFVRLGRDGYQAIHGASYANAQYVAQELKKLGPFELINDGNPAGGIPTVVWTLRADQELGFNLYDLSDRLRLRGWQVPAYPFTGELAHQAFQRILVKRDFSREMADLLLTDIRNAITHFESHPVKISLNANEAASTNHLGRSMVECRDAHG

SEQ ID NO: 17589 - protein, 334 aa, Prochlorococcus marinus str. MIT 9313
MDRTLIQEILEVVEQAAIASAHLTGLGKKDEADAAAVEAMRKRMGQIQMQGRIVIGEGERDEAPMLYIGEEVGSGSGPGVDFAVDPCEGTNLCANNQRGSMAVLAASDRGGLFNAPDFYMKKLAAPPSAKGKVDIRKSATENINILSQCLGLAVSELTIVVMDRARHKGLISEIRATGARVQPISDGDVQAAIACGFAGTGTHCLMGIGAAPEGVISAAAMRALGGHFQGQLVYDPAIAQTSEWADYTKEGNIARLNEMGITDVDKIYEAEELASGKNVVFAGSGITDGLLFHGVKFEPDCTRTSSLVISTLDNTARFTNTVHIKDGAKSIALS

SEQ ID NO: 17590 - protein, 174 aa, Prochlorococcus marinus str. MIT 9313
MPLAQPLELTNMQCRCWMLRLLTRAKQLGDFGEVPVSAVVLDADGRCIGHGSNQRHRRRDPLGHAELIALRQAAWLRSDWRFNDCTLIVTLEPCPMCAGALTQARMGQVIFAAHDPKRGGLGSTIHLGEHPSAHHKMRVLGGVMEVEARQQLEAWFKQQRQRFHENEVTLTRTD

SEQ ID NO: 17591 - protein, 327 aa, Prochlorococcus marinus str. MIT 9313
MSGTLLFNALRDAIDEEMARDSHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLIEELPDGDYVCALDQADLVREGKDVTILTYSRMRHHCLKAVEQLEADGIDVELIDLISLKPFDMETIVRSIRKTHRVIVVEECMKTGGIGAELIALITEQCFDELDARPIRLSSQDIPTPYNGKLENFTIIQPHQIVEAAKQIVLKGL

SEQ ID NO: 17592 - protein, 653 aa, Prochlorococcus marinus str. MIT 9313
MGWSGTGTRMRLSELTHPNQLHGLSIAELEDVARQIRERHLEVVSTSGGHLGPGLGVVELTLALYQTLDLDHDRVVWDVGHQAYPHKLITGRYGDFNTLRQQGGVAGYLKRCESSFDHFGAGHASTSISAALGMAVARERRGESFKCVAVIGDGALTGGIALEAINHAGHMPNTPFLVVLNDNDMSISPPVGALSTHLNRMRHSAPVQFISDSVEERVKSLPFMGGELPAELDLLKGSMRRLSVPKVGAVFEELGFTYMGPIDGHDIERMVRTFETAHKVGGPVLVHVVTTKGKGYPYAEADQVGYHAQSAFDLSTGKALPSKGKKPPSYSKVFGETLIKLCQQDSTVVGITAAMATGTGLDLLQKAVPEQYIDVGIAEQHAVTLAAGMACEGLKPVLAIYSTFLQRAFDQLIHDVGIQNLPVTFVMDRAGIVGADGPTHQGQYDISYFRAIPNFTVMAPKDEAELQRMLVTCLQHQGPAALRIPRGSGEGVPLLDEGWKPLAIGRGEVLCEGDDLLIVAYGVMVPAAMITAQLLQEAGIKATVINARFLRPLDQALIHPLARRIGSVVTMEEGALAGGFGAAVVESLSDQDVLVPTFRIGIPDQLVDHASPQQSREALGLTPTQMSERIQEHFCLNSKPSLVGQEAPQALST

SEQ ID NO: 17593 - protein, 1214 aa, Prochlorococcus marinus str. MIT 9313
MRDRMTAGPLDITRPESAFLARLHSSERPVLVFDGATGTSLQKQNLSADDFGGALLEGCNENLVVTRPDAVKEVHRQFLESGCDVIETNSFGAASIVLAEYGLEDQAFELNRQAAQLAKSMAVQYSTKDQPRFVAGSIGPTTKLPTLGHIAFDTMRDSFQEQAEGLLAGDVDLFIVETCQDVLQIKAALQGIECAFLKANERRPIMVSVTMETTGTMLLGSDIASVVTILEPFPIDILGLNCATGPEQMKEHIRYLSEHSPFTISCIPNAGLPENIGGVAHYRLKPLELKMQLMHFVEDLGVQVIGGCCGTTPEHTSALAELAKEMRAAQRPCRQGENEQQRQLFGYEPSAASIYGITPYHQDNSFLIIGERLNASGSKKVRELLNSEDWDGLVGLARGQLKENAHILDVNVDYVGRDGEKDMNQLVSRLVTNINLPLMLDSTEWQKMEAGLKVAGGKCILNSTNYEDGEERFFKVLDLAKKYGAGLVIGTIDENGMARTAMQKVAIAKRAYRDATEYGIPAHEIFYDPLALPISTGIEEDRRNGLETIEAIRVIREELEAVHVVLGVSNVSFGLSPAARITLNSVFLHDCTDAGMDAAIVSPAKILPLNKVSDEQQKICRDLINDHRRFENEICTYDPLTELTSLFEGVSAKEARASGPSLADLPVEDRLKQHIIDGERIGLNEALDEGLESYKPLQLVNTFLLDGMKVVGELFGSGKMQLPFVLQSAQTMKAAVAYLEPYMEKSAGDKSSKAKFLIATVKGDVHDIGKNLVDIILTNNGYEVINLGIKQDSASIINAQMTHQADCIAMSGLLVKSTAFMKSNLQEFNDSGITVPVILGGAALTPRFVNHDCSEVYKGKLIYGKDAFTDLRFMDAYVKALSNDRWDDCRGFLDGTPDGLTLGGQSTESDSPHSSNDEDPQEENQKNIQDINLAVNTNRSEKVSQEDAVTPPFLGSKHLKLDKIPLDEIIQYLDRNALFSGQWQIRKRKDQSREQYDQYINDEIEPILQHWLHRIRNESLLHPGVAYGYFPCGRRDNDLLVFNSEGQSLLGKFNLPRQKGGNRYCIADFYRDLEGGLPKDILPMQAVTMGENASIFAQKLFESDAYTDYLFFHGLAVQLAEALAEWTHSLIRCECGFKSDEPKTLQDVLAQRYRGSRFSFGYPACPNVGDSRQQLNWLKADLIGLTMDPNDQLHPEQSTTALVTLHSKARYFSA

SEQ ID NO: 17594 - protein, 455 aa, Prochlorococcus marinus str. MIT 9313
MMSSSPYEPGRDPLSPNCNLAPITTELDAQSRLIVGGCQLSELAECYGTPLYVLDEATLRAACQSYRGALQRHYPGPSLPIYASKANSSLMMSSLVASEGFGLDVVSAGELLTALKGGVPGDCIVLHGNNKSDQELLLAYRNGVTIVADNQHDLDRLSQLVPVGADPAKLMLRFTPGIECHTHEYIRTGHLDSKFGFDPDQLESVLNQLLGCRWARLTGLHAHIGSQIFELEPHQDLADVMAGALQLARRLGHPVMDLNVGGGLGVRYVSSDDPPSIDNWVKVVAEAVNQACRSRNLDLPRLMCEPGRSLVAAAGVTLYRVGSRKTIPGLRTYLSVDGGMSDNPRPITYQSLYTACLADRPLASPDETITLVGKHCESGDVLLKDLALPYASSGDVLVVFATGAYNVSMSSNYNRIPRPAAVLVHSGHSELVQRREQPEDLLRYDVMPERFLALG

SEQ ID NO: 17595 - protein, 320 aa, Prochlorococcus marinus str. MIT 9313
MAPLAVLSDVDLVRSYLRDIGRVPLLSHEQEITLGRQVQELMSLEQLESELEGQTGEPASRKELAKAAGLSELQLKKKLQSGRRAKERMVSANLRLVVSVAKKYTKRNMELLDLIQEGTIGLVRGVEKFDPTRGYKFSTYAYWWIRQGITRAIAEKSRTIRLPIHITEMLNKLKKGQRELSQEMGRTPTVSELAEFVELPEEEVKDLMCRARQPMSLEMKVGDGDETELLELLAGEEELPSEKVEVDCMKGDLRTLLEKLPELQGRVLRMRYGIDGGEPMNLTGIAKTLGMSRDRTRRLEREGLALMRTSSFELEAYMAV

SEQ ID NO: 17596 - protein, 155 aa, Prochlorococcus marinus str. MIT 9313
MSISISSPAPNGSLPRLRLSSSSIQGLSFSDQGFTDQIPSVLLGMTIYIGNLSFQAEQEDLLDLFSQYGEVKTCSLPLDRETGRKRGFAFVEMTNDADEQKAIDDLQDVEWMGRMIRVNKATPRERTGGGGGRGGYGGGGGGGGGYGGGGGGNRW

SEQ ID NO: 17597 - protein, 388 aa, Prochlorococcus marinus str. MIT 9313
MVNIQLGRTKVVRRAYGIDETALVPGGRTVDPEITDTCWNLAGIEREIPIIASAMDSVVNVDMAVALSRLGALGVMNLEGVQTRYKDPNPVLDRISSIGNDAFVPLMQEIYSKPVQEALIYQRIKEIKNQGGIAAVSGTPVAAMRFSKTIAEAGADLFFVQATVVSTEHIGPEGQQTLDLEALCQGMGVPVVMGNCVTYEVALKLMRAGAAGVMVGIGPGAACTSRGVLGVGIPQATAVADCAAAREDYERESGRYVPIVADGGIITGGDVCKCIACGADAVMIGSPIARALEAPGRGFHWGMATPSPVLPRGTRIKVGSTGSLERILRGPALLDDGTHNLLGALKTSMGTLGARTIKEMQQVEVVIAPSLLTEGKVYQKAQQLGMGK

SEQ ID NO: 17598 - protein, 417 aa, Prochlorococcus marinus str. MIT 9313
MKAISVLGSTGSIGTQTLEIAEEFPERFRVVALTAGTNVSLVVEQIQRHHPEVVALADASLLPELKQQLNALPSEQQPPHLPQLLAGPEGLNVAASWDSADLVVSGIVGCAGLLPTLAAIKAGKDLALANKETLIAAAPVVLPELKRSGSRLLPADSEHSAIFQCLQGTPWAENARLSTGVPTPGLRHIQLTASGGAFRDWSAKDLEKATIADATSHPNWSMGRKITVDSATLMNKGLEVIEAHYLFGIDYNQIEIVIHPQSIIHSMIELADSSVLGQLGWPDMKLPILYCLSWPERLETPWRRLNLAEVGELTFRAPDTKKYPCMKLAYAAGRAGGTMPAVLNAANEEAVAQFLEERIHFLDIPEVIEAACERHKPDLQTQPQLDDVLAVDAWARKAVQEQVKRGTRRLPLPALTA

SEQ ID NO: 17599 - protein, 339 aa, Prochlorococcus marinus str. MIT 9313
MHPSMVIPRFSDRPLDVVGIGNAIVDVLVQADDAFLDAHSLSKGNMALVDEAQAEALYSISGPGLETSGGSAANTLVGLAQLGGKAGFIGRVKNDQLGSIFSHDIRSVGARFETPPASDGPSTARCLILVTPDAQRTMCTYLGASVQLDPEDLDLSMVRQAKVLYLEGYLWDSPAAKKAFIAAAQVCRDSGGQVALSLSDGFCVDRHRDSFLELVDSHVDLLFANDSEITSLYKSVSFEAALEEVKGRCKVAALTRSEHGSVVLAGDQRWDIPAYKLGNVVDTTGAGDLYAGGFLHGYTQGTTLETCGQIGSICAGQVITQLGPRSQVSLPELVAKHLN

SEQ ID NO: 17600 - protein, 471 aa, Prochlorococcus marinus str. MIT 9313
MATFAWFCISMGSAPSFPLSSFIPSPAMSPAATQAAAAKAQPKASAKTAKPQVAKGTAKTKAKKVKATAAKAKTAAKPVSSAAKASSPKAKKAKATPPPTVSKNLDLTADQLLATAATSAPKASAETESSQAAAKATSEADAKARALANIKIGPKGVYTEDSIRVYLQEIGRIRLLRPDEEIELARKIADLLHLEELAEQFNSDHGHYPNNKEWASLVEMPNIKFRRRLMLGRRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKVLSQEFGRKPTEEEIAESMEMTIEKLRFIAKSAQLPISLETPIGKEEDSRLGDFIESDTENPEQDVAKNLLREDLEGVLATLSPRERDVLRLRYGLDDGRMKTLEEIGQIFEVTRERIRQIEAKALRKLRHPNRNGVLKEYIK

SEQ ID NO: 17601 - protein, 262 aa, Prochlorococcus marinus str. MIT 9313
MGPYDPARTNHAMTSPRPLTGQTALITGASRGIGRAVALALAEAGAEVVVNYSSSADAAEEVVQAITSNGGSAYAIKANVAEEDAVDQLIKTVLERSSRLDILINNAGITRDGLLMRMKTEDWQAVVNLNLTGVFLCTRAVARTMLKQKSGRIINITSVVGLMGNAGQANYAAAKAGVVGLTKSTAKEVASRGITVNAVAPGFITTDMTKELDSEPILAAIPLGSFGTPEQVAGAVRFLVADPAAAYITGQVLQVDGGMLMG

SEQ ID NO: 17602 - protein, 319 aa, Prochlorococcus marinus str. MIT 9313
MLSIRHWLLMVLPFALWGTAMAAMTPLVISGGPLLVACLRLLPAGVVILLALPSLGRDWAIASTDRIWFLVFTVVDACLFQMFLVKGLAYTGAGMGSVLIDSQPLLVALLARSLFGESINPVGWMGLMFGLVGIICLGAPPDLLRHWWLLGEQASGSSLLEQGEGWMLAAAIAMALGTVLSRYACRSSDPVAVTGWHMVLGSLPLLLWHSFDRTWPLWPDWTGFDWGLMAYASLFGSALAYGLFFWLVNREELTSFSTLAFLTPVFALAAGGVWLGERLQPLQWFGVALVLLSVLVVSQRRRLWEPVEVDSDVLPGEIG

SEQ ID NO: 17603 - protein, 685 aa, Prochlorococcus marinus str. MIT 9313
MASSTSQAIAEWAPPGDGQPPPEPPGWGERIYLWWAEFSLQTKLLAIATLVVSLLMTGVTFFVLNGIQRDAGMNDTRYARDLGLLLSGNVTELVAQGRDRELATVAEQFWRSRSLRYIFFADPDGLIYLGIPISASPVSGDNDLQLNHRLELPAELPSRPENALIRQHLTPQGQLTDVFVPLVWKGDYLGTLALGVNPNDTALASAALTRQVTIAVFISIWVLVILGAVFNALTITQPVKELLRGVRAIASGNFEARIALPMGGELGELLNGFNAMASQLEAYDAANIEELTAAQVKQQSLIATMADGALLLDEVGQIVLANPTARRIFRWEGRNLEGQELLNELPEIIANELHDPLQSLLRNIGESNDLRCSLEEPSRTLRIVLQSVRDQSGETLKGIAITVQDLTREVELNAAQSRFISNVSHELRTPLFNIKSYVETLHDLGDQLSEEEKKEFLGIANSETDRLARLVNDVLDLSRLESGRTVQFEPMDLRPAIEQTLRNYRLNADDKQIHIELNTDDELPTILGNWDLLLQVLDNLVGNGLKFSRAGGSLMVRAYTWPDSCKMSPIESSKSAPHCEFFSPLPKLRVEVADTGHGINQDDQQHIFDRFYRVENAVHTEAGTGLGLSIVRGIIEKHGGQIRMASEVELGTTFWFDLPLEQTDADELIVQSVRTTRQQEQGLEL

SEQ ID NO: 17604 - protein, 112 aa, Prochlorococcus marinus str. MIT 9313
MKKVEAIVRPFKLEDVKLALVNAEIIGMTVSEVRGFGRQKGQVERYRGSEFTVEFLQKLKVEVVVDDDKVEAVVNAIAEAAKTGEIGDGKIFISPVDSVVRIRTGERDSKAL

SEQ ID NO: 17605 - protein, 432 aa, Prochlorococcus marinus str. MIT 9313
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 17606 - protein, 358 aa, Prochlorococcus marinus str. MIT 9313
MATAEQAHNALDQVKDSGSGRSALEMGWIDQVRVIPPRAVIRLTLPGFAQSQRDRLAQEARQALLELNGISEVQIEIGETASQGPIGQAGHGQSAEPQAIQGVQQIVAVSSGKGGVGKSTVAVNLACALAQEGLSVGLLDADIYGPNTPTMLGVADRTPEVSGNGAEQCIIPIESHGIAMVSMGLLIEENQPVIWRGPMLNGIIRQFLYQAYWGERDVLVVDLPPGTGDAQLSLAQAVPIAGVVIVTTPQKVSLQDARRGLAMFKQMGINVLGVVENMTAFVPPDQPERRYALFGSGGGEQLAMENNVPLLAQIPMEMPVQEGGNEGSPIVHSRPESVSAKAFKQLAKQVLDCASKAS

SEQ ID NO: 17607 - protein, 428 aa, Prochlorococcus marinus str. MIT 9313
MKIEAARPLMGRRLLVAVTGSIAAVKTPLLVSALIKAGAEVRCLVTPSAARLVSPVALASLSRHRCYQDEDQWNSSEPRPLHVALAEWAELVIVAPLSATSLARWSHGLAEGLLASLLLACERPVLAAAAMNTAMWSNPAVRRNWQELQTDRRVLPLAPESGLLACDRIGDGRMVDPKLIELAVVSGLLQADETGRLQRDWQGRRLLVTAGSTVEVLDPARLLINRSSGRMGVLLAQAARLRGAQVDLVHGPLKLPVAWLEGLAAYPVTSADEMQNMLAQLQSKADAVAMAAAVADVRRVNPAQTEKLSKDCLLQSFSQGWEQVPDLLAELVLRRPVGQVLLGFAALTGNEAQIQQLGEEKRLRKGCDLLMANPIDRPGQGFEEDFNGGWLLAADGSIRSLPVTSKLALAHQLLDAILEVQVVISAPS

SEQ ID NO: 17608 - protein, 502 aa, Prochlorococcus marinus str. MIT 9313
MSTVSDSPSTVSATSIDVPGGFDRDDWASGYCNVEQELNAVSLRPLRGQIPAELQGSHYRNGPGRFERDGQWVHHPFDGDGMITAVRFSDSKATLSNRFVRTKYWQEEEKAGRFLYRGVFGTQKRGGVKANAFDVRFKNIANTQVVQLGDQLLALWEAAGPHALDPVSLETHGLSSLNGVLKPGEAFSAHPRFDPGHHGDPRMVTFGVNTGPTSKIRLMEFATQGPDAGRLISDRTDSFKGFAFLHDFAITPNWTLFLQNAINFNPLPFVLGQKGAAQCLTSKPGGQAKFWLIPRDCGTFAGQPPRIFDAPDGFVFHHLNAWEEGDELVLESIYYSDYPSIDPGEDFLSMDFDFFPEGRLEQCRINLLGKGIETKRFSERCCEFAMVNPRREGLSARYAWMAVAERETGYAPLQAIKKLDLSNGDQCLWSAAPRGFVSEPLMVPRPGSEAEDDGWLLVFVWNGERRASQLLILNANDLSEQAVLEMPITIPYGLHGSWVAAD

SEQ ID NO: 17609 - protein, 431 aa, Prochlorococcus marinus str. MIT 9313
MIDSLDLVIDTIVAREVLDSRGNPTVEAEVLLEAGAIGRAIVPSGASTGAHEAHELRDGDSRYLGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASSFRESLRMGAEVFHTLKGLLSAQGLSTAVGDEGGFAPNLANNDAAGDLLIQAIEKAGYSPGKDISLALDVASTEFYQDGCYAFGGGRYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGSQAVYAGATGQGPRGRS

SEQ ID NO: 17610 - protein, 355 aa, Prochlorococcus marinus str. MIT 9313
MRLYLQDIGRVELLTNEEEVTLARLVQRREALLKQERKLASNQEAIKELQRLEELQQREANHSCHWPTKQEWAMAAGLTLAELQEKIETGYKTWGALTGLDPLELKRSLRAGRRAKDQMIQANLRLVVAVAKKYQQRGIELLDLVQEGTLGLERAVEKFDPTRGFRFSTYAYWWIRQGITRAIATQSRTIRLPMHITEKLNRIKRVQQEIASSQGRLASIADLAKALGLSEETVRLTLMRVPRSISLETRIGQEQDTQLGDLLEDSNATPEEKLTRNQLHNDLEILLDELSNREATVIRRRFGLEDDTPQTLTQIGEAMHLSRERVRQIETHALLKLRQPQRRCKVRDYIQNLDS

SEQ ID NO: 17611 - protein, 710 aa, Prochlorococcus marinus str. MIT 9313
MGLRLLHLHLHGLFRSHDLELGRDADTGGQALYVLELVRGLAARSEIEQVEVVTRLIHDRRVSTDYANPIEDIAPGAKIIRLPFGPRRYLRKELFWPYLDDLADQTVSHLQQQEHLPDWIHAHYADAGYVGALVSRRLGVPLVFTGHSLGREKLRRLLGVGGDHEQIEQTYAIGQRIDAEEFTLAHCSLVITSTRQEIDHQYARYGRFVPEQAEVVPPGVDSIRFHPLQSSSETDVVDGLLAPFLRKPSLPPLLAISRAVRRKNIPFLVEAYGRSPVLRQRHNLVLVLGCRDDPRQLEKQQREVFQQVFDLVDRYDLYGRVAYPKQHRRDQIPAIYRWAALHRGLFVNPALTEPFGLTLLEAAACGLPMVATDDGGPRDILARCDNGLLVDVTDLEALQDVMEQAGSDADQWRLWSDNGIVAVSRHFSWDAHVCHYLALMKQRLELSQPRIWATDKECLGSPLGQSLLLLDLDSSLEEPEAEGLASLREGLESIGSGDAHGLGVLTGRSVQAAKKRYAELNLPSPRVWISRAGTEIHYGLEDQSDRFWQAHIDVDWRRQAVVSALADLKDHLTLQDDQEQGPHKVSYLLKEHGEAILPLVRQRLRQRSQAARPHLRCHWFLDVVPLRASRSEAIRYLSLRWGLPLEQILVVASQQGDAELVRGLTASVVLAEHDPCLEGLRHQQRVFFANNPHLFGLLDGLNHYRFFLKS

SEQ ID NO: 17612 - protein, 214 aa, SYNECHOCOCCUS SP. WH 8102
MSIFVGNLPFRAEQEDVIELFAQFGEVANCALPLERDTGRKRGFAFVEMADEAVEDAAIEGLQGAELMGRPLRINKAEPRGSAPRGGGGGYRGGGGGYGGGGGYGGGGGRDGGGGYGGGGGGYRGGGGGYGGGGGGGRDGGGGYGGGGGGYRGGGDAGDRPSGARGWEDRSYGARDSGGEGGGGHDDGRSRRRRGSSGGGGGGDDYSGYGGAEG

SEQ ID NO: 17613 - protein, 248 aa, SYNECHOCOCCUS SP. WH 8102
MFDHIRADFAIIRERDPAARGWLEIICCYPGFQALSLHRLSHSLWRSPLPLKLAARCLSQISRTLTGIEIHPGARIGRSVFIDHGMGVVIGETAEVGHRCLLYQGVTLGGTGKDHGKRHPTLAENVVVGAGAKVLGAINIGANTRIGAGSVVVRDVDADCTVVGIPGRVIHQSGVRINPLAHSALPDAEANVIRNLMERIDELESTVSNLQRCLKEVAEGRQLRDVCRGESQSLKDREILEFLGENTG

SEQ ID NO: 17614 - protein, 332 aa, SYNECHOCOCCUS SP. WH 8102
MAPAAATASKPATSARSVSVDVDLVRSYLRDIGRVPLLTHEQEITLGRQVQDLMDIEAMQTELESRDGDKPSRDKLAKASGLTPLQLKRKLQHGRRAKERMVAANLRLVVSVAKKYTKRNMELLDLIQEGTIGLVRGVEKFDPTRGYKFSTYAYWWIRQGITRAIAEKSRTIRLPIHITEMLNKLKKGQRELSQELGRTPTITELAQYVELPEDDVKDLMCRARQPVSLEMKVGDGDDTELLELLAGDADLPSDQVEEDCMKGDLRSLLGQLPHLQEQVLRMRYGMDGEDPMSLTGIGRILGMSRDRVRNLERDGLAGLRRISDQVEAYVAS

SEQ ID NO: 17615 - protein, 476 aa, SYNECHOCOCCUS SP. WH 8102
MVAAPTTATELKLGVDCVIADINQAAFGRKELDIAETEMPGLMALREKYGTEKPLKGARIAGSLHMTIQTACLIETLVELGAEVRWASCNIFSTQDHAAAAIAAQNIPVFAVKGETLEEYWEYTHRILEWGDGGSPNMILDDGGDATGLVMLGSKAEQDITVLDNPSNEEETFLFASIKKKLAQDPTFYSRTKAEIQGVTEETTTGVARLYKMQKSGELPFPAINVNDSVTKSKFDNLYGCRESLVDSIKRATDVMVAGKQALVMGYGDVGKGSAQSLRGLGATVCIAEVDPICALQAAMEGYRVVRLEDVVEEMDIFVTATGNYQVIRNEHLEKMKDEAIVCNIGHFDNEIDVASLKGYEWDNIKPQVDHITLPSGNRIILLAEGRLVNLGCATGHPSFVMSNSFTNQVLAQIELFTKGNEYGKEVYVLPKHLDEMVARLHLDRIGAKLTELSKDQADYINVPVEGPYKPDHYRY

SEQ ID NO: 17616 - protein, 489 aa, SYNECHOCOCCUS SP. WH 8102
MTVAPARPYNRSDWASSFVNVDEELTDVALTPVRGVVPAELQGTFYRNGPGRLERDGQRVHHPFDGDGMIAAMRFDNGRVQLTNRFVRTEGWLAEEKADKVLYRGVFGSQKPGGRLANAFDLRLKNIANTNVVRLGDQLLALWEAAEPHALDPQSLETRGLSRLDGVLKKGEAFSAHPRFDPGHNGRPSMVTFGVKTGPRSTIRLMEFATEGPDAGTLLHDRSDSFPGFAFLHDFAITPNWAVFLQNAIAFNPLPFVTGEKGAAQCLQSKPGGKGRFWLIPRDSGEFAGQKPRILEAPEGFVFHHLNAFEDGDHVVVESIVYDDFPSIGPDDDFAEVDFDTVPEGILHRCRLDLSREIVNTERISERTCEFAMVNPERQGLSAQFAWMAVAERETGNDPLQAVQKLDLSSGATHTWSAAPRGFVSEPLMVRRPGAEAEDDGWVLDLVWNGARRASDLVILNARDLSEVAVLELPLAVPHGLHGSWAAEL

SEQ ID NO: 17617 - protein, 515 aa, SYNECHOCOCCUS SP. WH 8102
MTIQSSSQRSWWRQPPLWVGATPLLIFLVVSAIDLALAKQFTDNGKAVVSTALGGLWQWMVLLVFLIAVVIAISPVGKLRLGGAEAKPSLKLFDWCAVLICTLLAGGGVFWSAAEPLYHFQTPSPVFDGIQGGTAEAVDPALAVSFLHWGFLAWALVATTTTITFSILERRGEPLRPRTLLVNVVPRGWVDGPIGHLADGLSVVAAIAGTVGPLGFLSLQLSNAAGQLPWLSDSAGLQSLVVVLLTAVFASSTVSGIQKGIKWLSELNVWLTLTMAAGLLLLGPGLWLIQHFFSGFLTYLIHLPRMALTPNVAPGNWINGWTVFYWGWFLGYAPLMGLFTAGVSRGRSIRELVLAVAILCPIVTNIWFTLLGGTGLQLELAGAGISEALARNGAAAALLAILSQLPLAGLLIPIGLVLVVLFMCTSADSMSYAAAMVVSGRNEPPAPLRLFWALMIGSLTLVLLRIGSGLGDSTSIDALQAFIVITAVPVTPLVLATLWSAPRLAWKEAQREGLN

SEQ ID NO: 17618 - protein, 488 aa, SYNECHOCOCCUS SP. WH 8102
MRSRSPCWRDDWTMTTTRRHLQGCRTGICSGPWPFIALNSRPPTCIWSIRNLLMRTEVSTPLKGRRLLVAVSGSIAAVKTPLLVSALVKAGAEVRCLVTPSAAKLVSPLALATLSRHRCYTENVEWDSSCSRPLHIELAEWAELVLLAPLSATSLSRWSQGSADGLLASVLLACECPVLPAIAMNTAMWSHPAVQRNWQIVQTFPGVVPLMPQPGLLACDRLGEGRMADPMLIELAASSLFSRCDAGPVATQDWSGRRLLVSAGPTVEPIDQARLITNRSSGAMGVLLAQAARLRGAEVVLVHGPLQVPEPWLESLHCHPVSSAAEMQAVLEQQQPGVDAIAMAAAIADLRRDATANGSADGKVSKANLAVQLTDGWELVPDLLQGLAARRPAGQLILGFAALTGDDNVLRRIGEEKRLRKGCDLLLVNPIDRPGQGFSMPYNGGWLLGDGWTKQLPVTGKLQLAHQLLDTLLDVSQQVPSSPVPAGQ

SEQ ID NO: 17619 - protein, 112 aa, SYNECHOCOCCUS SP. WH 8102
MKKVEAIIRPFKLEDVKVALVEAGIIGMTVSEVRGFGRQKGQVERYRGSEFTVEFLQKLKIDVVVDDERVDDVVKAIADAARTGEIGDGKIFISSVDSVVRIRTGDRDSSAL

SEQ ID NO: 17620 - protein, 414 aa, SYNECHOCOCCUS SP. WH 8102
MKAISVLGSTGSIGTQTLQIAEEFPEQFRVVALTAGQNLDLLVQQIQRHQPELVALANADLLPELQQRLDALGTDRKRPQLVGGPDGLNIAASWESADLVVTGIVGCAGLLPTLAAVRAGKDLALANKETLIAAGPVVLPELKKSGSRLLPADSEHSAIFQCLQGTPWAENARLSTGVPTPGLRRIQLTASGGAFRDWKAEDLENATVADATSHPNWSMGRKITVDSASLMNKGLEVIEAHYLFGLDYDHIEIVIHPQSIIHSMIELADSSVLAQLGWPDMKLPILYCLSWPSRLETPWRRLDLTEVGQLSFRAPDPAKYPCMQLAYAAGRAGGTMPAVMNAANEEAVAQFLEEKIHFLDIPVVIEAACERHKADLIAHPQLEDVLAVDQWARMAVREQVKRGTTRVPLAALAA

SEQ ID NO: 17621 - protein, 387 aa, SYNECHOCOCCUS SP. WH 8102
MDIQLGRSKTVRRAYGIDEIALVPGGRTVDPEVTDTRWTLGGIERDIPIIASAMDGVVDVDMAVRLSNLGALGVLNLEGVQTRYDDPNEVLDRIAAVGKDEFVPLMQEIYSQPVQESLIRKRIADIKAKGGIAAVSGTPVAALRFGKAIAEAGADLFFVQATVVSTNHIGPEGQDTLDLEALCRDMGVPVVIGNCVTYDVALQLMRAGAAGVMVGIGPGAACTSRGVLGVGIPQATAVADCAAARADYEKETGRYVPIVADGGIVTGGDICKCIACGADAVMIGSPIARAEEAPGRGFHWGMATPSPVLPRGTRINVGSTGSIERILRGPAKLDDGTHNLLGCLKTSMGTLGARTIQDMQNVEVVVAPSLLTEGKVYQKAQHLGMGK

SEQ ID NO: 17622 - protein, 455 aa, SYNECHOCOCCUS SP. WH 8102
MAPLFGRPMHPTWTEQWWPISYLQDLDPQRPNRFTLLERDLVIWWDQSGESWRVFPDVCPHRLVPLSEGRINDAGQLECPYHGWSFDGDGQCRQIPQALENTQPDSRRSRCASLPTASAQGLLFVWMGSPDSADPEQLPLVPALEENPDSWTVQDTFRDLPMDAVTLLENVLDVSHVPFTHHKTVGKRENAAPVEATITAEDASGFKAYWEEGPRRGKLGAQSTTFLAPQLMWHDLTAKGFGRILTVVYAVPIRRGECRLFARFPFQFQSALPRLLIGLRPRWLQHIGNHKVLEDDQVFLHWQERTLEAAGGSAAAERAFFLPTAADVYVAALHRWLNHNGGEPFAGQPLPNRQPTTALMDRYVSHTIHCRSCSTALIWIRRAQPVCWGLLWLGAILIGINGGWGLISIGLIVSAGGALGLRQTKRWERGLLAGDGQAPRNQPKSLRRVPLSDGR

SEQ ID NO: 17623 - protein, 131 aa, SYNECHOCOCCUS SP. WH 8102
MRLPCNVITFRLDPRLSPSFGTGSCTRAHPTVPRSMTIYIGNLSFQAEQEHLFDLFSEYGEVKNCSLPLDRETGRKRGFAFVEMVNDEDEQKAIDDLQEVEWMGRMIRVSKATPRERSGGPRGGGGGGYRG

SEQ ID NO: 17624 - protein, 459 aa, SYNECHOCOCCUS SP. WH 8102
MTQAFASQKPYETERDTASPNRNLAPVTTCLDERDRLMVGGCLLSDLAQRYGTPLYVLDEDTVRGTCRAYRDALKQHYPGPSLPIYASKANSSLLVSSIAASEGLGLDAVSAGELLTAFQGGMPGERMVLHGNNKNDEELLLAYNNDVTIVVDNQHDLERLAELVPAGGAPARLMLRFTPGIECHTHEYIQTGHLDSKFGFDPDLLESVLRQLVGKPWAKLTGLHAHIGSQIFELEPHRDLAAVMADALKLARSLGHPVEDLNVGGGLGIRYVASDDPPTIEQWVKVVADAVTAACRDRQLELPRLLCEPGRSLVATAGVTLYAVGSRKTIPGVRTYVAIDGGMSDNPRPITYQSLYTCCLADRPLAPAEETVNLVGKHCESGDVLLKDLPLPTTQSGDIVAVFATGAYNASMSSNYNRIPRPAAVVVQSGSSELFQKREQPDDLLRYDVLPERFRALP

SEQ ID NO: 17625 - protein, 327 aa, SYNECHOCOCCUS SP. WH 8102
MAGTLLFNALREAIDEEMARDPYVCVMGEDVGHYGGSYKVTKDLCEKYGDLRVLDTPIAENGFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPEGEFTCALDQADLVQEGSDVTILTYSRMRHHCLKAVEQLEADGISVELIDLISLKPFDMETIGRSIRKTHRVIVVEECMKTGGIGAELIALITEQCFDDLDARPVRLSSQDIPTPYNGSLENLTIIQPHQIVEAAQQMVRQGV

SEQ ID NO: 17626 - protein, 334 aa, SYNECHOCOCCUS SP. WH 8102
MDQTLIQEILEVVEQAAIASAKLSGKGLKNEADAAAVEAMRKRMGQIQMQGRIVIGEGERDEAPMLYIGEEVGSGTGPGVDFAVDPCEGTNLCAFNQRGSMAVLAASDRGGLFNAPDFYMKKLAAPPAAKGKVDIRKSATENIKILSECLGLAVDELTIVVMDRARHKDLIAEIRATGARIQPISDGDVQAAIACGFAGTGTHCLMGIGAAPEGVISAAAMRALGGHFQGQLVYDPAVAQTSEWADMTKEGNLARLAEMGITDPDKVYEAEELACGEHVCFAGSGITDGLLFHGVKFERDCTRTSSLVISNLDNTCRFTNTVHIKDGAQSIALS

SEQ ID NO: 17627 - protein, 1209 aa, SYNECHOCOCCUS SP. WH 8102
MVVAQASRQLTNSRFLDHLNGPERPVLVFDGATGTSLQGLDLTAEDFGGPELEGCNENLAVTKPEAVKAVHRQFLEVGCDVIETDTFGAASIVLAEYGLEDKAFELNKRAAELAREMADEFSTPDKPRFVAGSMGPTTKLPTLGHIDFDTMRDSFREQAEGLIAGDVDLFIVETCQDVLQIKAALQGIEEAFEASGERRALMVSVTMETTGTMLVGTDIAAVVSILEPFPIDILGLNCATGPEQMKEHIRYLSEHSPFTVSCIPNAGLPENVGGVAHYRLTPVELKMQLMHFVEDLGVQVIGGCCGTTPSHIGSLAELAAELKPALRSSRHDAASDANVRPALNYEPAAASIYGVTPYQQDNSFLIIGERLNASGSRKVRELLAEEDWDGLVSVARGQVKENAHVLDVNVDYVGRDGEQDMHQLVSRLVTNVNLPLMLDSTEWQKMEAGLKVAGGKCILNSTNYEDGDERFFKVLELARRYGAGVVVGTIDEDGMARTAEKKFAIAQRAYRDALEFGIPAHEIFYDPLALPISTGIEEDRLNGKATVDSIRMIRENLPGVHVVLGVSNVSFGLSPAARITLNSVFLHDCCEAGMDAAIVSPAKILPLIKITEEHQTVCRDLINDNRRFDDGICVYDPLTELTKLFEGVSAKEARASGPSLADLPIEERLKQHIIDGERIGLEPSLDEALQAYPPLQIINTFLLDGMKVVGELFGSGQMQLPFVLQSAETMKSAVAYLEPHMETAEGESTSKGKFLIATVKGDVHDIGKNLVDIILTNNGYEVVNLGIKQSCEAIVEAQHEHQADCIAMSGLLVKSTAFMKDNLKAFNDAGIDVPVILGGAALTPRFVQKDCREVYNGKVIYGRDAFADLRFMDALMDAKGNDNWNNLEGFITDVPSGVGLDEETESSTVERSTAEEKSQQDAPSPQLPVTTVRSEAVPAEPTPTAPFLGSVVITEADVDIEEVFGFLDRNALFAGQWQLRKVQQQSRDEYDAMLKEKAEPVLQQWVDRCLQESLLTPRAAYGYFPVGRDGNALRVFDASGETELGRFDLPRQRSGNRYCIADFFQDMTADGRPGDVLPMQAVTMGDKASEVAQELFKGDQYSDYLYFHGLAVQMAEAMAEWVHARIRRELGFADPDGMPLRDVLAQRYRGSRYSFGYPACPNVADSRQQLSWLGADRIGLSMDASDQLSPEQSTTALVALHSKARYFSA

SEQ ID NO: 17628 - protein, 643 aa, SYNECHOCOCCUS SP. WH 8102
MHLGDLTHPNELHGLKLSELEDVARQIRDRHLQVVSTSGGHLGPGLGVVELTLALYQTLDLDRDRVIWDVGHQAYPHKLITGRFNDFHTLRQQNGVAGYLKRSESNFDHFGAGHASTSISAALGMAMARDNRGEDFKCVAVIGDGALTGGMALEAINHAGHLPETPLLVVLNDNDMSISPPVGALSNVLNRARLSPPMQFLSGSVEESVRHLPFMGGELPAELNRLKGSMRRLAVPKVGAVFEELGFTYMGPIDGHDIGEMMRTFQAAHRDGGPVLVHVVTKKGKGYPYAEADQVGYHAQSAFDLTTGKAIPSKKPKPASYSKVFGQTLVKLCEQNSRVVGITAAMATGTGLDLLQKAVPNQYVDVGIAEQHAVTLAAGMACEGLRPVVAIYSTFLQRAYDQLIHDVGIQNLPVTFVLDRAGIVGADGPTHQGQYDISYMRSIPNFTVMAPKDEAELQRMLVTCLNHDGPTALRIPRGSGVGMPLMEEGWEALPIGRGELLREGDDLLIVAYGSMVHPALDTATLLEEAGLSTTVINARFLRPLDQALIHPLARRIRRVVTMEEGALAGGFGAAVLESLSDQDISIPLLRIGIPDKMVDHATPQQSKESLEMIPVQMAERIRRRFDLGGRDFAGAASVPAIQS

SEQ ID NO: 17629 - protein, 414 aa, SYNECHOCOCCUS SP. WH 8102
MTAAPLPSTGAVTGLGETLAFFRDPSFSQRRFSELGDVFETKLLAQSIVFIRGERAIGDLLKQEDCLQGWWPDSVRQLLGSKSLANRSGADHKARRRVVGQLFSSAALSRYTPAIEALVNDLANELQQAEGPIPLAARMRRFAFSVIATTVLGLEAENRDALFADFEIWTRALFSIPLALPGTPFARALAARQRLLARLKTVLQTNNNRQQGGLDLLSGGLDEAGLPLDDDDLVEQLLLLLFAGYETTASSLSCLFRALLLNPEVEQWLMQDLNNHERPSRLDATVLEVMRMTPPVGGFFRQNTQSIELADVAIPQGRVIQVVLSSSSTTNQIDLETFRPQRHLDGSFQQTLLPFGGGERVCLGKALAELEIRLMAMGLLQRVQLHLEPDQDLNLQLIPSPTPRDGLLVRATAR

SEQ ID NO: 17630 - protein, 313 aa, SYNECHOCOCCUS SP. WH 8102
MVSTAQKPTDSQRRRSSDPVSWYLATIGRIPLLTPAEEIELGNQVQAMMTLTEDGSKTFEDHELTGKQRRMLRIGRRAKERMMKANLRLVVSVAKKYQGKGLELLDLIQEGSLGLERAVEKFDPTRGYKFSTYAFWWIRQSMTRAIACQSRTIRLPVHLSERLTTIRKVSLDLAHKLGAMPSRVEIAEAMDIPLDELDSLLRQALTTSSLDAPVNGEEGRSFLGDLIADSSLDEPLDIVEQRIHHEQLGRWLSHLSEQEQHVLKLRFGLEGNERHTLAEIGRLMDVSRERVRQVELKALRKLRNLTRRLPSGI

SEQ ID NO: 17631 - protein, 334 aa, SYNECHOCOCCUS SP. WH 8102
MTRFPSTCSLDVVGIGNAIVDVLVQTDDAFLAQHGLQKGGMALIDEQQAETLYTASGPGLETSGGSVANTMVGIAQLGGRAGFIGRVRDDQLGGIFSHDIRAVGARFDTPAATTGATTARCLIYVTPDAERTMCTFLGASTQLEPEDLDLSMVRDTKVLYLEGYLWDSPAAKRAFIAAADVCREAGGQVALSLSDGFCVDRHRESFLELVNGHVDVLFANEVEIKSLYETDDFDTALKKVGGCCSVIAVTRGGEGSVVLSGDQRWDIGIFGLGELVDTTGAGDLYAGGFLHGYTQGESLGRCGQLGALCAGQIVTQLGARPQVSLRELAAAHLN

SEQ ID NO: 17632 - protein, 471 aa, SYNECHOCOCCUS SP. WH 8102
MSPAATKTAQPDIVLLANSEGEVREVKSNAETKKAPARRRSSKASAKDLTAAADELLSAADPKKAEAGKTKAKAAPKASTKKTTAKAATAKKPAAKKASAKKASSKTSAETDAAPAKAVVAKPEIVLSPEEKAKAIAAEKAAKAKALASIKIGPKGVYTEDSIRVYLQEIGRIRLLRPDEEIELARKIADLLHLEELAAQFESDNGREPDKKEWAALVEMPLIRFRRRLMLGRRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKVLSQEFGRKPTEEEIAESMEMTIEKLRFIAKSAQLPISLETPIGKEEDSRLGDFIEADIENPEQDVAKNLLREDLEGVLATLSPRERDVLRLRYGLDDGRMKTLEEIGQIFDVTRERIRQIEAKALRKLRHPNRNGVLKEYIK

SEQ ID NO: 17633 - protein, 250 aa, SYNECHOCOCCUS SP. WH 8102
MLSSASLDGQTALVTGGGRGIGKAIALALAEAGAEVVVNYANSAGAADEVVASINAAGGKAYALKANVSIEEEVDGLIKAVLERSGRLDVLVNNAGITRDGLLMRMKTSDWQAVIDLNLSGVFLCSRAVARPMLKQKSGRIINITSVVGLMGNAGQANYAAAKAGVIGLTKSTAKELASRGITVNAVAPGFIATDMTKDLDADAILKDIPLGQFGTQEQVAGAVRFLAADPAAAYITGQVLQVDGGMVMA

SEQ ID NO: 17634 - protein, 309 aa, SYNECHOCOCCUS SP. WH 8102
MAPLRLWLLMVLPFALWGTAMTAMAPLIVSGGPWFVAAFRLLPAGFVLMAWAAISGRRWSLDGRDLPWFLLFTLVDACLFQGLLACGLAETGAGLGSVLIDSQPLLVALLARVLFAESINPIGWLGLALGLAGIVCLGVPADLLGHWWLLLDPPQLLQLLQPGEGWMLLAALAMAVGTVLIRYAARHSDPVAVTAWHMLLGGCPLLLAAEWQNGWTLPPWSVADWGRMGFATFLGSALAYGLFFWFANRRDLTTFSSLGFLTPVFALATGGWLLGERLDPLQWVGALMVLVSVVCVSQRRRLWEPQPVG

SEQ ID NO: 17635 - protein, 358 aa, SYNECHOCOCCUS SP. WH 8102
MVSVEQANGVLAQIQDAGSGRAVTELSWIDQIRVEGSRVVFRLALPGFAQGQRERIAGEARQALLSLDGIDDVQIELGQPPSQGGIGQAGHGQPAERQSIPGVRQVIAVSSGKGGVGKSTVAVNLACALAQQGLSVGLLDADIYGPNAPTMLGVADRTPEVRGSGDTQRMVPIESCGVAMVSMGLLIDEHQPVIWRGPMLNGIIRQFLYQADWGERDVLVVDLPPGTGDAQLSLAQAVPMAGVVIVTTPQQVSLQDARRGLAMFRQLGIPVLGVAENMSAFIPPDRPEQRYALFGSGGGATLAADYDVPLLAQIPMEMPVQEGGDSGRPIVISRPDSASALEFQGLAERVLQQVTTTA

SEQ ID NO: 17636 - protein, 309 aa, SYNECHOCOCCUS SP. WH 8102
MLAGLLLLTGAAGATALLIWLQRDRRYHSSDSVAAAYDAWTDDQLLERLWGDHVHLGHYGNPPGSVDFRQAKEAFVHELVRWSGLDQLPRGSRVLDVGCGIGGSARILARDYGLDVLGVSISPAQIRRATELTPAGLSCRFEVMDALNLQLPDRQFDAVWTVEAGPHMPDKQRFADELLRVLRPGGCLAAADWNRRAPKDGAMNSTERWVMRQLLNQWAHPEFASISGFRANLEASPHQRGLISTGDWTLATLPSWFDSIAEGLRRPWAVLGLGPKAVLQGLRETPTLLLMHWAFATGLMQFGVFRLSR

SEQ ID NO: 17637 - protein, 430 aa, SYNECHOCOCCUS SP. WH 8102
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 17638 - protein, 240 aa, SYNECHOCOCCUS SP. WH 8102
MMTQPNLLIRPAVERFHSQRDWLDSWHTFSFAGHHDSNWMGFGPLLVINDDTIAAGEGFGMHPHRDMEIITVMVEGQINHQDSMGNAEVLRAGELQRMSAGTGIVHSEMNKGESPCRLLQIWIEPVHKGLEPSYEQRHIEVGKAWTPLLNPDPSQGAMAIDRPVRLWRAQPKQGQDLTLPEESGDTLWLQLINGSVQLEGIDGDAPDALHSGDGLGLRNQRNWTLTSQSDDADLLLFSLA

SEQ ID NO: 17639 - protein, 467 aa, SYNECHOCOCCUS SP. WH 8102
MAKGFALQFAEAVDAQQAKHHPKEPVQSIACAALAVDRGTPRRAVGTAGYSHLAQFEPCVNRADPEGIQRFCRTDDGCGEPCRQSNCSTPLPRQPRRTGETRDRRSRSTTDLLRLYLQDIGRVDLLTNEEEVTLARLVQRREALLQQQRDLATSDAAIGELYRLEELQRREANQHSHWPTKQEWARAAHLSLAELQQRIEAGYGAWAREANLEARELKTALRNGRRAKDHMIQANLRLVVAVAKKYQQRGMELLDLVQEGTLGLERAVEKFDPTRGFRFSTYAYWWIRQGMTRAIATQSRTIRLPVHVTEKLNRIKRAQQEIATNEGRIASIADLARALKLSEDTVRQTLARVPRSVSLDTRVGRDQDTQLGDLIEDGKATPEQTLTHDELHNDLEHLLDELTSREAAVLRRRFGLEDDTPQTLAQIGEALKLSRERVRQIETRALLKLRQPQRRSKVRDYIQGLDS

SEQ ID NO: 17640 - protein, 232 aa, SYNECHOCOCCUS SP. WH 8102
MLGDLWSFQGRYRTLHLTWIAFFLTFVVWFNLAPLATTVKADLGLTVGQIRTVAICNVALTIPARVLIGMLLDKFGPRITYSSILVFSAIPCLLFASAQSFNQLVVARLLLSIVGAGFVIGIRMVAEWFPPKEIGLAEGIYGGWGNFGSAFSALTMVALAGFLSFSGGFELPTGTVLNWRGAISLTGIVSAVYGLFYFFNVTDTPPARPISALRKPQAWRSPPCATSGVCSA

SEQ ID NO: 17641 - protein, 290 aa, SYNECHOCOCCUS SP. WH 8102
MRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAASNSAFFQILGVAGLIVAFFCFFFLKEPKGSFAELHEGETA

SEQ ID NO: 17642 - protein, 710 aa, SYNECHOCOCCUS SP. WH 8102
MGRGVRVLHLHLYGLFRSRDLELGRDADTGGQTLYVLDLVRSLAQRPEVDRVDVVTRLVQDRRVAADYERPLEVIAPGARILRFPFGPKRYLRKEQLWPHLEDLADQLVHHLTQPGHEVDWIHAHYADAGFVGALVSQRLGLPLVFTGHSLGREKQRRLLAGGGDRQQIEQAYAMSRRIEAEEQALTQADLVITSTQQEADLQYARYSQFRRDRVQVIPPGVDAGRFHPVSSAAEGDALDQLLSPFLRDPSKPPLLAISRAVRRKNIPALLEAFGSSSVLRDRHNLVLVLGCREDPRQMEKQQRDVFQQVFDLVDRYDLYGSVAYPKQHRRSQVPAFYRWAVQRGGLFVNPALTEPFGLTLLEAAACGLPMVATDDGGPRDIQARCENGLLVDVIDAGALQEALERAGKDASRWRRWSDNGVEAVSRHFSWDAHVCRYLGLMQAHLHQLPSVGPRPQGSPASSHRPDHLLLLDLDSTLDCPDGPSLTALRSQLERDGQRYGLGILTGRSLAAARQRYGDLHLPSPLVWISRAGSEIHLGEDLQPDHIWAQHIDTDWQRESVEAVMEDLHDLLELQSEEHQGPWKLSYLQRQPDESVLSHVRQRLRREGLSARPQRRCHWYLDVLPRLASRSEAIRHLALHWQLPLERVMVMASQQGDGELLRGLPATVVPADHDPCLVRHPQQKRVLLSGRPSLAAVLDGLSHYRFPSQR

SEQ ID NO: 17643 - protein, 1222 aa, Cytophaga hutchinsonii
MSQEHESSFQDPSRDELIQQVKELQIINANQRPEKILQEAFEKINLLVITIDQDGLIVYANEAFLEVIGWEKQRLLGENWKEFLEPGKDKNKEEHIYTLIKKQGFIDQLKRKFLSKEGDYRTIKFNVVIHHPIGNDVHLTTLIGEDITDKKKVIRALKDSNDQLQDLFENANDLIQVFDLDGKIQFVNRAWKDILQYSDEEILKLNFRDIIAKEQVGVTMEHLNNILAGKKDDKFETVFTSKNGRNIQVICSVNVRYEKEKPVSFRGIFHDNTEHMRAERAQNLYYKISTLAINSDRLDSLLDNIHKELRTIIAVNNFHVALYDRDHNYLNFPYYVDENIGPKPISMKRIVGKGLTEYSLFNEEPTFLYEEDINKLSEAGAIELLGPTPKIWLGVPLRLENRTIGVICVKSHSDRNKYKRRHVELLDFISGQIALVIERKRNEEQIIDKTARLNAIFESSSHLIWSVNRKRGLTSFNQNYANAIFRKYQKYPTIYDEGVTKEVLVLSDPEFHDSIDKKYKDAFNGQPQHFEACNTNQNGEIFWRETYLNPIFLPDGRIDEVSGISHDITEKKQWEITIQESEEKFRNIFESFQDIYYRTDLSGYITMISPSGCELSGYTQEEIIGKHISEFFTTPKQQVNLIREVLKTGRVKNYETNVNIKGGESIQSISNIRLIYNNEGKPIGVDGVARDITFLKKASQELYHAKEIAEKSLKVKENFLANMSHEIRTPMNGVIGMIDLLNETPLMEEQRKYVQTIKKSSETLLNILNDILDLSKIEAGKMQLRLAPISIEQTVEKLHALFYQQATLKNIDLLYSIDSNVPKVVLADETRLLQILSNLTSNAIKFTDQGSVRIQISLQSKKDLVNKIRVNISDTGIGIAQDKLNVLFGYFNQVDNSSSKSYGGTGLGLAISKELSKLMNGEIGVQTEANKGSVFWFTFEANESKRLVEAKVETPNAFSSEKTFKDYPKILLVDDNAINLFVASEILRKAGCEIDTAGNGLEAIQKVKENPYRMVLMDIQMPQMDGIEATAEIRKLNLAYTPPIIAMTAYSMKEDKDRFMVNGMDDYIAKPIKAESLISKVKAWLDSNAAKNGHTATQTSDETAVEIPILDLEVFEKLKSLSGAEIIDQIYKEFENESLEQIVDCKNSLAMGDFHNILNKLHTLKGVSGTLGLIELESISRLVESKLKKGDYPELAVDIEKLSEAHNRFIEHYTFILNSNSK

SEQ ID NO: 17644 - protein, 438 aa, Cytophaga hutchinsonii
MNTHKATTINLFSLKTPNMKAFHMTWMAFFLCFFGWFGIAPLMVMVRDELHLTKGEIGNIMIASVSITIFARILIGYLCDRVGPRIMYAALLILGAFPVMLIGLSNDYTSFLLFRLTIGVIGASFVVTQFHTSAMFAPNIIGTANAVTAGWGNLGGGVTQLVMPLIFAGFVGLGYSNSESWRLAMVVPGIALLIMGILYFLYTTDTPEGNLADLKKKDPNFTLKKKQSQVSFAEIFKDYRVWVLAFCYGACFGIEITIDNIAALYFKDKFNLSLEAAGLIAASFGMMNLFARALGGMLSDKIGNTKGLNGRVLVLGACILLEGIGILIFSNMEVLVFSVISMIGFALFVKMSNGATYAVVPFVNKNAVGSVAGIVGAGGNIGAVLMGFLFKSESLTYNDAFSIIGYCVLGIAVLAFTIRFVTSTEKKQVEFTAVESLA

SEQ ID NO: 17645 - protein, 338 aa, Cytophaga hutchinsonii
MTKADIRGELAKRILILDGAMGTMIQRYTLEEEDFRNDKLKNHDHPLKGNNDLLSFTRPDVIKAIHTEYLAAGADIIETNTFSGTTIAQADYRLEHMVYDINYYGAKIAREAVDEFMKKNPSSPQRYVAGAIGPTNRTASISPDVNDPGYRAVTFDELAKAYKDQAIALLEGGADLLLIETIFDTLNSKAAIYAIMELFEETGNEVPVMVSATITDASGRTLSGQTTEAFLISVSHGPLLSVGLNCALGAKELRPYLQVLAKEAPFFVSAYPNAGLPNEFGQYDETPAQMAEQITVFLEEGLVNILGGCCGSTPDHIRAMAEVAAKFAPRKLDETVEA

SEQ ID NO: 17646 - protein, 246 aa, Cytophaga hutchinsonii
MSANLKYALVTGAARGIGKAIAVKLASDGYHVLINYKSNDAEAEKTKSAIEEQGGAATLMKFDVSDRTEVNNVLAGWLEQHPDSVIEVLINNAGIRNDNLLMWMEPKDWDGVIDINLTGFYNVTKTLINQMLLNRYGRIINIVSLSGLKGVPGQMNYSAAKAGVIGATKALAQEVGKRGITVNAVAPGYIKTDMTQDINEKEAKAQIPANRFGEPEEVAELVSFLASKKASYISAEVISINGGLYS

SEQ ID NO: 17647 - protein, 148 aa, Cytophaga hutchinsonii
MLSIHSDEHFMREALKEAQKAFEKGEIPVGAVVVSNNQIISRAYNQTELLSDVTAHAEMLAITAAANHLGGKYLSDCTLFVTLEPCVMCAGALTWSQIGNVVYAAKDIRRGYSTISGLKMHPKTRVCQGPFSEESEKLLLDFFRKLRN

SEQ ID NO: 17648 - protein, 248 aa, Cytophaga hutchinsonii
MGLLSGKTALVTGASKGIGKSIAMRYAQEGANVAFTYLSSVEKGQALEKELQALGIKAKGYRSDASKYTEAEELVTSVLADFGQLDIVVNNAGITKDGLLMRMTEEQWDSVMEVNLKSVFNLTKAALKPMMKAKAGSIINMTSVVGISGNAGQTNYAASKAGIIGFTKSVAQELGSRNIRSNAIAPGFIETEMTEVLDPKVKAEWENGIPLKRAGKSEDVANACVFLASDLSTYITGQVLQVDGGMLT

SEQ ID NO: 17649 - protein, 1317 aa, Cytophaga hutchinsonii
MEEIEFLKKSLQEEIISRKQLEIELEKNKLEIEKLKKKFSNSHKEILENYIRKEQDLLSNSSRLSSLIVNLDSAILLEDENRKIVLVNQKFCDIFGIPLSPQELIGTDCSNSAQQSKIKFKNPDQFISRIEELLENKKKVLSDELQLIDGKILKRDFIPVYHNNEYLGHLWNYEDLTNYINVKKKIESLSRFPKESPNPILRCSADGMVIYANAAAKPFVSVLSTTKYNSNNNVTYDSLVSNVKASFKTRMLLKNEIRIKDRTYNVSYVPVEHEDYVNIYATDITSTKESEEKIYLLKELLNQLDEFIQVIDKEGNFVFINESSANRFQRTIEEFETLNIKNIVPSFYNNMTWEEQFDFFKQKQNFLLESTHTKPDKTSYPIESSVKYTTVHEKEYIISFSKDISERKRTEQALQDQKQFYEDILNNIPSDIAVFNTNYQYLYVNPAAIKDEETRKWIIGKTDLDYCRYRGKDDSLAIMRRKNHDILHEFKKPIEWEDVFTDKDGNVSYVLRKFHPVLDENDNIKIIIGNGINITEIKQVQEKLAKSEELYRLVIHAANDGIWDWDIASGSLYLSERWKSMLGYTDETLANHISSWEKTMHPDDLSIAKEILQNHFEKRKPYNYTLRYLHVDGSIRWIMCRGFAIRNRKGEPYRMVGSCTDVTDTQIAEEKLKENEEKLQAIFNHSHDAKFLVDPCTNKIIEFNKRTLELFETDKPDTLYTIPLTSLRKYPLTDAELADTQNQFKQLGYWNQEVLYITQKKNEFWGNIVAKTIFINKKEVILVRITDISENKKIEQELIKAKQIAEESTKAKEMFLANMSHEIRTPMNGILGMAELISRTSLDVTQKKHVQLIKNSADNLLIIINDILDIAKIESGKLTIEQIPFDICEVIKSAIQTLTYKAEEKGIDLIIHPIKLDHRVVIGDPFRLTQALLNLINNAIKFTENGSVEISGRIPHSSSTDITFEFTVKDTGIGIPQEKLDSIFEGFTQASPDTSRKYGGTGLGLTISKNLIQMQGGNIWVESVVGKGSKFIFSITYKKGDLLDVSPNNKNKINLYQLHDLKVLLAEDNEVNQYFAKTLMDEIGVKVDVANNGIEAFQFFEQNEYDIILMDIQMPYMGGIETTSKIRSHANKTKAKIPIIALTANALVGDSEKYIEAGMSDYISKPFDRETLFRKLQLHAGSNKNIFQDAKNIHLFQSDTNDAYLPNYSHLEKNFQNNTVFLKKIFTLFIESTPEIVNELKLFSEGKDYEKLQATAHKLKASVDAFKIVALHQTIRNIEKFAANKTNLDEIPDLVKSTDDILKIAQEDITKKLKQIE

SEQ ID NO: 17650 - protein, 346 aa, Cytophaga hutchinsonii
MERNLSTVKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQMNVGLNVYRLK

SEQ ID NO: 17651 - protein, 1009 aa, Cytophaga hutchinsonii
MSDYIHLIDQEHIGLTRAMQNPFPGLRAFNVDESHLFFGREGQSDEVLDKLSKNKFVGIIGASGSGKSSFMFCGVIPILYGGFLSHVGPNWHVITTRPGGCPIDNLSEALLQKDAEYLVADAEDKRLKKTITSTLLKSSSLGLIEAVRQLHLDNGNNVLIVADQFEELFRFKRTEDTNTTNESLAYINLLMEAVKDLKSNIYVVITMRSDFIGDCAQFPELTKYINESHYLIPQMVREQKRLAIEGPVAVGGAEISSRLVQQLLNDLGDNPDQLPIIQHALMRTWTFWAENHEPEEILDLRHYEAIGSMSGALSQHADEAYDELTEQQKFYCEILFKTLTEKGSDSAGIRRPTKLSTIANVAGCSEDDMAHIIDHFRIEGRSLLMPPVHVALASDSIIDISHESLMRIWTRLKKWVEEEGESAQMYIRLSDAASSYQIGKAGLWRPPDLQLALNWKQKNKPTLVWAQRYDSAFERAMVFLDTSNEAHEEEQRLKELAQKQALKRARIIALVLGIFTIMALGSLVFSILKTVEANNQRIEAEKQKGIALTQEAEAKKQTGIAEQQTLEAQRQKDFAVLAAEEAKHQQGIAEKNFNEAQKQRNIAVTYATEATKQQKIAEMQRELAVKNEKQAKQEKQRADKLRLLSIAQSMAVKSVQMEEDTMRKALLAFQAYEFYKENGGNVNQHEIYDGLYYALKNLKVKDYNALHAHKDAVRSIAYTADGKGMYTAGSDGKIFSWDMTAANPKPKTVYNTNYALGALSLSSNGTMLASGGASPNIRMVNLTKEGDAPLLLKGHKKTVLYTAFSPDNQTLVSASADSTVMIWNLSSGVPITVYRDRHNIKAVSLHPKGRVIAVANDKGETMIISLYNEFTPYLIDRGTTADYSLQYSHDGEFLAIANNSGLIKIMDVEGRRLVVALPGHKARVNEMKFSKDDSKLASASFDGTIRVWDLSELSEQPLILKDHTNWVWSMTFNAEGDKLIAGCGDNLIRIWPTSSKIMADQMCDLINET

SEQ ID NO: 17652 - protein, 856 aa, Cytophaga hutchinsonii
MNLSIRTLNIIFSISLLLLASAFIYSYLNIQGLRSANHWVNHTNKVIISLESIYSDIKNAESGVRGYALTKDASYLEQQDQSRTNIKNQLILLDSLLADNPEQHIYIDTLQKTVNDRFFLFNGLINLTNNNADQAEVLPLMQKGKASTEHIYNLVKKMKNNEGILLLQRNEKAEALDKTTPITIVFSGIFGFMVLVISYYFILADLKQRRKIANEVKIKNTLLEYAQQITQMGTFEYNVFTNTLFWSNEMYNIFELDRSVIPEINFIDSLIKEESEITHNRRKKNFQPGASYSDELKIRTVNGNEKVLISNGYVVNEENGLVVHGAIIDITPLKKAELTAREQQELMRVAKEKAESASQFKTRFLSNMSHEIRTPINAILGFTAILSKQELTEQQKKLLKNISISGELLLKLIGNILDISKIEEGKVIIESKSFHLKESIRSVLSPFQHSASEKGLQFHLIIDKSIPDYLLGDFPRISQVLVNLIGNALKFTSHGNITVSVLLTKKQDGLSFVEFVINDTGIGIQANKQDEIFESFTQANESISVKYGGSGLGLSIVQEVVHLMGGNIQVQSPAHYNERGKGYGSKFFFTLPFKLGEKGADPQAKKTAVQPFPRVLHILVADDNEMNRTLATYTLQSLGCTFEIVENGLQAIQKAAANTYDIILMDMQMPVCDGLQATRQIRLNKNTTPIVGLTANVFQEDINRCLDAGMDGHLGKPYTEEDLYHIIDKWVFKNEKNIAASVPSFSNYEFIEKLSKNDPVIFREMLEMFLNQNAQLLKIIHTAINAEDLETLSFNVHQYKSCARMLNIEKQISLIKQIEEKIEARVSLETIRTDIMQLIETGALVSKEIEQKLLIV

SEQ ID NO: 17653 - protein, 287 aa, Cytophaga hutchinsonii
MMKENINTQSLIDLLRKTHHAEWEATPSAHDAITWLGDLVQFLFPSNHLPKQSSYEGILKKNQIDLENILLSYVEAHKLNIEQAVSSFYNGLGNLYQNLREDASKINEFDPAATSVNEVIVSYPGFYAITVYRIAHKLAELNIPILPRILSEYAHGKTGIDIHPNASIDVPFVIDHGTGIVIGATSVIGKNVCIYQGVTLGALHVSKIMAEIKRHPTVEDNVVIYARTTILGGNTVIGKNSIIGGSVFITKSIEPDSQVFNTHQLRISNIHARTFDENRGVVLKKQS

SEQ ID NO: 17654 - protein, 397 aa, Cytophaga hutchinsonii
MLYIGFSYGFTPLISQADGEGDELKIARILKHALVLNLVIGFFLTGLLYLCIYAIPFMHQPAHIVQPATEFFAIIALSMIPVIIFQVFKQFIEGLGNTKQAMVVSILGNVVNIVLIVILVYGWYGLPKLGLNGIAYATLIARIFMAVTMVLFFLFTKNYAHYRSAYKRTKLEWHYFVDVFNKSYPVGLQMSFESGAFSLAAIFVGTFGTAQISAHQIALNLASVTYMVATGIAAAATVRVGYEYGRKEKTELQIAGRTAIILVVALMSTTALMFTLLHQVLPSFYTEDIEVIGIAGSLLWMVAFFQLSDGIQVVSMGSLRGMGDVVVPSSVAFMAYWVLGLPLGAFLAFVLKWEVYGIWVGLTVGLVFASIVLLVRFLKKSKRVVFEEDAKSVMLKA

SEQ ID NO: 17655 - protein, 290 aa, Cytophaga hutchinsonii
MSNIQLIIEERSANIGNFMVGRLLPFREKRMVGPFAFIDHMGPAYLKANENLDIPPHPHIGLSTLTYLFEGSIMHRDSLGTEIEIQPGAVNWMTAGKGIAHSERTPDTVRAISKTLHGLQIWVALPKALESMEPAFMHVEASDIPHWKEDGVQYKLIAGEAFGKKSPVQVYSPLFMIEIKTTDPKTISIGDSLFGESAMYILEGSVSSEGNTFEPKHILIAKDSKLCSFEMDANTTVYIFGGEAFPEERFIYWNFVASEKQTIEKAKADWLAQRFPAVPNETEFVPLPQY

SEQ ID NO: 17656 - protein, 112 aa, Cytophaga hutchinsonii
MKKIEAVIRTSKFLELKEALNKMGIQFFTYADVKGVGHQATEKAVYRGVQYDLGYIARTKLDIIVSEKVEEVIKCIVDTCKTGELGDGKIFVSNIEECVRIRTGERGVPALQ

SEQ ID NO: 17657 - protein, 636 aa, Cytophaga hutchinsonii
MIQPGELLRTIHSPEELRKLDETQLIQVSEELRQFIVDNVSVYGGHFAASLGVVELTVALHYVFNTPVDQLVWDVGHQAYGHKILTGRMENFHTNRTYNGLSGFPKRSESPYDTFGVGHSSTSISAALGMAVASQYQKDNRQHIAVIGDGALTGGMAFEAMNHAGVTNSNLLIVLNDNCMAIDPNVGALKDYLVDITTSRTYNRVRDEVWNMLGKISKFGPNAQAIASKVESGLKASLLKQSNLFESLHIRYFGPVDGHDLNHLVQVLNDLKDIPGPKILHTLTVKGKGYALAEKDQVKWHAPGKFDKVTGQIHVKTYDTPQAPKYQDVFGNTIIELAEKNDKIMGITPAMPSGCSLNLMMEKMPDRAFDVGIAEQHAVTFSAGLATQGLIPFCNIYSTFMQRAYDQVIHDVCIQNLHVIFCLDRAGFAGVDGPTHHGAYDLAFFRCIPNLVVSAPMNEQELRNLMYTAQLQKNKGPFSIRYPRGQGVMPNWKTPFEEITIGKGRKVSDGDDVAILSIGHIGNYVIEAKALLREEELSPAHFDMRFVKPIDEEMLHLVFKKFKKIITVEDGCLMGGFGSAVLEFMADNNYAAQVIRLGIPDRIVEHGEQAELHKECGFDPQSIARTVRNLSGVVLK

SEQ ID NO: 17658 - protein, 291 aa, Cytophaga hutchinsonii
MEDTMDSATEEILREPQQQERPGKETDMKPRPQSENNAPGNNKLKNKIALITGGDSGIGKAVALLFAKEGADVAIVYLNEHADALETQSIINAKYSKQCLLLPGDISNESFCSKVIDQVIETFGRIDILVNNAGIHYECEDLAELVTEKMIATFETNVYSMFWITKYALPHLKAGSSIINSSSVTAYRGSKHLIDYAATKGAIVSFTRSLSSSLVDKGIRVNGVAPGPIWTPLIPSSFEEDRVAKHGLNAPMHRAGEPSEVAPSYLFLASEDASYITGQFLHPNGGEIING

SEQ ID NO: 17659 - protein, 490 aa, Cytophaga hutchinsonii
MLSDSSKFAGEALTYDDVLLIPAYSEVLPRDTDTSTYLTKTIKLNIPLVSAAMDTVTEYEMAIAMAHEGGLGFIHKNMSIEKQAEQVRRVKRSESGMIMDPIVLQEDALLKDALKIMKDFKIGGIPVLDKNKRLVGILTNRDLRFQKNVNKPISKIMTVTNLVTAPEGIDLAKAEEILQKYKIEKLPIVDKQGKLKGLITYRDILKKKDRPMACKDEFGRLRVGAAVGATADVMDRIEALVKAGVDVVSIDTAHGHSKNVIQAVRDIKRKFKNLQLIAGNVATGEAAKALADAGADAVKVGIGPGSICTTRIIAGVGVPQLYAVYECAKALQKYKIPVIADGGIRFSGDVCKAIAAGASTIMIGSLVAGTEEAPGEVIIYEGRKFKTYRGMGSLEAMEDGSKDRYFQDAEEDSKKLVPEGIVGRIAYKGKAYEVVYQLIGGLKACMGYCGAKDIDAMKKAKFVKITAAGVKESHPHDVQITREAPNYSSR

SEQ ID NO: 17660 - protein, 577 aa, Cytophaga hutchinsonii
MKIKTKLTLGVGLLFLLIILLSAVGTRYINALKSDTENILVANYNSLEYARFMLSSLEEQSSQAISTFENNLTKQEANLTETGEKNITTEIRNQYNRYKINRSDSTLLPQIRHGIYKIMDLNMQGIQRKSEIAKSTANKAIFWIAVTGTLCFVIAFTLLINLPSNIANPIKELTESIQQIAEKKYSERVHFEGHNEFGELAKSFNTMAEKLEEYNSSNLAKLMMEKKRIESLINNMYDPVIGLDENLKILFVNEQAIKIIGISQEELIGHYTQELAIKNDLVRTLVQDLMVAENTPSNKAIPIKIYSNNKEGYFEKEILHISVTPTGEQVKQLIGHVIILRNITEYKELDFAKTNFIATVSHEFKTPISSIKMSLQLLENKQIGMLNEEQQNLLESIKEDANRLLKITGELLNMTQVESGNIQLSILPNDPKEILFYAINATKTQAEQKNISLKITAPDNIPHVLADNEKTAWVLINLLSNAIRYSYDNSTIQLAIASRDNKVTISVKDTGQGIASQYKDKIFNRYFRVPGTKKEGTGLGLAISKEFIEAQGGSISVDSEFGSGSTFTIGLLVAGGQ

SEQ ID NO: 17661 - protein, 318 aa, Cytophaga hutchinsonii
MKKYPFTEKKDTRSGFGDGMTELGKTNPNVVALCADLTPSLKLNDFEKQNPERFFQIGIAEANMISMAAGMTIGGKIPFTATFANFSTGRVYDQIRQSVAYSDKNVKICASHAGLTLGEDGATHQILEDIGLMKMLPGMTVINPCDYNQTKAATIAIADHKGPVYLRFGRPALPVFTDPNQKFEIGKAWMVNEGTDVTIIATGHMVWEAILAGQQLEELGISAEIINIHTIKPIDEEAILKSVGKTGCVVTAEEHNILGGLGESVARVLASNLPTPIEFVAVKDTFGESGTPDELMEKYGLKDRHIVEAVQRVIKKKK

SEQ ID NO: 17662 - protein, 143 aa, Cytophaga hutchinsonii
MNIFVGSLPFSLEENELREFFEEYGEVSSVKIISDKFTGRSKGFGFVEMPDDAAAQKAIDELNGAEVNGRTIVVNKSEEKKDGPRRSGFSGGGNRGGGGGYSGGGNGGGGYGGNRSGGGGYGGGGNSRGFGGSGTGRNSRGDR

SEQ ID NO: 17663 - protein, 106 aa, Cytophaga hutchinsonii
MMVEISAVIRAGKFDEVRDALHAIGVEFFTFYDVKGVTFTKEQKGSYRGTTIYDASSISRRKIDIVVPEIDAAEVVDCIKKAATTGVAGDGKIFVKEVKTSVRISI

SEQ ID NO: 17664 - protein, 113 aa, Cytophaga hutchinsonii
MKKIEAIVKPSKLKAIQAGLIKIGIPCMTVVPVKGVGLQQGFPEIYRGTEKSIVLLSKVMIICVVSDENLEKCIDVIIETGSEGKVGDGKIFVYDVLDAIRMRTRTRGDDAIR

SEQ ID NO: 17665 - protein, 391 aa, Cytophaga hutchinsonii
MKDPQKKYIAILGSTGSIGTQALEVIRNNKDRFVVEVLTAENNAALLIEQAVEFRPNVVVIGNEGLYSNVQHALEPLDIKVYCGVKALASVVEMEDIDVVLTALVGYAGLIPTIHAIKAGKHIALANKETLVVAGDIVTALARQHRVAILPVDSEHSAIFQCLPGEGMNEIEKIILTASGGPFRGMKRADLEHVTKKQALKHPNWSMGAKITIDSASLMNKGLEVIEAKWLFGLEADQIDVVVHPQSIIHSMVQFQDGSIKAQMGLPDMKLPIQYALAFPERLKSDYPRFDFTQYPALTFDKPDTETFHNLSLAYDALRKGGNMACILNAANEIAVEKFLQDEIAFLEMPDLIAECMAKVPYIVVPTLDDYIQTDTQTRALARAYTQVKVK

SEQ ID NO: 17666 - protein, 264 aa, Cytophaga hutchinsonii
MTYRSVYIIMLLMTVSSAVAAQQPGRVYPAIPAMDGEGAEVLRLFPGKFVKHADPFILLDDFTVSPPVGFPTHKHIGFEAITYMIEGSFVHKDNIGNNDTVYAGQAQRFTAGSGLLHSEMPGASAVNRGLQLWVNIPAAAKAAEPTYQLVETLPVESADSTRIVRTIAGKGSVLQVHCGCDLSYLDIQLKKNTIVLTPESGYTSFVYVLDGMVQIHEHVVYAGNFYFLESGVPNTIIGDGVPRFVYLSAKPLNQKIKQRGPYVY

SEQ ID NO: 17667 - protein, 401 aa, Cytophaga hutchinsonii
MTLRGRKILLAVCGSIAAYKSALIVRILKKQGAEVRVIMTPSALTFITPLTLSTLSENPVAHAFTEGDQGVWNNHVELALWADVMLIAPASENTIGKMASGICDNLVLSVYFSAKCPVYVCPAMDLDMYKHVTTQQNLVRLQQHGVRLIDAESGELASGLIGQGRLAEPENIVEIIEADFGTKAPLLHKKILITAGPTYEALDPVRFIGNHSSGKMGLALVKEAWKMGAEVTLVCGPVNEELLRMLPASVQLHKIVSGQQMFDVVQAEIEKQDVAIFAAAVADYTPEQVSDIKIKKAEDSFTIRLKKNPDIAKTCGEKKKDHQLFVGFALETNDEETHALKKLQSKNLDAIVLNSLNDTGAGFAGDTNKITIYAKDKEPFHSQLLSKEYIAKDILNYLLLL

SEQ ID NO: 17668 - protein, 806 aa, Cytophaga hutchinsonii
MKWRENQVQIKLTLLLTIGIIGIFSICLFAHRAFSSLRETVKEFQYPDQKIKHLSSLSDQTNNADQFLRLYTITKKNIYIDKYNKSVDSINQLFETYRKYIEGDTFRIHQIDTIQMWWNKKVLENTEILKLNNDKPDILVIGTLVDKSKDTTLYSTQIYNEKTIHDSLVIIKKILVNNEQRTGLLRKVKRVFEKKEDIDVDVVADSADNLNVQLYSYTYKEQDTIFTDTLVKLESFNKSDKAAVKNVLQEKMEYDTIVNLKRLAIIEKDFIIRNRIAKQIKSIQKQEQEDAVSNIAAIQNISTKTINKIFWIFLFILFTCVCLYLLLVLDTYRIKRYEEKLILEKQNYQNLANNRSQFLSMMAHELRTPLQSIIGFSDLLHEQNKSAADKSFHYSEIIKNSSSHLLQTINLLLDRSKIDAGKLELENIPFNVTECLHSVFESLSLQAQDKKINYLYQSDIPNDLIVISDAFRLKQVLYNLLSNAIKFTSEGTVQLRTSTFLDSEKYTQIRFEISDTGIGIPSNKIDQLFDEYNQLNNSIGRLFGGTGLGLVITKKILGLFSSEITVHSEEKKGTQFSFDILFEKSAQSVQQLNQIHKHIDASVLLIDDDNYNLLYTHQLLSKYAAQVYVAGSIEEAKLILEKESPDIVLCDLYIDQSLGTDIIPFIKPAAKIIFMSADHERLLKIKEANQLTLPKPYSIEILLNTISNLPLQTDKVLSPDPSLDYIHIDSFKEKITLIGQAIEQNDVKMMESVLHQIKTTFGYLQQWEEIKHIQKIENMYLLYKDDAIFQSSVAELYAQWNKFYSN

SEQ ID NO: 17669 - protein, 283 aa, Cytophaga hutchinsonii
MLDEFGAKRIIDTPISELGFAGIGVGAAMNGLRPIIEFMTFNFSLVAIDQIINGAAKIMSMSGGQYTAPIVFRGPTGNAGQLSSQHSQNFENWFANTPGLKVVVPANPYDAKGLLKSAIRDNDPVIFMESEVMYGDKGPVPEGEYLLPIGVADVKREGTDVTLVSYGKILKVALQAAEDLAKEGVSAEVIDLRTVRPIDFEAIVHSVKKTNRLVIVEETWPLASISSEISYHVQRYAFDHLDSPILRVTSRDLPLPYAPTLIQEILPNVKRTIDAVKTVMYQK

SEQ ID NO: 17670 - protein, 338 aa, Cytophaga hutchinsonii
MEGTPIIQIKPLGFPWETLDPFIFCVHHRDDFPKGNDNMGPSVSLAGRTIGQDFSGKEGWNMYHGKTMPGFPYHPHRGFETVTVVKEGVIDHTDSLGAAGRFSGGDVQWMTAGKGVLHSEMFPLVHSDKGNPMELFQIWLNLPKRSKFVQPHFKMLWKENIPVLNEMDSNGNKTEVNVIAGNLKSFHGPEPTPDSWAAEQGNDVSILTIKLDAHATWTLPKTDAGVNRMLYFYKGSSMKIAATDISVYHSVQLKSDIDVILQAGVEDCYLLLLQGKPMNEPVVQYGPFVMNTEEEIREAFAEYQKTQFGGWPWPNHEQAHARESGRFALHADGREEKM

SEQ ID NO: 17671 - protein, 427 aa, Cytophaga hutchinsonii
MSLIEEIVARQIFDSRGNPTIEVDVITENGLIGRAAVPSGASTGKHEAVELRDNDKSIYMGKSVLKAVANVNDIIAPELIGSHVFEQNLIDRLMIDLDGTANKGKLGANAILGVSLALAKAAAQEAGLPLYRYVGGVSANTLPVPMMNIINGGSHADNSIDFQEFMIMPTGAKSFTEAMRMGSEIFHNLAKVLKSKGMSTNVGDEGGFAPNIASNEDALITVIQAIEAAGYRPGEDVMIAFDAASSEFYDSETKLYHFKKSTGDKLTSSQMASYWADLVKRYPIVSIEDGMDEDDWSGWAELTKLVGDKVQLVGDDLFVTNVSRLQQGIDQGIANSILVKVNQIGSLTETISAVNLAKRNSYTSVMSHRSGETEDNTIADLAVALNCGQIKTGSCSRSDRMAKYNQLLRIEEELGEAAYFPGKNMRK

SEQ ID NO: 17672 - protein, 435 aa, Cytophaga hutchinsonii
MVDTFVKHKVKDISLAAWGRKEIELAEAEMPGLMSIRKEFGPSKPLKGARVAGCLHMTIQTAVLIETLIELGAEVTWSSCNIFSTQDHAAAAIAAAGISVYAWKGMNEEEFDWCIEQTLFFGEDRKPLNMILDDGGDLTNMVLDRFPELVKDIRGISEETTTGVLRLKDRERNGSLVLPAININDSVTKSKFDNKYGCKESLVDSIRRATDVMMAGKVAVVAGYGDVGKGSAASLRGAGARVIVTEIDPICALQAAMDGYEVKKMADAVKRADIVVTATGNKNIITGEHFKAMRDKVIVCNIGHFDNEIDMAWLNKTYGSTKVTVKPQVDIYNVDGHDVIILAEGRLVNLGCATGHPSFVMSSSFSNQVIAQLELWENSSKYENKVYTLPKSLDEKVARLHLSKIDVELDILSADQAAYIGVTVDGPYKNDEYRY

SEQ ID NO: 17673 - protein, 293 aa, Cytophaga hutchinsonii
MERAIVTTYGGINSKVGELLVNRLVPNRYVEAIGPFVFLDHLYPTVQQPKNPSAPNGQDAHPHRGIATFSYIFSGALEHFDSNGHHGIVEAGGAQWMNAGNGVIHDEHFSPDFQAKGGIMHGLQFWINLPAVNKAEAPDYMAVQPHDIPEVTLPNEAGVMRIVIGACGDNRSPVKTFSEQFMYHIKLNPKSSFTCETKAALEYAAFVPSEEATINGQKVSKSELIVFDKDGGSITFINNNITEITIILFGGEPYTEDIYAEGPFVMNNRLEIAHAYRDFFNGKYGTINYENKH

SEQ ID NO: 17674 - protein, 297 aa, Cytophaga hutchinsonii
MNKHFLETLLQKHQQAGTFPSTSDICRLVTRILLVLFPEQTQAKYKDVADVEIQMGVYQKELTRLLGSMQKDLPAPANELSDAFMNELSVIYDKLLLDIQAILNGDPAARSEFEVIRAYPGFYAIAFYRMAHALYKLNIPLMPRIIMEYAHSKTGIDIHPGATIGKNFYIDHGTGIVIGETAHIGDNVKVYQGVTLGALSVSKDKADTKRHPTIEDNVIIYSGATILGGKTVVGHDSIIGGNVWLTESVQPFTRVYHKAQIEVIIKNADPSLNETENNEEAIRKMKKAESENTKKNS

SEQ ID NO: 17675 - protein, 379 aa, Cytophaga hutchinsonii
MKIGIVCYPTFGGSGVVATELGKALAELGNPIHFITYSQPHRLDFFHENIFYHEVTVKSYPLFEFAPYEVILASKIVDVVKHEKLDLLHVHYAIPHASAAFMAREILKTQGIYIPIITTLHGTDITLVGKDPSFAPVVAFCINQSDGVTAVSEDLKKDTFEHFDIHREIEAIPNFIDVSRFRKQKKDHFKKAICPNDEKLIVHTSNFRKVKRVEDVVSVFNIVRQTVPSKLLLVGDGPERVLIEGMCRELGICNDVRFLGKLDAVEEVLSVADLFIMPSEKESFGLAALEAMACEVPVISSNAGGLPELNIQGKTGFLSNVGDVKEMAKNAIFILDNANLQEFRKNALERAKEFDSNHIVPKYLEYYQQVLDKSHSFVK

SEQ ID NO: 17676 - protein, 527 aa, Cytophaga hutchinsonii
MHTILPFLLAMIAVIVLLNMWATKLQIAYPILLVIAGLLISFIPGLPAVKIDPDLIFFIFLPPLLFDASWSVSFKEMKKWWRIIGSFAFLVVFFTALSVAIVTNHFIPGFTIALGFLLGGIVSPPDAVSTGAITKFVKIPKATSAILEGESLLNDASSLIIFRFALIVIGTGQFIWHEAAVSFLWMIVGGAGIGLLLGWLFVQAHKRLPTDAPSDIALTLIEPYFMYWIAEQLHSSGVLAVVSGGLFMSARRLIFLSSTSRIRAFSVWESFIFILNGIVFLIIGLELPEIVDGLRSQDIPLTTAIKYGVLVTGVLIAARIISSYAAMLATFIFRRNTARNLTSGRSWLLMPLLLGWTGMRGVVSLAAALAIPITLDDGTAFPHRNLILFITFVVILLTLVVQGLTLPYFIKNIPFFNGILNEETEAADRLKMKQGLKLHVYQVLKNKYDNELNGHAGMEKFLQQWEERAKATDDNWMNEKTKVIFIELLESQRQYLTELNKDPKINEEIIRQQLYQIDLEEERLRII

SEQ ID NO: 17677 - protein, 281 aa, Cytophaga hutchinsonii
MSMFFWGLSWPSGKVAASYGSPVTIVLIRYIVVFAGFLPVFFFMKAPLTIHRKGIPSLLAAGLLLSAYTYLFFYGLKNGLAGAGGVLVTTMNPIMAYSIGLVLNRKKPSRNETIGLVLGLVAGATLLKIWGSLDELFASGNIYFLLAAFVWAVMSRITSKASTYGSSMSFSLWMYLATVLIMIPFVNLTDLNNILHNADQYFWWNILFSGIFATSLATSYYFYATTTLGPEKASSFIFLVPVSAAVSSWVFLNETLLLHTIIGGVLGIAAVYMINRKKEIM

SEQ ID NO: 17678 - protein, 1073 aa, Cytophaga hutchinsonii
MKQRTFVLLFFILTLSSYAQTLKLETVIQKGHSASVKAVAVSPDGKILATGSRDKSVKLWDQQSGMEIRSLIGHDHTVNGLAFSPDGKLLATSSADGTARVWDILTGKEIFTSPKNSKYITDVAFNPDGKSFAYAGYPDSASIYAIPSGKLIKRLEVNADQGSGYGISLKYSNDGKWLAIGEDNKTANVYRTSDWHLAYTFKPAEGWCGGCGTYVEFSRDNKSLFKIAHNDKLSQYDLQTGSLIKTFGEPVDYLRGITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESGLEFYEHVHISSREWMARTPQGYFSATEQARADIHFVKGMDVYAPDQFFEYYRPDLIQQIFLNRGSSPTGMQNVENSLQLSPPPLIKLACIPNADGLQATLNIKVMDEGGGLSEIRLAHNGKNMAVALDPKKVVEGKGNSYIYSVPVSLVRGTNQFSGIAVSKGKIESAASLVSVVSDKAPSAAVCHVFAIGIDTYKNPAYTLNYAREDAEAFAESVKRNGANLYQKVIVHGLYDAAATRQNVLDTLKSLEAHIALNDVFIFYYAGHGSMVDQNFYFIPTECTSMYQATANNALSAETIQAGFKNIKALKQIIIMDACQSGGSVEVLAMRGANEEKAFAQLSRGAGIHVMASAGSEQNAKEILELKHGLFTYVLLEALNGKADGAPKDGKITIYELKSYLDDQVPELNSKYSGKIQFPYTFSRGSDFPIVLE

SEQ ID NO: 17679 - protein, 535 aa, Cytophaga hutchinsonii
MSNQTIQTPTTNGMPSGIPFIVGNEAAERFSFYGMRAILAVFMTSYLHMTESTATEWAHTFNSAVYFTPILGAFLADIFIGKYRTILYLSVLYCFGHLVLALNESKDGLFWGLTLISIGAGGIKPCVSAHVGDQFGIKNKHLIERVFSIFYFAVNFGSLFSTLLIPYLLEHYGPAYAFGLPGILMFVATFIFWSGRNKFVHVPPFGKAYFKTVFGKEGLSAIGRLIFIYAFIAIFWALYDQHASTWVYQSKSAFLNKDINLFGLVEFTLLPSQIQAANPVLVLVLIPAFAFFIYPALNKIITLKPLIKILLGMFMCVLAFLVAAYIEKRISSGIETSVWWQFLAYLILTMAEVMVSITALEFSYTQAPNQMKSTVMGIFMFSISLGNILVAVISNYNNLHEEVKTVEIGTKTYISIKDYTPVKGEKIEFEDGTGLFILQQNSKTSLMDTIPLGGTYLVGDVDAVSNRFTLEDNGWHAIQTIKKSELPKGYKVVFHRFKHQSYFYMYALLMFVTAVLFIGVALKYKGKTYIQGEAV

SEQ ID NO: 17680 - protein, 287 aa, Cytophaga hutchinsonii
MRQLKISKQITNRESQSLDKYLQEIGKVDLLTPDEEVDLAKRIREGDQLALEKLTKANLRFVVSVAKQYQNQGLSLGDLINEGNLGLIKAAQRFDETRGFKFISYAVWWIRQSILQALAEQSRIVRLPLNRVGSLNKISKTFSELEQKYEREPSPDELAEVLEVSTAEVVDTLKISGRHVSMDAPFVQGEENSLLDVLENSSESAPDSSLMNDSLRREVQRALSTLTQREADVISLYFGLNGEHSMTLEEIGEKFNLTRERVRQIKEKAIRRLRHTSRSKALKPYLG

SEQ ID NO: 17681 - protein, 185 aa, Anas platyrhynchos
ARGSTCAVFGLGGVGLSVIMGCKAAGASRIIAVDINSDKFAKAKELGATDCINPKDHKEPIHKVLIGMTGYGVDYSFEVIGRIETMVAALASCHYNYGVSVIVGVPPAAQNITFDPMLLFSGRTWKGSVFGGWKSKDSVPKLVADYMKKKFVLDPLITHTLPFSKINEGFDLLRAGKSIRSVLTF

SEQ ID NO: 17682 - protein, 513 aa, Plasmodium falciparum
MGNHLSVNKLKRKKKKKSFLNIYGKNTNENTSKQSNDYKYDINTSCISREGTTTLERKNLILCHSGKLEDKYIIDEKLGQGTYGCVYKGIDKVTNQLYAIKEEKKDRLKNINRFFQEIEIMKKLDHPNIVKLYETYENDNYIYLIMELCSGRELFDSIIENGSFTEKNAATIMKQIFSAIFYLHSLNIVHRDLKPENFLFQSENKDSLLKIIDFGLSKNLGTGEFTTTKAGTPYYVAPQVLDGKYDKKCDIWSSGVIMYTLLCGYPPFYGDTDNEVLKKVKKGEFCFYENDWGSISSDAKNLITKLLTYNPNERCTIEEALNHPWITQMTKSHEHVELSSTLLKNLKNFKKENELKKIALTIIAKHLCDVEINNLRNIFIALDVDNSGTLSSQEILDGLKKIGYQKIPPDIHQVLRDIDSNASGQIHYTDFLAATIDKQTYLKKEVCLIPFKFFDIDGNGKISVEELKRIFGRDDIENPLIDKAIDSLLQEVDLNGDGEIDFHEFMLMMSKKK

SEQ ID NO: 17683 - protein, 578 aa, Tortula ruralis
MGNSCVGAAGYFQGFTSVIALGGRSSRSPSEVSPTPSKAESRGGSRAEAESPETQRKPPRPAHIPAVEPAETQQFKEVIEAMKKGREMKPVPGQSLTHSVLQRKTENLRDLYVLGKKLGQGQFGTTYLCIEKATNREYACKSIAKRKLISKEDVDDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLTPQASKRLKAHQVLAHPWICEDGVAPDRPIDSAVQSRLKHFSAMNKLKKIAIRVIAESLSEEEIAGLKEMFKMMDTDNSGSISYEELKAGLKKVGSNLKEEDVRQLMDAADVDGSGAIDYGEFLAATLHLNKVERDENMFAAFSYLDKDNSGYLTVDELQHALAEFNMGDVSVEELLREVDQNNDGQIDYTEFVTMMRKGNMGGGAGRSSLRNSQQLSLTDVLGIGG

SEQ ID NO: 17684 - protein, 364 aa, Homo sapiens [sequence omitted]

SEQ ID NO: 17685 - protein, 294 aa, Oryza sativa; identical to SEQ ID NO: 3260

SEQ ID NO: 17686 - protein, 406 aa, Bos taurus
EFQEDQENVNPEKAAPAQQPRTRAGLAVLRAGNSRGPAPQRPKTRRVAPLKDLPINDEYVPVPPWKANNKQPAFTIHVDEAEEIQKRPTESKKSESEDVLAFNSAVTLPGPRKPLAPLDYPMDGSFESPHTMEMSVVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLAFDLAAPTINQFLTQYFLHQQPANCKVESLAMFLGELSLIDADPYLKYLPSVIAAAAFHLALYTVTGQSWPESLVQKTGYTLETLKPCLLDLHQTYLRAPQHAQQSIREKYKNSKYHGVSLLNPPETLNV

SEQ ID NO: 17687 - protein, 414 aa, Solanum tuberosum
MESRVLTGGATAIRGGLPLLRKPAAVMKFTTAAHAISRDFPAGAVTAKPVGPLIAGPNLIWGRQLRPAILLETSPKRESIKPCSAAASSSAGSSDSSGDAKVGFFNKATLTTGFFFFMWYFLNVIFNILNKKIYNYFPYPYFVSVIHLAVGVVYCLVSWGVGLPKRAPIDSTQLKLLTPVAFCHALGHVTSNVSFAAVRVSFTHTVKALEPFFNAAASQFILGQQIPLALWLSLAPVVLGVSMASLTELSFNWLGFTSAMISNISFTYRSIYSKKAMTDMDSTNVYAYISIIALIFCLPPAIFIEGPQLLQHGFNDAIAKVGLTKFVTDLFWVGMFYHLYNQVATNTLERVAPLTHAVGNVLKRVFVIGFSIVIFGNKISTQTGIGTCIAIAGVAIYSFIKAKMEEEKRQKKAA

SEQ ID NO: 17688 - protein, 236 aa, Gossypium hirsutum
MGRGRVELKRIENKINRQVTFAKRRNGLLKKAYELSVLCDAEVALIIFSNRGKLYEFCSSSSMIKILERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANRTLKQRLVEGYQVNSLQLNPNATEDVGYGRQQVHHQPHGDAFFHPLDCEPTLQIGYQHDPMSVVTAGPV

SEQ ID NO: 17689 - protein, 499 aa, Trametes versicolor
AIGPAASLVVANAPVSPDGFLRDAIVVNGVFPSPLITGKKGDRFQLNVVDTLTNHTMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWIRANPNFGTVGFAGGINSAILRYQGAPVAEPTTTQTTSVIPLIETNLHPLARMPVPGSPTPGGVDKALNLAFNFNGTNFFINNASFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAGFAIVFAEDVADVKAANPVPKAWSDLCPIYDGLSEANQ

SEQ ID NO: 17690 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAARPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 17691 - protein, 440 aa, Candida albicans [sequence omitted]

SEQ ID NO: 17692 - protein, 57 aa, Galleria mellonella
IEKVFSKYGNIRNVWVARNPPGFAFVEFEDPRDAEDSVRGLDGTRCCGTRIRVEMSN

SEQ ID NO: 17693 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYSHVTCATDTNNIQFVFDAVTDVIIAKNLRGCGLY

SEQ ID NO: 17694 - protein, 354 aa, Rattus norvegicus
MGCTLSAEERAALERSKAIEKNLKEDGISAAKDVKLLLLGAGESGKSTIVKQMKIIHEDGFSGEDVKQYKPVVYSNTIQSLAAIVRAMDTLGVEYGDKERKADSKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHEFLKLFDSICNNKWFTDTSIILFLNKKDIFEEKIKKSPLTICFPEYTGPSAFTEAVAHIQGQYESKNKSAHKEVYSHVTCATDTNNIQFVFDAVTDVIIAKNLRGCGLY

SEQ ID NO: 17695 - protein, 354 aa, Lymnaea stagnalis
MGCTLSAEERAAMERSKAIEKNLKEDGMQAAKDIKLLLLGAGESGKSTIVKQMKIIHEGGFTSEDNKQYKPVVYSNTIQSLVAIIRAMGTLSIPFGDNERESDAKMVLDVIARMEDTEPFSEELLAAMKRLWVDSGVQECLGRANEYQLNDSAKYFLDDLDRLGAKDYMPTEQDILRTRVKTTGIVEVHFSFKNLNFKLFDVGGQRSERKKWIHCFEDVTAIIFCVAMSEYDQVLHEDETTNRMQESLKLFDSICNNKWFTETSIILFLNKKDLFEEKIKKSPLTICFPEYTGKQMYQEASAYIQAQFEAKNKSSAKEIYCHQTCATDTNNIQFVFDAVTDVIIANNLRGCGLY

SEQ ID NO: 17696 - protein, 355 aa, Mus musculus
MAGCCCLSAEEKESQRISAEIERHVRRDKKDARRELKLLLLGTGESGKSTFIKQMRIIHGSGYSDEDRKGFTKLVYQNIFTAMQAMIRAMDTLRIQYMCEQNKENAQIIREVEVDKVTALSRDQVAAIKQLWLDPGIQECYDRRREYQLSDSAKYYLTDIERIAMPSFVPTQQDVLRVRVPTTGIIEYPFDLENIIFRMVDVGGQRSERRKWIHCFESVTSIIFLVALSEYDQVLAECDNENRMEESKALFRTIITYPWFLNSSVILFLNKKDLLEEKIMYSHLISYFPEYTGPKQDVKAARDFILKLYQDQNPDKEKVIYSHFTCATDTENIRFVFAAVKDTILQLNLREFNLV

SEQ ID NO: 17697 - protein, 353 aa, Coprinellus congregatus
MGCVQSTGVDDEAKARNDEIENQLKRDRVMAKNEIKMLLLGAGESGKSTVLKQMKLIHHGGYSDQEKDSYKEIIFSNTVQSMRAILDALPALDLALQPANDARRATILAVPGQIEAEVLPRDIADAIRQLWADPGLKEAVRRSREFQLNDSAVYYFNSIDRMSAPGYLPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPARRSTYFPDFTGGDNYDAACDYLLHRFVSLNQSAATKQIYAHYTCATDTQQIKFVLSAIQDILLQLHLRECGLL

SEQ ID NO: 17698 - protein, 376 aa, Lymnaea stagnalis
MGCFRQTRDDEDDKLRKEANKKIEKQLAKDKLLYRGTHRLLLLGAGESGKSTIVKQMRILHVNGFSPEERKQKIEDIKRNVRDAILTITGAMSTLNPPVQLEHPQNKAKVDYIQDKASQAEFDYPPIFYEYTEILWKDKGVQAAFERSNEYQLIDCAQYFLDRVHIIRQAEYTPSEQDILRCRVLTSGIFETKFSVDKVNFHMFDVGGQRDERRKWIQCFNDVTAIIFVTACSGYNMVLREDATQNRLKESLDLFKSIWNNRWLRTISVILFLNKQDLLAEKVKAGKSKIEDYFPEYARYQVPPDASSEPGEDTEVVRAKYFIRDEFLRISTASGDGRHYCYPHFTCAVDTENIRRVFDDCRDIIQRMHLRQYELL

SEQ ID NO: 17699 - protein, 397 aa, Sus scrofa
MGCLGNSKTEDQRNEEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIELFVLDDRLFQERPFSFIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 17700 - protein, 379 aa, Schistosoma mansoni
MVIGCCTLNNISEDAKTRSDANKQIEKLIEKEKKNFKSTHRLLLLGAGESGKSTIVKQMRILHIDGFSEREKKEKIDAIRKNLRDAICSIAGAMGSLKPPVKLELSENRKLRDYILETASKPDFDYPPEFFTYCAKLWKDGGIQETFERSNEYQLIDCAKYFLDKALEVGAPNYIPSEQDILRCRVLTSGIFETKFSVDKVNFHMFDVGGQREERRKWIQCFNDVTAIIFVAACSSYNMVLREDPSQNRVKESLELLASIWNNRWLRNISVILFLNKQDLLTEKVLAGKSKIEVYFPHYATYQAPADTLAEYRHENSEVVRARFFFRDEFLKVTSNNNGGRHYCYPHLTCAVDTENIRRVFNDCRDIIQRMHLRQYELL

SEQ ID NO: 17701 - protein, 354 aa, Asterina pectinifera
MGCATSAEDKAAAERSKAIDRNLRIDGEKAAREVKLLLLGAGESGKSTIVKQMKIIHEEGYSEEDCKQYKPVVYSNTIQSMIAIIRAMGSLKVDFGDGDRTDDARQLFALAGQAEEGELSPELAAVMKRLWADGGVQGCFSRSREYQLNDSASYYLNALDRLAAPGYIPTQQDVLRTRVKTTGIVETHFTFKDLHFKMFDVGGQRSERKKWIHCFEGVTAIIFCVALSAYDLVLAEDEEMNRMHESMKLFDSICNNKWFTETSIILFLNKKDLFEEKITKSPLTICFPEYTGSNTYEEAAAYIQMQFEDLNKRKDQKEIYTHFTCATDTNNIQFVFDAVTDVIIKNNLKDCGLF

SEQ ID NO: 17702 - protein, 354 aa, Lymnaea stagnalis
MGCVTSQEDKAAVERSKQIDKSLRMDGEKAAREVKLLLLGAGESGKSTIVKQMKIIHEKGYSQEECLQYKPVVYSNAIQSMIAIIKAMGQLKIQFGHPDRAEDARQFFALAGHADEGEMSAELSGIMKRLWKDVGVQECFSRSREYQLNDSAEYYLNALDRISAPGYIPTEQDVLRTRVKTTGIVETHFTFKDLHFKMFDVGGQRSERKKWIHCFEGVTAIIFIVAMSEYDLTLAEDQEMNRMMESMKLFDSICNNKWFTETSIILFLNKKDLFEEKIKKSPLTICFPEYTGANTYEEAAAYIQLQFENLNKKKDTKEIYSHFTCATDTNNVQFVFDAVTDVIIKNNLKDCGLF

SEQ ID NO: 17703 - protein, 478 aa, Emericella nidulans
MNENDENGPSTRLTRAKAAALTTDAPAANGALKKPLQTKKAATGANGTQRKRAALGDVSNVGKADNGETKDAKKATSKTGLTSKATMQSGGVQKLSRSNLSRTAVGAKDNNVKKPATEAKRPGSGSGMGSAMKRTSSQKSLQEKTIQQEEPPRKKVDIEKVVEKQAEAVSVKGDVKAGAQTEELEKPQDFVADLDTEDLDDPLMAAEYVVEIFDYLRELEMETLPNPDYIDHQPDLEWKMRGILVDWLIEVHTRFRLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWDATLAHYAGYTEEEIDEVFRLMVDYLHRPVCHEAFFKKYASKKFLKASIMTRQWAKKYHHLYIDSALTEPYNSIKDNE

SEQ ID NO: 17704 - protein, 213 aa, Nicotiana tabacum
MAIKVHGSPMSTATMRVAACLIEKELDFEFVPVDMASGEHKKHPYLSLNPFGQVPAFEDGDLKLFESRAITQYIAHVYADNGYQLILQDPKKMPSMSVWMEVEGQKFEPPATKLTWELGIKPIIGMTTDDAAVKESEAQLSKVLDIYETQLAESKYLGGDSFTLVDLHHIPNIYYLMSSKVKEVFDSRPRVSAWCADILARPAWVKGLEKLQK

SEQ ID NO: 17705 - protein, 594 aa, Oryza sativa (japonica cultivar-group)
MGLCHGKPSQIPEPEAEEAAAAAGVAVAGAASPGPAAAAAAAAAAKPGTPKQPKFPFYLPSPLPASSYKSSPANSSVASTPARGGLKRPFPPPSPAKHIRALLARRHGSVKPNEAPIPEGGETEVGLDKGFGFSKHFFAKYELGDEVGRGHFGYTCSAKAKKGDHKGHDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFTSKDENSALKVIDFGLSDFVKPDERLNDIVGSAYYVAPEVLHRSYGTEADMWSIGVIAYILLCGSRPFWARTESGIFRAVLKAEPSFDEAPWPTLTAEAKDFVKRLLNKDYRKRMTAAQALSHPWIRNSQQVKIPLDMIIYKLMRAYISSSSLRKSALRALAKTLTANQLFYLREQFELLGPNKNGYISLQNLKTALVKNSTDAMKDSRVIDFVNTVCTLQYRKLDFEEFAASAVSVYQMEALETWEQHARRAYELFDKEGNRPIVIEELASELGLGPSVPLHVVLQDWIRHADGKLSFLGFIKLLHGVSSRSIPKA

SEQ ID NO: 17706 - protein, 721 aa, Homo sapiens [sequence omitted]

SEQ ID NO: 17707 - protein, 1061 aa, Oncidium cv. 'Goldiana'
MAGNDWINSYLEAILDAGPSIDASKSSLLLRERGRFSPTKYFVEEVITGFDETDLYKSWLRAAATRSPQERNTRLENMCWRIWNLARKKKQIEGEEAQRLSKRRLERERGRRDATADMSEDLSEGEKGDVVGELSSHGDSSRGRMHRISSIDALDAWASQLKDKNLYIVLISIHGLIRGENMELGRDSDTGGQVKYVVELARALGSMPGVYRVDLLTRQISAPDVDSSYGEPTEMLAPSHSENFHEMGESSGAYIIRIPFGPRDKYIPKELLWPYIQEFVDGALSHIMQMSKILGEQIGWGQPVWPAAIHGHYADAGDSAALLSGALNVPMVFTGHSLGRDKLEQLLKQRRATRDEINATYKINRRIEAEELALDASEIVITSTRQEIDEQWCLYDGFDVILQRKLRARIKRGVSCYGRFMPRMVVIPPGMELHHITANDGDIDGDGDGNEENPASLDPPIWAEIMRFFTNPRKPMILALARPDPKKNILTLVKAFGEYRPLRELANLTLIMGNRDAIDDMSGTNGAVLTAVLKLIDKYDLYGQVAYPKHHKQSEVADIYGLAAKTKGVFINPAFIEPFGLTLIEAAAHGLPIVATKNGGPVDIIRVLDNGLLVDPHDQDSISAALYKLVSDKQLWARCRQNGLKNIHLFSWPEHCKIYLSRIATCKPRHPQWKRSEDVLEKSDSESPGDSLRDIQDISLNLKLSIEGDKAEESGNLDALDSEESIADRKYKLENTVLKFSKGVSKVTQKAGSGEKHDQSSGASKLPALRRRKHIFVIAVDFDSETDVIEIILKIFEAVHEQRMAGSIGFVLSTALTISEIYSLLTTGGIATTDFDAFICNSGSDLYYPFLNSEDSINSSDLPFEIDLDYHSQIEYRWGGEGLRRTLVRWATSIIGKNGVNEEQAVVEDEERSSTYCHAFKLKNPALVPPIKELRKLMRIQALRCHVLYSYDCTKLHVIPILASRSQALRYLHVRWDTDLSNLVVFVGESGDTDYEGLLGGIHRTVILKGVCNAPKPPVSIRNYALGDVVAFNSQNIVETEQSFSSAEILLALQKLSILKH

SEQ ID NO: 17708 - protein, 323 aa, Bos taurus
MDPKGQRVKLNDGHFIPVLGFGTYAPPEVAKKEALEFTPFAIEVGFRHIDCAHAYQNEEEIGQVIRSKIADGTVKREDIFCTSKLWLTSLRPELVRPALEKSLKNLQLDYVDLYIMHYPMALKPGEELFPKDENGKLIFDSVDFCRTWEALEKCKDAGLAKSIGVSNFNHKQLERILNKPGLKYKPVCNQVECHPYLNQSKLLDFCKSHEIVLVAYAGLGSQRVKEWVNQNHPVLLEDPVLSAISQKHKKTAALIALRYQIQRGVVVLAKGNNKKWIKENMQVFDFELTPEDMKAIDGLNRNIRYYELHLAVSHPEFPFSEEY

SEQ ID NO: 17709 - protein, 323 aa, Bos taurus
MDPKSQRVKLNDGHFIPVLGFGTYAPQEVAKRDALEFTPFAIEVGFRHIDCAHAYQNEEQIGQAIRSKMADGTVKREDIFCTSKLWCTSFRPELVRPALEKSLKSLQLDYVDLYIMHYPLALKPGEELYPKDENGKLIADSVDFCLTWEALEKCKDAGLAKSIGVSNFNHKQLEKILNKPGLKYKPVCNQVECHPYLNQRKLLDFCKSHDIVLVAYSALGSQRVKGWVNPNHPVLLEDPVLSAIAQKHKKTAALVALRYQIQRGVVVLAKGNNKEWIKENMQVFDFELTPEDMKAIDGLNRNIRYCDFHPGVGHPEFPFSEEY

SEQ ID NO: 17710 - protein, 522 aa, Ceratopteris richardii
MGNCCGTDGFKHERPLPAHPNRQGEDKTGAPKVISHTKLSSCGEQSVNEKYHLGRELGRGEFGITYLCTDRETDEVLACKSISKGKLRTPIDIEDVRREVDIMRHLPKHPNIVTLEGVYEDENAVHLVMELCEGGELFDRIVARGHYSERAAAAVMRTILEVVQVCHRHGVMHRDLKPENFLFANKKENSPLKAIDFGLSIFFKPGEKFTEIVGSPYYMAPEVLKRSYGPEVDIWSAGVILYILLCGSPPFWAETEQLVAQAILRGNVDFNRDPWPNVSENAKALVRQMLEPDPSKRLTAQQVLDHSWLVNARKAPDVPLGDAVCARLKQFSAMNKLKKRALRVIAELLTGEEVEGIRAMFNMMDVERTGSLTFGQLKAGLYKLGSQLPESEIQQLMEAADVNGNGTLDYGEFVAITVHLQRMDNDECLRKAFNFFDLNGDGFIDRSELHEMLEADLGEVGTDIIDDIIQEVDIDKDGRISYDEFASMMRTGTDWRKVSRNFSRERYASLSIKLMQEGSLKL

SEQ ID NO: 17711 - protein, 376 aa, Gallus gallus
MATSGKVIRCRAAVAWAAGKSLSVEEIEVAPPKAREVRVKMVATGICHTDEHVLEGNFPDVDFPVILGHEGAGIVESIGEGVTSVKPGDKVILFPLPQCGECSFCLNPDSNYCLKSHLTEPQNLMPDKTTRFTCKGKQIQHFLWNSTFAEYTVVPEYTLAKIDAAAPLDKVCVFACGFSTGYGAAVNTAKVKLGSTCAVFGLGGVGLSVVMGCKAAGASRIIAIDINKDKFAKAKEMGATECINPQDFKKPIQQVLTEMTGHGVDYSFEAIGTADTLIAALASCNMNTGVCVMVGVLPAGSTVPIDPFLLLSGRTCKGTLAGGWKMRDSIPKLVASYLEKKFNSDLLITHTLPFAKINEGFELLRAGKSIRTVMLF

SEQ ID NO: 17712 - protein, 631 aa, Mus musculus
MESVALLQRPSQAPSASALASESARPLADGLIKSPKPLMKKQAVKRHHHKHNLRHRYEFLETLGKGTYGKVKKARESSGRLVAIKSIRKDKIKDEQDLLHIRREIEIMSSLNHPHIIAIHEVFENSSKIVIVMEYASRGDLYDYISERPRLSERDARHFFRQIVSALHYCHQNGIVHRDLKLENILLDANGNIKIADFGLSNLYHKGKFLQTFCGSPLYASPEIVNGKPYVGPEVDSWSLGVLLYILVHGTMPFDGQDHKTLVKQISNGAYREPPKPSDACGLIRWLLMVNPTRRATLEDVASHWWVNWGYTTGVGEQEALREGGHPSGDSGRASMADWLRRSSRPLLENGAKVCSFFKQHVPGGGSTVPGLERQHSLKKSRKENDMAQNLQGDPAEDTSSRPGKSSLKLPKGILKKKSSTSSGEVQEDPQELRPVPDTPGQPVPAVSLLPRKGILKKSRQRESGYYSSPEPSESGELLDASDVFVSGDPVEQKSPQASGLLLHRKGILKLNGKFSRTALEGTTPSTFGSLDQLASSHPAARPSRPSGAVSEDSILSSESFDQLDLPERLPETPLRGCVSVDNLRGLEQPPSEGLKRWWQESLGDSCFSLTDCQEVTAAYRQALGICSKLS

SEQ ID NO: 17713 - protein, 464 aa, Homo sapiens
METGFPAIMYPGSFIGGWGEEYLSWEGPGLPDFVFQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 17714 - protein, 580 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMRHSHRLAYAAHVTRIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 17715 - protein, 290 aa, Mus musculus
MASSKKVTLSVLSREQSEGVGARVRRSIGRPELKNLDPFLLFDEFKGGRPGGFPDHPHRGFETVSYLLEGGSMAHEDFCGHVGKMNPGDLQWMTAGRGILHAEMPCSEEPAHGLQLWVNLRRSEKMVAPQYQELKSEEIPKPTKDGVTVAVISGEALGIKSKVYTRTPTLYLDFKLDQGAKHSQPIPKGWTSFIYTISGDVYIGPDDAQQKIEPHHTAVLGEGDAVQLENKDPKRSHFVLIAGEPLREPVVQHGPFVMNTNEEISQAILDFRNAKNGFEGARTWKSKIGN

SEQ ID NO: 17716 - protein, 456 aa, Mus musculus
MSSFTKDEFDCHILDEGFTAKDILDQKINEVSSSDDKDAFYVADLGDILKKHLRWLKALPRVTPFYAVKCNDSRAIVSTLAAIGTGFDCASKTEIQLVQGLGVPAERVIYANPCKQVSQIKYAASNGVQMMTFDSEIELMKVARAHPKAKLVLRIATDDSKAVCRLSVKFGATLKTSRLLLERAKELNIDVIGVSFHVGSGCTDPETFVQAVSDARCVFDMATEVGFSMHLLDIGGGFPGSEDTKLKFEEITSVINPALDKYFPSDSGVRIIAEPGRYYVASAFTLAVNIIAKKTVWKEQPGSDDEDESNEQTFMYYVNDGVYGSFNCILYDHAHVKALLQKRPKPDEKYYSSSIWGPTCDGLDRIVERCNLPEMHVGDWMLFENMGAYTVAAASTFNGFQRPNIYYVMSRPMWQLMKQIQSHGFPPEVEEQDDGTLPMSCAQESGMDRHPAACFC

SEQ ID NO: 17717 - protein, 581 aa, Homo sapiens [sequence omitted]

SEQ ID NO: 17718 - protein, 508 aa, Bifidobacterium animalis
MPKSKHTTVGRVPQDPGRYSLVAKETTSTEKAAKKKASESAHDEAAVEEKGKTTRRRASSKASSAKKGSAGKTTKRATARKKKDAAESESTPARKTRAASKTGAKKAISKSEEIDDEDMIGEDVIDEEDLDLDEDLDADENDDDLEDEESEDEPEPEEDDDEEPQAPKEPKEKGAFVVSDNDEDDEALLANPGVNPKRRVVTTGATADPVKDYLKQIGRVSLLNAEQEVDLSERIEAGLYAQHLLDTEGDTMEFRRKRELKWAAADGKKAKDHLLEANLRLVVSLAKRYTGRGMLFLDLIQEGNLGLIRAVEKFDWKKGFKFSTYATWWIRQAITRAMADQARTIRVPVHMVEVINKLSRVQRQMLQDLGREPTPDELARELDMPVEKVQEVQKYGREPISLHTPLGEDGDSEFGDLIEDTDAIAPSEAVAFSLLQEQFRQVLETLSPREAGVIKMRYGLEDGQPKTLDDIGRVYGVTRERIRQIESKTMSKLRHPSRSQTLRDFLDQ

SEQ ID NO: 17719 - protein, 239 aa, Brassica oleracea var. botrytis
RGRVQLKRIENKINRQVTFSKRRSGLLKKAHEISVLCDAEVALIVFSSKGKLFEYSTDSCMESILERYDRYLYSDKQLVGRDISQIENWVLEHAKLKARVEVLEKNKRNFMGEELESLSLKDLQSLEHQLDAAIKSIRSRKNQAMFESISALQKKDKALQDHNNTLLKKIKEREKKTGHQEGQLNHCSNNSSIVQPQYCLTSSRDGFVGRVGGENGGASSLTEPNSLLPAWMLRPTTNE

SEQ ID NO: 17720 - protein, 241 aa, Brassica oleracea var. botrytis
MGRGRVQLKRIENKINRQVTFSKRRSGLLKKAHEISVLCDAEVALVIFSSKGKLFEYSTDSCMERILERYDRYLYSDKQLVGREISQSENWVLEHAKLKARVEVLEKNKRNFMGEDLDSLSLKELQSLEHQLHAAIKSIRSRKNQAMFESISALQKKDKALQDHNNALLKKIKEREKNTVQQGGQLIQCSNNASILQPQYCLTSSRDGFVGRVGEENGVASLLAEPNSLLPAWMLRPTTKE

SEQ ID NO: 17721 - protein, 243 aa, Brassica oleracea var. botrytis
MGRGRVQLKRIENKINRQVTFSKRRSGLLKKAHEISVLCDAEVALVVFSSKDKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGASSLIGPNSLLPAWMLRPATNE

SEQ ID NO: 17722 - protein, 242 aa, Brassica oleracea var. botrytis
MGRGRVQLKRIENKINRQVTFSKRRSGLLKKAHEISVLCDAEVALVVFSSKGKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGTSSLIEPNSLLPAWMLRPTTK

SEQ ID NO: 17723 - protein, 256 aa, Brassica oleracea var. botrytis
MGRGKVELKRIENKINRQVTFAKRRNGLLKKAYELSVLCDAEIALLIFSNRGKLYEFCSNPSGMAKMVEKYRKHSYATMDPNQSAKDLQERYQDYLNLKSRVEVLQHSQRHLLGEEIAGIGVDELEQLECQVDTSLRQIRSTKARSMLDQLSDLKSKEEMLLETNRDLKRKLEESDAALNQTLWGASSSAEHSQQQQEGMTSYHANPLSQEVGFFRPLQGNVALQMSHYNPGVPNASNSATTSQNVINGFFPGWMV

SEQ ID NO: 17724 - protein, 250 aa, Brassica oleracea var. botrytis
MGRGRVELKRIENKINRQVTFAKRRNGLLKKAYELSVLCDAEVALIIFSNRGKLYEFCSSSNMIKTLERYQKCSYGSIEVNNKPAKELENSYREYLKLKGRYEGLQRQQRNLLGEDLGPLNSKELEQIERQLDGSLKQVRSIKTQYMLDQLSDLQTKEQMLLETNRALAMKLDDMIGVRSHHMGGGGGGWEGNEHNVSYAHHQAQSQGLFQPLECNPTLQMGYDNPVCSEQITATTQAQAQPGYIPDWML

SEQ ID NO: 17725 - protein, 259 aa, Brassica oleracea var. botrytis
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGLVLVYIRFQQHYYVQGEGSSVPKSNVACETNFVQDWFL

SEQ ID NO: 17726 - protein, 252 aa, Brassica oleracea var. botrytis
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGFQQHYYVQGEGSSVPKSNVACETNFVQDWFL

SEQ ID NO: 17727 - protein, 125 aa, Mytilus edulis
MSGRGKGGKAKAKAKSRSSRAGLQFPVGRIHRLLRKGNYAERVGAGAPVYLAAVLEYLAAEVLELAGNAARDNKKSRIIPRHLQLAIRNDEELNKLLSGVTIAQGGVLPNIQAVLLPKKTQKAAK

SEQ ID NO: 17728 - protein, 1192 aa, Arabidopsis thaliana
MAFLTALFLFLFFSFSSSAIVDLSSETTSLISFKRSLENPSLLSSWNVSSSASHCDWVGVTCLLGRVNSLSLPSLSLRGQIPKEISSLKNLRELCLAGNQFSGKIPPEIWNLKHLQTLDLSGNSLTGLLPSRLSELPELLYLDLSDNHFSGSLPLSFFISLPALSSLDVSNNSLSGEIPPEIGKLSNLSNLYMGLNSFSGQIPSEIGNTSLLKNFAAPSCFFNGPLPKEISKLKHLAKLDLSYNPLKCSIPKSFGELQNLSILNLVSAELIGSIPPELGNCKSLKSLMLSFNSLSGPLPLELSEIPLLTFSAERNQLSGSLPSWIGKWKVLDSLLLANNRFSGEIPREIEDCPMLKHLSLASNLLSGSIPRELCGSGSLEAIDLSGNLLSGTIEEVFDGCSSLGELLLTNNQINGSIPEDLWKLPLMALDLDSNNFTGEIPKSLWKSTNLMEFTASYNRLEGYLPAEIGNAASLKRLVLSDNQLTGEIPREIGKLTSLSVLNLNANMFQGKIPVELGDCTSLTTLDLGSNNLQGQIPDKITALAQLQCLVLSYNNLSGSIPSKPSAYFHQIDMPDLSFLQHHGIFDLSYNRLSGPIPEELGECLVLVEISLSNNHLSGEIPASLSRLTNLTILDLSGNALTGSIPKEMGNSLKLQGLNLANNQLNGHIPESFGLLGSLVKLNLTKNKLDGPVPASLGNLKELTHMDLSFNNLSGELSSELSTMEKLVGLYIEQNKFTGEIPSELGNLTQLEYLDVSENLLSGEIPTKICGLPNLEFLNLAKNNLRGEVPSDGVCQDPSKALLSGNKELCGRVVGSDCKIEGTKLRSAWGIAGLMLGFTIIVFVFVFSLRRWVMTKRVKQRDDPERIEESRLKGFVDQNLYFLSGSRSREPLSINIAMFEQPLLKVRLGDIVEATDHFSKKNIIGDGGFGTVYKACLPGEKTVAVKKLSEAKTQGNREFMAEMETLGKVKHPNLVSLLGYCSFSEEKLLVYEYMVNGSLDHWLRNQTGMLEVLDWSKRLKIAVGAARGLAFLHHGFIPHIIHRDIKASNILLDGDFEPKVADFGLARLISACESHISTVIAGTFGYIPPEYGQSARATTKGDVYSFGVILLELVTGKEPTGPDFKESEGGNLVGWAIQKINQGKAVDVIDPLLVSVALKNSQLRLLQIAMLCLAETPAKRPNMLDVLKALKEI

SEQ ID NO: 17729 - protein, 482 aa, Oryza sativa (indica cultivar-group)
MAQPSPTTGTLPFLMASNAKSTIPSATKMDEDCTFGNDTFSFQPHVGSRRPNFSASEKGPNACHQNQSLSNIHQRESSLQSSFTAVKDITDEKNIKTKTSDSMFGDNHSSDEQDDETNQNGENFMPPLNHRSGVPLSHTNDPEVNVLENRGSQTCHNSASLWDNAKNDCLQDVQSEVIETRTAACLPVSTNCDTSIMESQDAVDVSSTLSNEEDDRATHGTASIECNGDGDETDSKRRKLDALTAATAAITTTSNIDMGAAASRGVREPRVVVQTTSEVDILDDGYRWRKYGQKVVKGNPNPRSYYKCTHQGCSVRKHVERASHDLKSVITTYEGKHNHEVPAARNSGHGSSGSGNAPSAPQSNGSQRRQEQGQASFSQFGGAAPFSSFVLPPRNQFGPSASNFPFGMVPPGMAIPMPSLGSLAPAKMAGHPSTMQGYQGLMIPEGEMKTEPMSQLGFPAVNQSSSSFQQMMNRPPSFGPQM

SEQ ID NO: 17730 - protein, 330 aa, Escherichia coli
MSQNTLKVHDLNEDAEFDENGVEVFDEKALVEYEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 17731 - protein, 277 aa, Escherichia coli
MLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 17732 - protein, 355 aa, Suberites domuncula
MSSSDYYSQRVGDTVFTVQKRYTNLTNIGSGAQGVVCSAFDTVTQEKIAIKKLVKPFQNETYAKRAFRELRLMKMVDHKNIIGLKNLFTPAKSLDDFQDVYIVMELMDANLCRVIGIELDHDRMSYLLYQLLCGIKHLHSAGIIHRDLKPSNIVVKEDCSLKILDFGLARTADQTFNMTPYVVTRYYRAPEVIVGMKYKENVDIWSVGCIFAEMIRGDILLPGKDYIDQWNKVTQVLGTPPSVFFKQLSSSVRLYCESQPRYAGKSWKDLFPDDVFPNDTPEDKAKTRHGRDLLSKMLQIDPQNRITVEQALAHPYVSIWYDPAEVHAPPPKRYDHALDEQSIPLDQWKTRIYEE

SEQ ID NO: 17733 - protein, 380 aa, Candida boidinii
MSTVGKTITCKAAVAWKPGEDLSIETIEVAPPKAHEVRIKIEYTGVCHTDAYTLSGADAEGEFPVVFGHEGAGIVESVGEGVTSVKVGDSVICLYTPECRECKFCKSGKTNLCGKIRATQGKGLMPDGTSRFTCKGQPLLHYMGCSTFSQYTVVADISVVAVNPEAPKDRTCLLGCGITTGYRAATNTVKMNEGDNIAVFGVGCIGLSVIQGAVAKKAGKIIAIDINDGKTEWAEKFGATDFVNPTKLAEGETIVSKLIDMTDGGCDFTFDCTGTVQVMRNALEACHKGWGESVIIGVAAAGKEISTRPFQLVTGRVWRGCAFGGVKGRTQMPGIVEDYLSGTLKVDEFITHRHKLDDINKAFHDMHAGDCIRAVITMEE

SEQ ID NO: 17734 - protein, 256 aa, Saussurea medusa
MVRAPCFDKHGIKRGAWSQEEDNKLRAHIQRSGHSNWRQLPKLAGLSRCGKSCRLRWVNYLRPTIKHGNFTKDEKDVVVALHNKLGNKWSAIAARLPGRSDNEIKNYWHTHLKNRAQTDQTVLQTKQDGNAETSKGKGTPKAGCVVRKPNVKSQQEVEILLAVLSSASSSSFSSSTTSDQNESSPPSLSVSDANVTPQCSEEAARSLCIDQFLVEEDSIMLSSDKMYSPLGSVDYFISQDNVMDDVLLWPNLDFYY

SEQ ID NO: 17735 - protein, 428 aa, Danio rerio
MSTQGSAVHDSDIHNQENMLSRLRGAAAKNRVENRENVNPNPKAANNRTVLGELENSQRRQLGLRGAKQGSGPQIIACKPEENARSFGERPSNRQPAAFQIHVDEPDGACSKKAPLQRSTMDCSPLTLNPTVTRLRQPLATIDLPLEASFDSPMDMSVIDCEERPTNVNEVSDYAAEIHTHLREMEVKSKPKAGYMRKQPDITNSMRAILVDWLVEVGEEYKLQNETLYLAVNYIDRFLSSMSVLRGKLQLVGTAAMLLASKFEEIYPPEVAEFVYITDDTYTKKQVLRMEHLVLTVLSFDLAAPTINQFLTQYFLHQPVSSKVESLSMFLGELSLIDCDPFLKYLPSQMAAAAFILANHTLASGSWSKSLVDLTGYSLEDLLPCVQDLHQTYLAASQHAQQAVREKYKGSKYHEVSLIEPPEKLMLN

SEQ ID NO: 17736 - protein, 920 aa, Danio rerio
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIVHRDVKPHCVLLASKENSAPVKLGGFGVAIQLGESGLVAGGRVGTPHFMAPEVVKREPYGKPVDVWGCGVILFILLSGCLPFYGTKERLFEAIIKGKYKVMNPRQWGHISESAKDLVRRMLMLDPAERITVYEALNHPWLKRDRYAYKIHLPETVEQLRKFNARRKLKGAVLAAVSSHKFNSFYGDPPEELPDFSEDPTSSGAVSQVPDSLEEIHALTDCSEKDLDFLHSVFQDHHLHTLLDLYDKINTKSSPQIRNPSSDAVQRAKEVLEEISCYPENTDAKELRRILTQPHFMALLQTHDVVAHEVYSDDAMRVTPPPTSPYLNGDSPESTNGDMDIENVTRVRLVQFQKNTDEPMGITLKMNDLNHCIVARIMHGGMIHRQGTLHIGDEIREINGISVANQTVEQLQKMLREMRGSITFKIVPSYRTQQSSCEKESPSTSRQSPANGHSSINSSILDLPSTIQPKGRQIYVRAQFEYDPVKDDLIPCKEAGIRFRVGDIIQIITKDAITGGRASWRTPKNGTAGLIPSPELQEWRVACIAMEKTKQEQQASCTWFGKKKRQYKDKYLAKHNAVFDQLDLVTYEEVVKLPAFKRKTLVLLGAHGVGRRHIKNTLITKHPDRFAYPIPHTTRPPKKDEENGKNYFFVSHDQMMQDISNNDYLEYGSHEDAMYGTRLETIRKIHEQGLIAILDVEPQALKVLRTAEFAPYVVFIAAPTITPGMTEDESLQRLQKESEILQKTYAHYFDQTIINNEIDETIRLLEEAIDMVCSTAQWVPVSWVY

SEQ ID NO: 17737 - protein, 409 aa, Corynebacterium glutamicum ATCC 13032
MPPFRYRCATVFRWLIFEIMRVGMMTREYPPEVYGGAGVHVTELTRFMREIAEVDVHCMGAPRDMEGVFVHGVDPALESANPAIKTLSTGLRMAEAANNVDVVHSHTWYAGLGGHLAARLHGIPHVATAHSLEPDRPWKREQLGGGYDVSSWSEKNAMEYADAVIAVSARMKDSILAAYPRIEPDNVRVVLNGIDTELWQPRPTFDDAEDSVLRSLGVDPQRPIVAFVGRITRQKGVEHLIKAAALFDESVQLVLCAGAPDTPEIAARTTALVEELQAKREGIFWVQDMLGKDKIQEILTAADTFVCPSIYEPLGIVNLEAMACNTAVVASDVGGIPEVVVDGTTGALVHYDENDVETFERDIAEAVNKMVADRETAAKFGLAGRERAINDFSWATIAQQTIDVYKSLM

SEQ ID NO: 17738 - protein, 498 aa, Corynebacterium glutamicum ATCC 13032
MESSMVENNVAKKTVAKKTARKTARKAAPRVATPLGVASESPISATPARSIDGTSTPVEAADTIETTAPAAKAPAAKAPAKKVAKKTARKAPAKKTVAKKATTAKAAPATAKDENAPVDDDEENLAQDEQDFDGDDFVDGIEDEEDEDGVEALGEESEDDEEDGSSVWDEDESATLRQARKDAELTASADSVRAYLKQIGKVALLNAEQEVSLAKRIEAGLYATHRMEEMEEAFAAGDKDAKLTPAVKRDLRAIARDGRKAKNHLLEANLRLVVSLAKRYTGRGMAFLDLIQEGNLGLIRAVEKFDYSKGYKFSTYATWWIRQAITRAMADQARTIRIPVHMVEVINKLGRIQRELLQELGREPTPQELSKEMDISEEKVLEIQQYAREPISLDQTIGDEGDSQLGDFIEDSEAVVAVDAVSFTLLQDQLQDVLETLSEREAGVVKLRFGLTDGMPRTLDEIGQVYGVTRERIRQIESKTMSKLRHPSRSQVLRDYLD

SEQ ID NO: 17739 - protein, 281 aa, Corynebacterium glutamicum ATCC 13032
MDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 17740 - protein, 506 aa, Corynebacterium glutamicum ATCC 13032
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 17741 - protein, 162 aa, Oryza sativa; identical to SEQ ID NO: 3414

SEQ ID NO: 17742 - protein, 161 aa, Oryza sativa; identical to SEQ ID NO: 3312

SEQ ID NO: 17743 - protein, 228 aa, Gossypium marchantii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHBKPVQEVLAEMTNGGVDRSVE

SEQ ID NO: 17744 - protein, 430 aa, Bifidobacterium longum DJO10A
MLEFLSDARRRGSPMKVDILTREYPPHVYGGAGVHAEELSKVLAERIDVTVRAFDGKRTEADIPAIPNAADAKGSLKVVGYDTPSELADANPALKTFGVDLQIANDVDADIIHAHTWYACLAGYMAKMLHGTPLVITAHSLEPFRPWKREQLGGGYNLSSWAEKDAYEHADRVIAVSGGMRKDILTAYPNLDPNKVVVVYNGITMADFATPAPDDPGWKVFERYHIDRSKPTLLFVGRITRQKGLPYLLKALHLISKDIQVVLCAGAPDTPEIAEEVKIAFAKLDEERGNIVWIEEMLPKPELNALEHGCDAFICPSIYEPLGIVNLEAMACGLPVVASATGGIPEVVVDGETGYLVPIDQLHDGTGTPTDPDKFVHDMAAAIDRIMADPELAKKMGQAGYERARDVFSWETIADKTVEVYQSVLDEQKK

SEQ ID NO: 17745 - protein, 475 aa, Bifidobacterium longum DJO10A
MDETFELSAAKMREHGMSETAINQFHHLYDVWRHEEASSWIREDDIEPLGHVPSFHDVYETINHDKAVDAFAKTAFLKLNGGLGTSMGLDKAKSLLPVRRHKAKQMRFIDIIIGQVLTARTRLNVELPLTFMNSFHTSADTMKALKHHRKFSQHDVPMEIIQHQEPKLVAATGEPVSYPMNPELEWCPPGHGDLFSTIWESGLLDVLEERGFKYLFISNSDNLGARPSRTLAQHFENTGAPFMAEVAIRTKADRKGGHIVRDKATGRLILREMSQVHPDDKEAAQDIAKHPYFNTNSIWIRIDALKDKLAECDGVLPLPVIRNKKTVNPTDPNSEQVIQLETAMGAAIGLFNGSICVQVDRMRFLPVKTTNDLFIMRSDRFHLTDTYEMEDGNYIFPNVELDPRYYKNIRDFDERFPYAVPSLAAANSVSIQGDWTFGRDVMMFADAKLEDKGEPSYVPNGEYVGPQGIEPDDWV

SEQ ID NO: 17746 - protein, 432 aa, Bifidobacterium longum DJO10A [sequence omitted]

SEQ ID NO: 17747 - protein, 215 aa, Bifidobacterium longum DJO10A
MTKAAIFDLDGTLLDSMGVWDQVDIDFLNKRGIEVPPDYMTKVSAMQFRQIAEYTIARFGLTDTPEELMQEWDDMASVAYSTTVEAKPGALDYLRDLKDSGVKLGVATSLPPRLREPALRHVGMFDLFNDIVSVDDANDVGKDQPDVYLLAARRLGAAPVDCTVFEDLLVGMKSAKSVGMKVWAMHDDSSASDWPEICHLADGVLFDFHDAPRVL

SEQ ID NO: 17748 - protein, 275 aa, Bifidobacterium longum DJO10A
MAIQSTIMLNNGTVIPQVGLGVFQTPDGDTTVNAVQTALENGYRHIDTAMIYHNEASVGEGIRRAGVPRSDFFLTTKLWNDDIRARCGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 17749 - protein, 545 aa, Bifidobacterium longum DJO10A
MRCRTRQRISERSQACVVKVSACSYSVCMATKLDELNAQSAYAPLPPIFAKLGLAYDDVLLLPNETDVIPSEVDTSTHLTRKIVMKAPVLSAAMDTVTESEMAIAMARNGGIGVLHRNLSIDDQAAQVDVVKRSESGMITDPLTVNPEVTLADLDKLCGKFHISGLPVVDKENKLVGIITNRDMRFIASEDYDTLKVKDVMTKENLVTGPSNISKDDAHRLLAQHKVEKLPLVDEEGHLTGLITVKDFVKTEQYPDATKDEQGRLRVAAGVGFLGDAWQRASALMEAGVDVLVVDTANGEARLALDMISRLKHDSAFDGVQIIGGNVGTRSGAQAMIEAGADAVKVGIGPGSICTTRIVAGVGVPQLTAVYEAAQACRAAGVPCIADGGIHYSGDIAKALVAGASSVMLGGTLAGCEEAPGEKVLLHGKQYKLYRGMGSLGAMAPRGKKSYSKDRYFQADVTSSDKVVPEGVEGEVPYRGPLNAVLYQMLGGLHQSMFYIGAHNIAEMPERGKFIRITDAGLRESHPHDIVMTTEAPNYSGFHNN

SEQ ID NO: 17750 - protein, 559 aa, Bifidobacterium longum DJO10A
MRTIQGVSVSAGIAIGTVRVLAAVDYAVERRLIDDPQAEMDRFRAARDTAVAQLKQLRDNVAAEFGENKAELFDAHRLMLQDPDYAECVEGLIAQDKVNAEFAVKSAAEQFAAMFAAMDSSTMQARAADVKDVSRRVMNVLQGKRDSTAQDGSVQGDAVQNGIVQNGIAQNGESHIIFAEDLAPSDTAQLDRAKVLGLVTAKGSANSHTAILARTMGLPAITGIGDAFDPADDGHVAVIDGTSGAVFVDPDEATLTEYRRRKAEAEEHLSLLRKLKGKPTETKSGQRVHLYANISRPSDAAAVLANDAEGIGLFRSEFLYLEREDWPTEEFQFDAYGQVAQEMGDRPVIIRTLDIGADKQVDYFNLSHEDNPALGYRAIRICLTRPEIFKVQLRALLRASAYGNIAIMLPMITSVQEVRDAKRILEEAKSELRGERIDFNESIQIGVMIETPASVIMADELAAEVDFFSIGTNDLTQYTLACDRQNPSLERFADPHSPAVLRMIQMTIEAAHRHGIWCGICGELGADLSLTDTFLRLGIDELSVSPTSVLPLRNVIRNH

SEQ ID NO: 17751 - protein, 112 aa, Bifidobacterium longum DJO10A
MKLITAIIQPHKLDDVKEALAAAGVHGLTVSEANGYGRQRGHTEVYRGAEYTVDLIPKIRVEVLSDDADAETLVGVIIKSAGTGTIGDGKVWVAPLDSVARVRTGETGSAAI

SEQ ID NO: 17752 - protein, 500 aa, Bifidobacterium longum DJO10A
MRTMGNMKKSITADSDFAAWAAARSQKTNRSLAGARLAIPEPQKHAEIKSQAQQWGMTVEDATMTDGHSEEFLCDGTQSIDSITDMRKASGLEAMEYAEQHMPVLRDTMDSLTTRVDFSGIRIAVCLILEPKTAILLRKLKAAGAIVGVYCGPDSTDPRVAEQLRREGITVESSRDWTAEQAHEAALHLLDEIQPDIIIDDGASFARLASLERPELTANLIGVAEETTSGVRAFQQMQEAGALTYPVVAVNDSVLKTGFDNAHGTGETCVTTMQRILGEHAFDGKNVTVIGYGPVGQGFARRIRALGAEVTICDIDPVASLKAVFDGFAAQDIDEALPCADMVVSATGVRHTVTLEHMRAMHEGAALAVIGGIANEIALDEVSDFTPQVNRDTVQLNVPNGPTLTLIADGDGVNYTVGGGNPIEIMDLSFAVQASAVAYLLEHRGTLDHTLIRLDAATDQRIAASALKARGYRASHAVEDNGYNWRLTRFAENDRENADR

SEQ ID NO: 17753 - protein, 793 aa, Bifidobacterium longum DJO10A
MRIRPSLRAPWYQKELPHSLSHIAQRTNHPFTEMLGALLRHVDLGQCRALAFNFGKTSEGRFEGMRSASGNGFDSSDSFAVSGAAERTARLHDIPPSITPSHGDDSHLLSRIASPADVKALAPNELAELCREIRTTLLAYGHQHGGHIGSNLGMVEATVALHRVFDSPRDRIVFDVSHQSYVHKMLTGRAAAYLDPDRFSEVTGFTNPDESKHDQFVLGHTGTSISLACGLAKTRDMEGPNSGIGNVIAVIGDGSLSSGVAFEGLNNAAEQGGNLIIVFNDNEMSIAGDFGGMYGPLARLRASGGTAQPNLFNAFGLDYRYVEAGNDVSALVAAFEEVRDIDHPVVVHIHTLKGAGYDGEETHADRQTASASPVSFDSPTGVHPTDNVNHSEPWHSDHCNLSDHEPHEGQCEASHWQNPDAAIGKPDDPRKHYGKMAMAALEPRFAAEPGLVVISPATPGSNGITHEFRERAGAHYVDTGITESHAVAYAAGIARAGGTPVVATTASFFQRAYDQFFQEMSLNRSRVTVLDFLGGLSGSDNTHSGAYDVTMFSNIPGATMLVPTSARDYLADLAWATAPAGSADAPAGPVVIRVPGEAILTAERDATLLPVTGGQIADRPQSTSLPVSVSSASGGISAATVRGTVSVTAQRAGVRHMLDWRVNQTGSHVAIIGLGNAYPLAEQTAAALSADYGITATVIDPRQCTSLDSDVLESLRDGHQQVITLEDGQLEGGWGEKVTAYYANHHVSDGSRNPRVLNFGAAKEFTDRVSLGELNERYGLTVEQVTEAITRCF

SEQ ID NO: 17754 - protein, 289 aa, Bifidobacterium longum DJO10A
MTNGHINPANVPDIALKDGHSIPQVGLGVLRIDDEGVVPVVESALEAGYRHIDGAAGYNNEAGVGRALAASGYNKGTKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 17755 - protein, 177 aa, Bifidobacterium longum DJO10A
MGTMKKTLSLRPIMHIMRRYEKRHTLVGMEYDEAMRRALELAGQAAAAGDVPVGAVVLDAAGQIVGRGYNTREADGDPLAHAEIIAMRQAAQALGAWNLADCTLAVTLEPCPMCAGACIQTHIGTIAFGAWDPKLGACGSIWDIPRDPHIGHSPEVHGGVLEGECQSILTDFFAQRR

SEQ ID NO: 17756 - protein, 690 aa, Bifidobacterium longum DJO10A
MAVFELILCIIAAVVVSSFASRFVPKVSTPLVQIVLGVLVTYLPFFPDATLDPELFMVLFIAPLLYLEAHEIDKSALLKTLDLSLSLAIGLAIVTMAAVGFTLHAVWPSITLASALALGAALGPTDAVAVSSLGKEASLTQRQRSVLKGESLFNDASGIVGFQFALAAAFTGEFAVGQAAGEFVISFFGGTLFGLVIAAAANWLFETVRSLGWETTTTRILMELFLPFLLYLGAEEFNVSGILSVVAAGLFIRFDRTGVGPNVARTNIVSTSVWGVLSFSLNGAVFILLGMQLPRAMMASWSDPYISNTVLIGIILLVTLVVIALRFFWIAAMLRVARDTITGQRRKMTPERWRSAAVMTFGGPKGTITLSLMFTIPYYIAGGAPFPMRDELIFIASGVIIATLLLANFLLPLLAPNRGKDPSAEIIPVTIDVLRATVEELTGRITPENRRAILMVIDQYTKRIGRLQQRIGDTDPQGFEQLQIEALHWEKEFVRDRLADTKAHPAADTATQELNVETCERMLDQIMNTLRHTSTDPTSGHAVSQIRGRLRMFQRQMSNYAKRTVSKIRHTTPLVSEDQIFARTRELQVEAIHHVIGRLIDEMGQDTYNTEHCSALLLDYRRAEASLQARPTMSGTTETITQVEDVKRESYGIELGMIQDMYEAGDINRAQARSLRRNIYVMQVDADSGI

SEQ ID NO: 17757 - protein, 396 aa, Bifidobacterium longum DJO10A
MSIASNSTVIILGSTGSIGTQGLDVISRHPERFTVTGLAAGGAHIELLAQQAAQFHVSEAAVFDETKVPALQAALAQAGAQGVRVTGGPDSVIAMAGSGANVVLNGITGSIGLEPSIAALKAGSQLALANKESVVAGGHLLFSAQVRENQINPVDSEHSAIWQSLRSGTHAEVAKLVVTASGGPFRGWKRADMENITPEQALHHPTWNMGPVVTINSSTLMNKGLEVIEASRLFNVPPERIDVTVHPQSIVHSMVEFVDGATICQASPPDMRLPIALGLSAPDRMTNVAAACDWTQAATWTFEPLDDEAFPAVQLARHCLAASEKHTAVLNAANEQAVHAFLEHRLPYLGIVDTVKAVLDQMDAELRGNPLFTDVEEMNQLELEARRRADDLINKQ

SEQ ID NO: 17758 - protein, 371 aa, Bifidobacterium longum DJO10A
MSDARQIEADIYERLSKVIDPELGRSVTDLGMIAAIEAAPASSDAGTYDVTVHVELTVPGCPLSETITSQINGAVSSYPGAQLLPHIEVGSMSRGKLADLVADLKAERKQNPFSKPGVKTRIFAIASGKGGVGKSSVTANLAATFAALGFDTAAIDADIYGFSLPRLFGVHTQPTNLNGMLMPVTAWGVKLISIGMFAGADRAILWRGPRLQRSLEQFLSDVWWGEPDVLLLDLAPGTGDMAISVAQALPNAELVVVTTPQPSASDIAVRSGLVALQVPMKVRGVVENMSYYEHKGEKLEIFGAGGGQRVSEQLTQALGYDVPLMAQLPLEPEVRETGEAGRPAVLDADGALRTDGIGQTFRGLAERLLAV

SEQ ID NO: 17759 - protein, 297 aa, Bifidobacterium longum DJO10A
MMEQICHHRRSRRTIMLEPPVTPIRKANDGLELPATGFGTYKVNGLAGVDAIKSAIHQGYRLIDSAFNYENEGVVGRAIRESGVPREDIIVTSKLPGRHHAHDEALLTIEESVCRMGLDYIDLYLIHWPNPSQGQFVEAWEALVEARERGLVKHIGVSNFLPGHIDLLIRDTGVTPAVNQVELHPYFQQREQLAYDNAHGIITEAWSPLGRANQMLRDPDLKRIAAKHGISVVQAILRWHLQYGDVAIPKSLNPERQRQNLDLTAFELDDQDMADIAAMDNPEGHTFGQNPHWHEEA

SEQ ID NO: 17760 - protein, 535 aa, Bifidobacterium longum DJO10A
MRQRGHAAGAARQRRKDKAMTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 17761 - protein, 279 aa, Bifidobacterium longum DJO10A
MAAGVGFLGDAWQRASALMEAGVDVLVVDTANGEARLALDMISRLKHDSAFDGVQIIGGNVGTRSGAQAMIEAGADAVKVGIGPGSICTTRIVAGVGVPQLTAVYEAAQACRAAGVPCIADGGIHYSGDIAKALVAGASSVMLGGTLAGCEEAPGEKVLLHGKQYKLYRGMGSLGAMAPRGKKSYSKDRYFQADVTSSDKVVPEGVEGEVPYRGPLNAVLYQMLGGLHQSMFYIGAHNIAEMPERGKFIRITDAGLRESHPHDIVMTTEAPNYSGFHNN

SEQ ID NO: 17762 - protein, 355 aa, Homo sapiens [sequence omitted]

SEQ ID NO: 17763 - protein, 377 aa, Nicotiana tabacum
RPPFSLFISLLPRRHIFSYTHFASMSTNFLGSPPPLFKNVISPCNKLSTFTIRACLHSCEPKIDDHIYNNYTKYCTPNFPNHVSQTPISEKQPKTNKNHTILDNFAKDDDLWLKMQKEARLDIEQEPLLSNYYKNSILAHDSIESALANHLSMKLSNLSISSETLYDLFMGVLTEDQELIFDVNADLIAVKERDPACISYIHCFLNFKGFLACQAHRIAHKLWSKGRKILALVIQNRVCEVFAVDIHPGARIGRGILLDHATGVVIGETAIIGNNVSILHNVTLGGTGKMCGDRHPKIGDGVLIGAGTCVLGNVRIENGAKIGAGSVVLMEVPARTTAVGNPARLIGGKANPIKLDKIPSLPMDHTSYLSEWSDYVI

SEQ ID NO: 17764 - protein, 324 aa, Nicotiana tabacum
AAATPPTNPLSRDPNKPQIDNHVYNYVKFCRPSFPELVSCAPIPEKNSKIGRNEEEDDLWLKMKDEARSDIDQEPILSTYYITSILAHDSMERALANHLSMKLSNSSLPSSTLYDLFLGVLTEDCSQDIIKAVIADLRAVKERDPACISYVHCFLNFKGFLACQAHRIAHKLWSNGRQILALLIQNRVSEVFAVDIHPGAKIGKGILLDHATGVVVGETAVIGNNVSILHNVTLGGTGKISGDRHPKIGDGVLIGAGTCVLGNVIIEDGAKIGAGSVVLKKVPARTTAVGNPARLLGGKENPKKLDKIPSLTMDHTYEWSDYVI

SEQ ID NO: 17765 - protein, 300 aa, Nicotiana tabacum
RPPTLSDMPAGEYRNATPATPHPPTDTAEESTWLWTQIKAEARRDAEAEPALASYLYSTILSHSSLERSLSFHLGNKLCSSTLLSTLLYDLFLNTFSNEPELRAAASADLLAARYRDPACVSFSHCLLNYKGFLACQAHRVAHKLWTQSRRPLALALQSRISDVFAVDIHPAAKIGKGILFDHATGVVVGETAVIGNNVSILHHVTLGGTGKIGGDRHPKIGDGVLIGAGATILGNVRIGEGAKIGAGSVVLIDVPPRTTAVGNPARLVGGKEQPTKHEECPGESMDHTSFISEWSDYII

SEQ ID NO: 17766 - protein, 409 aa, Lycopersicon esculentum
IGINYPGTKAELRGCINDVRRMYNCLLNRYGFAEEDITVLIDTDDSYTQPTGRNIRKALSDLVGSAESGDCLFVHYSGHGTRLPAETGEEDDTGFDECIVPCDMNLITDDDFRELVDKVPEGCQITIVSDSCHSGGLIDKAKEQIGESHKQGDDDEGHGSGFGFKNFLRRNVEDAFESRGIHLPGRHHRREEEEENFAESSVIETEDGDQVHVKSKSLPLSTLIEILKQKTGKDDIDVGKLRPTLFDVFGEDASPKVKKFMKIIFNKLQKNNEQGGGGGFMGMVGNLAQEFLKQKLDENDESYAKPAMETHVEGKQEVYAGSGNRGLPDSGILVSGCQTDQTSADATPAGGESYGALSNAIQEILAESDGPVTNEELVSKARKKMQKQGFTQRPGLYCDDHHVDAPFVC

SEQ ID NO: 17767 - protein, 97 aa, Mirabilis jalapa
KSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 17768 - protein, 93 aa, Mirabilis jalapa
VKVSMDGAPYLRKIDLKVYQSYAELLRGLENMFKVRIGSYSERDGYNGSDYVPTYEDKDGDWMLVGDVPWEMFISSCKRLRIMKSSEAKGLGS

SEQ ID NO: 17769 - protein, 48 aa, Mirabilis jalapa
EDRDGDWMLVGDVPWEMFVNSCKRLRIMKGSEAIGLAPRAVEKCKSRS

SEQ ID NO: 17770 - protein, 52 aa, Mirabilis jalapa
NVLTYEDKDGDWMLVGDVPWEMFIDSCKRLKIMKSSDAIGLAPRTMEKSKSQ

SEQ ID NO: 17771 - protein, 729 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 17772 - protein, 459 aa, Ustilago maydis
MSSITLSRLMVTSPSITATLTRSVGVFSTTLTYHGCEANGENAFFVADLSEVYRQHLRWMRALPRIVPFYAVKCNPDPYVLQLLGALGTGFDCASNGEIEAVLKLGINPARIIYANPSKAASFVRHAAGHNVGLTTFDNMDELEKMKRYHPSCKLVVRILTDDSKSACQLGLKFGAPIASVPRLLERARELELDVVGVSFHVGSGCYDPDSFRDAVYRACAFEMGKQAGFSFDLLDVGGGFGHDNFEMVAGVLGPAIDAYFPDEDFAPGGKEVVGKVNGLRIIAEPGRFYVHSAFALATNIIAVRRGEPSAAMDHVEATPKAQVMYYQNDGLYGSFNCVIFDHVKFIQSSDAGPRVRVRADDWVARGASGECGRLALQQEAMTLESCSVWGPTCDSIDCVRDHVELPKGLQVGDWLVYENMGAYTICAASTFNGIRRSEIRYTLGHGQDADIVRQLMLQ

SEQ ID NO: 17773 - protein, 200 aa, Pan troglodytes
ADLGDILKKHLRWLKALPRVTPFYAVKCNDSKAIVKTLAAIGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSE

SEQ ID NO: 17774 - protein, 200 aa, Gorilla gorilla
ADLGDILKKHLRWLKALPRVTPFYAVKCNDSKAIVKTLAAIGTGFDCASKTEIQLVQSLGVPPVRIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSE

SEQ ID NO: 17775 - protein, 200 aa, Pongo pygmaeus
  unsure (1)..(200): unsure at all Xaa locations
ADLGDILKKHLRWLXAVPRVTPFYAVKCNDSKAIVKTLAAVGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSE

SEQ ID NO: 17776 - protein, 200 aa, Macaca sp.
ADLGDILKKHLRWLKALPRVTPFYAVKCNDSKAIVKTLAAVGTGFDCASKTEIQLVQNLGVPPERIIYANPCKQVSQIKYAANNGVQMMTFDSEVELMKVTRAHPKAKLVLRIATDDSKAVCRLSVKFGATLRNSRLLLERAKELNIDVVGVSFHVGSGCTDPETFVQAISDARCVFDMGAEVGFSMYLLDIGGGFPGSE

SEQ ID NO: 17777 - protein, 200 aa, Saguinus oedipus
ADLGDILKKHLRWLKALPRVTPFYAVKCNDSRAIVNTLAAIGTGFDCASKTEIQLVQSLGVPPERIIYANPCKQVSQIKYAANNGVQMMTFDSEVELMKVARAHPKAKLVLRIATDDSKAICRLSVKFGATLKTSRLLLERAKELNIDVIGVSFHVGSGCTDPETFVQAITDARCVFDMGAEVGFSMYLLDIGGGFPGSE

SEQ ID NO: 17778 - protein, 168 aa, Vibrio cholerae
DATQLYLSEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQRLDHEPTPEEIALELDRPVDDVTKMLRLNERITSVD

SEQ ID NO: 17779 - protein, 436 aa, Trypanosoma brucei
MNPTALREVSNLSTGSGDVKQRLAQRRSANLESCRYPYSSSAVRHGSGSLLSLRSSLYSPVGTAGKESSVSPHADRLRENNPVYCSDVIKDITTMYMESEKEAIYGQVLPSPRYLTYQPEINEKMRMILVDWLIDVHLKFKLHPETLYLTVSIVDRYLSSVNTRRTTGRYIPRSKLQLVGITAILLAAKYEEIWPPEVKECVYICANTYTRDEVIRMEREMCTELSFRFTVPTPFPFIVRLLDVVEGLERQQQTQQLSHQLQQIQSQSQSQSQQTQMQASQSQPQSLSRSRSQSRSQPRSDEECTAYVLQLRHTAFFFLDHGMLDYKCLQFSPSQQAKAALFLALVTLHMKEQGSSYVLNNDIIWTRQLQYYSKAQVRDFKACARTMLDFVSYVSTTRYQSVRRKYSSSKYGEVAKLTMPSKYLTFDWFTSLHSAV

SEQ ID NO: 17780 - protein, 426 aa, Trypanosoma brucei
MNPTALREVSNLSTGSGDVKQRLAQRRSANLESCRYPYSSSAVRHGSGSLLSLRSSLYSPVGTAGKESSVSPHADRLRENNPVYCSDVIKDITTMYMESEKEAIYGQVLPSPRYLTYQPEINEKMRMILVDWLIDVHLKFKLHPETLYLTVSIVDRYLSSVNTRRTTGRYIPRSKLQLVGITAILLAAKYEEIWPPEVKECVYICANTYTRDEVIRMEREMCTELSFRFTVPTPFPFIVRLLDVVEGLERQQQTQQLSHQLQQIQSQSQSQSQQTQMQASQSQPQSLSRSRSQSRSQPRSDEECTAYVVQLRHTAFFFLDHGMLDYKCLQFSPSQQAKAALFLALVTLHMKEQGSSYVLNNDIIWTRQLQYYSKAQVRDFKACARTMLDFVSYVSTTRYQSVRRKYSSSKYGEVAKLTMPSEVPDF

SEQ ID NO: 17781 - protein, 325 aa, Trypanosoma brucei
MSDTLSSKLDDVDADVLRGAYEPVAIIGEGTYGVVFRARGVASGAEFVIKKLRSDKLKEGVPATTLREVTLLHEMSDNPNVVRLLDVLCSKRRVYLVFELLNEDLRSFIRRNYPQPSATASSSVVPLRLVKNFTCQMLHALWRCHQNRIIHRDLKPANVLLGVKKSTRNDGEDSYILKLADFGLARTYEMTLLTYTKEVMTLWYRAPEILLGERHYTPAADVWSVGCIVLEMIVGCPVFRGESNRDQLDRIFYTVGTPTEETWAGVAMMPGYDKATKIYKVAPLHERLPTFDKEAVQFVAFLLQVNPKSRPTIPTILQHPFLQGD

SEQ ID NO: 17782 - protein, 249 aa, Phytophthora infestans
MDRDSLVFLAKLAEQAERYDEMVDHMKAVANNHNVELTVEERNLLSVAYKNVIGSRRASWRVISSIENKGDSERSEHIKAYRQKIEGELVDICNDILTIIENNLIPNSSSEEGKVFYYKMKGDYHRYLAEFQVDDERKESSDKALESYKQASTIAMAELPPTHPIRLGLALNFSVFYYEILNSPDRACNLAKQAFDDAIAELDTLSEESYKDSTLIMQLLRDNLTLWTSDQEPDNADANQGDMNVQDVE

SEQ ID NO: 17783 - protein, 310 aa, Phytophthora infestans
MSALTQYKPVATSEKKSGAMSFLLDLAAGGVAGGISKTVVAPIERVKLLLQVQAASTQIKPEDQYKGIVDCFVRVTKEQGVNSLWRGNLANVIRYFPTQALNFAFKDKFKKLFMDGVTKEQFWRFFMGNLASGGAAGATSLLFVYPLDFARTRLGADVGKGKSRMYTGLVNCVSTIYKSDGISGLYQGFGVSVGGIIVYRAAFFGGYDTLRDVALRDPKNAPVWQKWLVAQTVTSLAGMISYPFDTVRRRMMMQAGRKDILYTSTLDCAMKIAKNEGSGAFFKGAGSNILRGTGGAIVLVLYDEFKKMMV

SEQ ID NO: 17784 - protein, 215 aa, Phytophthora infestans
MGAMLPYWFTAMTMKSVGVAAMEMVKEVKHQFATIPGLLEGLPGHGPPDHARCIKISTDASLREMIPPGLLVMLSPIIAGTFFGVHAVSGLLVGSLTSGVQLAISQSNTGGAWDNAKKFVEKGCVSIEDKEGKLIVQGKGSAIHKAAVIGDTVGDPLKDTSGPALNILMKLMAIISLVFGDFFKSINNGRGLLNVPADVSAAAAPVVEVTAAPQL

SEQ ID NO: 17785 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 17786 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 17787 - protein, 422 aa, Phytophthora infestans
MPLPPPTSALERLDALAETYGTPLQIYDEQLIRDNARRLLTAFRAHFPDFQQFYAVKALPNPAILKLLHQEGCGMDCSSSAELHIVKELGVPGDQVIFTSNFTAKNDLGTAFDQGVIMNLDDVSLVDSLVAVRGKCPELMSFRLNPGIGRTDSETKSNVLGGPDAKFGVPPFQIVEAYRKAQQAGAKGFGIHMMTGSCVMNQEYWRETVTVLFNTIVQLKKELGIEFEFMNIGGGLGIPYREDQEPVNVEAIAKMLREVFDEAVKEHGLQTLPRLCMENGRFMTGPFGWLVTRCEAIKETYGRYYGVDACMAHLMRPGMYGAFHHISIPARANEEVSPSHVVGTLCENNDWFAKDRPLPKAQVGDLFVIHDTGAHSHSMGFQYNGKLRAPEVLLRADGSDSLIRERETYDALYGNCVIPADL

SEQ ID NO: 17788 - protein, 287 aa, Biomphalaria glabrata
  unsure (1)..(287): unsure at all Xaa locations
KLARPFQTAIXAKRTYRELRMLRHMNHENVIELMDCFTPTVRLEDFTDVYLVTPLMGADLNNILKTQRLSDDHVQFLIYQILRGLKYIHSAGILHRDLKPSNIAVNEDCELKILDFGLARHTDEEMTGYVATRWYRAPEIMLNWMHYNQTVDIWSVGCIMAEMLCGKPLFPGSDHIDQLTRILSLVGTPSEELMEEIKSNDAKLFIKSLPVMQHKDFKVVFSGASPLAIDLMEKMLDLNTKTRLNATQALAHEYLKQYADPNDEPEAEKYDQSFEDLDLGIREKKKT

SEQ ID NO: 17789 - protein, 756 aa, Mus musculus
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADVQHWVQGLRKIIDRSGSMDQRQKLQHWIHSCLRKADKNKDNKMNFKEVKDFLKELNVQVDDSYARKIFRECDHSQTDSLEDEEIETFYRMLTQRVEIDRAFAEAAGSAETLSVEKLVTFLQHQQREEEAGPALALSLIERYEPSETAKAQRQMTKDGFLMYLLSADGNAFSLAHRRVYQDMNQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMAHHLRAILGPMLLDQPLDGVTTSLPSPEQLKEKILLKGKKLGGLLPAGGENGPEATDVSDEDEAAEMEDEAVRSQVQHKPKEDKLKLVPELSDMVIYCKSVHFGGFSSPSTSGQAFYEMASFSESRALRLLQESGNSFVRHNVGHLSRIYPAGWRTDSSNYSPVEMWNGGCQIVALNFQTPGPEMDVYLGCFQDNGGCGYVLKPAFLRDPDTTFNSRALTQGPWWAPKKLRVWIISGQQLPKVNKNKNSIVDPKVIVEIHGVGQDVASRQTAVITNNGFNPRWDTEFEFVVAVPDLALVRFMVEDYDSSSKNDFIGQSTIPWNSLKQGYRHVHLLSKNGDLHPSATLFVKISIQD

SEQ ID NO: 17790 - protein, 215 aa, Pan troglodytes
EGDRGASKNWKLSIRCGGYTLKVLTENKFLPEPPSTRKKRILESHNNTLVDPCEEHKKKNPDASVKFSEFLKKRSEMWKTIFAKEKGKFEDMAKADKAHYEREMKTYIPPKGEKKKKFKDPNAPKRPPLAFFLFCSEYRPKIKGEHPGLSIDDVVKKLAGMWNNTAASDKQFYEKKAAKLKEKYKKDIAACRAKGKPNSATKRVVKAEKSKKKKE

SEQ ID NO: 17791 - protein, 386 aa, Arabidopsis thaliana
LCAILILRAPLAHSLIPPLTCVNTGTVESDVTGIRFDRCLDTDSLAKISLSTVMSKARVYTDVNVIRPKDYWDYESLNVQWGEQDDYEVVRKVGRGKYSEVFEGINMNNNEKCIIKILKPVKKKKIRREIKILQNLCGGPNIVKLLDVVRDQHSKTPSLIFEYVNSTDFKVLYPTLTDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDTQLEALVGRHSRKPWSKFINADNRHLVSPEAIDYLDKLLRYDHQDRLTAKEAMAHPYFAQVRAAESSRMRTQ

SEQ ID NO: 17792 - protein, 587 aa, Arabidopsis thaliana
VESRQASGIINKQSTSLLIRFSLYLEASISTKSFFSKSQRISQTQSPICLSANYYQPDNLDMEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 17793 - protein, 269 aa, Arabidopsis thaliana
KLRLVDLPENCVALIMTRLDPPEICRLARLNRMFRRASSADFIWESKLPANYRVIAHKVFDEITLTKLIKKDLYAKLSQPNLFDDGTKELWIDKNTGRLCLSISSKALRITGIDDRRYWSHIPTDESRFQSAAYVQQIWWFEVGGEFEIQFPSGTYSLFFRIQLGKTSKRLGRRICNSEHIHGWDTKPVRFQLATSDNQQAVSLCYLNNNPGSWSHYHVGDFKVTNPDVSTGIKFSMTQIDCTHTKGGLCIDSVLILPKECAKEVIGSQ

SEQ ID NO: 17794 - protein, 323 aa, Mus musculus
MAACGEPGRPWQEEEAAAVVVVGSCMTDLVSLTSRLPKTGETIHGHEFFIGFGGKGANQCVQAARLGAKAAIVCKVGNDSFGNDYIENLKQNHISTEFTYQTRDAATGTASIIVNNEGQNIIVIVAGANLFLNSEDLKKAASVISRAKVMICQLEISPAASLEALTMARRSGVKTLFNPAPAMADLDPQFYTLSSIFCCNESEAEILTGHAVSDPTTAGKAAMILLERGCQVVVITLGASGCVILSQAEPVPKHIPTEAVKAVDTTGAGDSFVGALAFYLAYYPNLSLEEMLKRSNFIAAVSVQATGTQSSYPYKKDLPLALF

SEQ ID NO: 17795 - protein, 626 aa, Drosophila melanogaster
MSTLANGGKEEDLKILAQLKSIEQINEQRRIFLNSTINEEVPEATNGSTVREEDLEKNLKAIDEPQSTKMPPEEVAKKTPDEVPAQEQQKEPEKVEPAKPVPPNTLTLNVKYATLPSPNVVTLRSPLSPPPKPPMLGRTRSTGPADGKGPASNGALSPDSSIIRQSFPEGVITPSKPEKSPATPSEEGPPTVSARHYEGLIEELRCPGCAGAMKAPILLCKSGHSVCEQCTRILLMCPLCKEPFTNSRSLTVEALCAKAHFRCGHASGGCQVRMPVVLLPWHEQQCMYKPMKCFMGRVWGDCRWQGREVQWKEHLEEQHDDRLFRSSSADLEWNLGTRRKPLTGYYVFQAHDEMFNFYEIHDRQRVLFTMTCTSNRRDSKYNFAYEVTVLLPDNEALSMTQKFPVHSEYDKDILMEGTCVSIPLTELNRFLDQDKVLHYRVSVLAVKSPRRAKPPRQNLPQPADLEQAPNGGVNVKSVPTNMIITRTYKEAIGEVTKADVASPDSEEDPAAADGAGAIGADGAGGVELERKWGTPQLHFNRKYLRNTLNDATPAEDELRPLAADLRNGNGDDKLSQCSNSTSYTKKVSDSLRRSFRALKADIVELRPFSKKAVRDGSTSPVQSNGK

SEQ ID NO: 17796 - protein, 251 aa, Drosophila melanogaster
MSLSNKVVIVTGASSGIGAAIAQVLAREGATLALVGRNVANLEATKKSLKGTQAEIVVADVTKDADAIVQQTLAKFGRIDVLVNNAGILGKGGLIDLDIEEFDAVLNTNLRGVILLTKAVLPHLLKTKGAVVNVSSCAGIRPFAGALSYGVSKAALDQFTKIVALEMAPQGVRVNSVNPGFVVTNIHRNIGIVDEEYNGMLQRAINSHPMGRVGDVTEVAEAVAFLASSKASFTTGALFPIDGGKHNLTPR

SEQ ID NO: 17797 - protein, 339 aa, Homo sapiens
MEYAGHLPASSAQGTILACTSCTGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 17798 - protein, 164 aa, Cleisostoma racemiferum
IENKINRQVTFAKRRNGLLKKAYELSVLCDAEVALIIFSNRGKLYEFCSSTSMLKTLEKYQKCNFGSPESTIISRETQSSQQEYLKLKSRVEALQRSQRNLLGEDLGPLGSKELEQLERQLDSSLKQIRSTRTQFMLDQLADLQRREHMLCEANKALKRRFEES

SEQ ID NO: 17799 - protein, 198 aa, Saururus chinensis
NRQVTYSKRRNGLFKKAHELSVLCDAQVSIILIPNTRRHHDYCSPSATHKQVYDRYQQVRGVDLWSTQYEKNKSESFYWRQRMGKDLGHLTYNELRGLEQTVENAVNVIRDRKIKQIQNQIQKYDKKCKSLDDDNDVRLLQLQAIHENCRYYGFMENGGADHRTGFKLANQASHIFAFRGQPCQPNLHDASFRDRDTH

SEQ ID NO: 17800 - protein, 908 aa, Pantoea agglomerans
MTKYSLRARMMILILAPTLLIGLLLSTFFVVHRYNELQEQLVDAGASIIEPLAVASEYGMTFRSRESVRQLVSLLHRRHSDIVRSITVFDAQNNLFVTSNYHHNFAQLQLPKGVPMPTDLMLTRRGNSLILRTPILSESQYPDQNATDPVPQDNNLGYVAIELDLQSVRLRQYKEVFISTLLLLLCMCIAILFAYRLMRDVTGPIRNMVNTVDRIRRGQLDSRVEGFMLGELHMLKNGINSMAMSLTAYLEEMQQNIDQATSDLRETLEQMEIQNVELDLAKKRAQEAARIKSEFLASMSHELRTPLNGVIGFTRQMLKTEMSVTQTDYLQTIERSANNLLTIINDVLDFSKLEAGKLVLEHIPFSLRETLDEVIVLLAPSAHEKGLELTLDVHNDVPEQVIGDSLRLQQIITNLLGNAIKFTETGNIDIRVELRGQQDHQVELEVQIHDTGIGISERQQSQLFQAFRQADASISRRHGGTGLGLVITQKLVKEMGGDICFHSQLNRGSTFWFHITLELHEGMLSLPSSLPDLRGKTLGYIEANPMAAEATLNMLSVTSLVITHSPTLAQLPKKNYDFLLVGVPIPFRDNLAQHESKLKAALNIAGRVILALPCQSQINAEQLKQQGAIGCLIKPITSNRLFPLLRMEPPQRLLAAPERKRLPLTVMAVDDNPANLKLIGTLLAEQVEKTLLCESGEEALALARDNVLDLILMDIQMPNIDGIRTGELIRQLPHHNSTPIVAVTAHAVSGEREHLLQAGMDDYLAKPIDEAMLTRVLARYYSGEPAAEPLLSLDWPLALRQAANKEDLARDLLQMLLDFLPQVSERVQAVLDGTPDDSILDLIHKLHGSCSYSGVPRLKQLCFYLEQQLRKGVGNEELEPEWLELLDEIELVSQAARSHLESDRPTTS

SEQ ID NO: 17801 - protein, 612 aa, Pantoea agglomerans
MEQNPQSQLKLLVQRGKEQGYLTYAEVNDHLPEDIVDSDQIEDIIQMINDMGIQVMEEAPDADDLLLAENSNSTDEDAEEAAAQVLSSVESEIGRTTDPVRMYMREMGTVELLTREGEIDIAKRIEDGINQVQCSVAEYPEAITYLLEQYDRVEAGEARLSDLITGFVDPNAEEDIAPTATHVGSELSTEEQNDDEEDEEDDDDAEDDNSIDPELARQKFTDLRDQYEATRLVIKKNGRSHASAAEEILKLSEVFKQFRLVPKQFDFLVNSMRIMMDRVRTQERIIMKLCVEQCKMPKKNFVTLFAGNETSDSWFEAALAMAKPWSEKLKDVTDDVQRSLQKLRQIEEETGLTIEQVKDINRRMSIGEAKARRAKKEMVEANLRLVISIAKKYTNRGLQFLDLIRKGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATSESLRSATHDVLAGLTAREAKVLRMRFGIDMNTDHTLEEVGKQFDVIRERIRQIEAKALRKLRHPSRSEVLRSFLDD

SEQ ID NO: 17802 - protein, 331 aa, Pantoea agglomerans
MNQNTLKVNELQDDADFDENATEAESFDEKALVEEEASESDLAEELLSQGVTQRVLDATQLYLGEIGYSPLLTAEEEVYFARRALRGDVPSRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKDNGPEDTTQDDDMKQSIVKWLFELNAKQREVLARRFGLLGYEAATLEDVGREIGLTRERVRQIQVEGLRRLREILQLQGLSIEALFRE

SEQ ID NO: 17803 - protein, 453 aa, Persea americana
MDNKGGILMQRFELGRLLGQGTFAKVYHARNLKSSQSVAIKVIDKEKVLKVGMIDQIKREISTMRLASHPNVVQLYEVMATKTKIYFVLEYVKGGELFNKVAKGKLKEDVAWKYFQQLVSAVDFCHSRGVYHRDLKPENLLVDENENLKVTDFGLGALAESKRQDGLLHTTCGTPAYVAPEVISRKGYDGAKADIWSCGVILFVLLAGYLPFHDSNLMELYRKVGKAEYKCPNWFPPEVRRLLARILDPNPNTRISIAKIKDNSWFKRGFEAKFAKGETKSKELAPLDTDAAFASSDTGVAARKPELVKPQHLNAFDIISLSAGFDLSGLFEDTNCRKEARFASKQPASAIISKLEDIAKRLRLKVKKKDEGILKLEGSKEGRKGVLSIDAEIFVVNPSFHLVEVKKSSGDTLEYQKLWNQDMRPALTDIVWAWQGDQQQQQESLVCSLGQSL

SEQ ID NO: 17804 - protein, 245 aa, Lycopersicon esculentum
MGRGRVHLKRIENKINRQVTFSKRRSGLLKKAHEISVLCDAEVGLIVFSTKGKLFEYANDSCMERILERYERYSFAEKQLVPTDHTSPVSWTLEHAKLKARLEVLQRNQKHYVGEDLESLSMKELQNLEHQLDSALKHIRSRKNQLMHESISVLQKKDRALQEQNNQLSKKVKEREKEVAQQNQWEINSSSFVLPQQLDSPHLGEAYQSTNVIDNGEVEGGSSSQQQGAANNTVMPQWMLRHLNN

SEQ ID NO: 17805 - protein, 189 aa, Gossypium anomalum
HVGLNGNGKPFVACHDCNFPICKTCFDYELKEGRKACLRCGNPYDENLLDDAEKASGDRSTMAAHMDKSQDAGIHARHISSVSALDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 17806 - protein, 189 aa, Gossypium somalense
HVGLNGNGKPFVACHDCSFPICKTCFDYELKEGRKASLLCGNPYDENLLDDAEKASGDRSTMAAHMDKSQDAGTHARHISSVSTLDSEMTEENGNPIWKNRVESWKEKKNKKKKTSIEVEIKAQVPPGQLMEDKPAADTFQSLSTVVPIPKSRLAPYRTVIIMRLIILGLFFRYRVTNPVNSAFALWLT

SEQ ID NO: 17807 - protein, 189 aa, Gossypium longicalyx
HVGLNGNGKPFVACHDCNFPICKTCFDYELKEGRKACLRCGNPYDENLLDDVEKASGDRSTMAAHMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 17808 - protein, 189 aa, Gossypium bickii
  unsure (1)..(189): unsure at all Xaa locations
HVGSNGNGKPFVACHDCNFPICKTCFDYEFKEGRKACLRCGNPYDENLLDDAEKSSGDRSTMAAHMDKSQDAGIHARHISSVSTLDSEMTEDNGNPIWKNRVESWKEXXIXNNKTSIKVEIEAQVPHEQIMEDKPAADAFQPLSTVIPIPKSKLAPYRTVIIMRLIILGFFFHYRVTNPVDSAFALWLT

SEQ ID NO: 17809 - protein, 190 aa, Kokia drynarioides
HVGLNGNGKLFVACHDCNFPICKTCFDSELKEGRKACLRCGNPYGENLLDDAEKASGDRSTMAAHMDKSHDAGIHARHISSVSTLDSEMTEDNGNPIWKNRVESWKEKKNKKKKTSIKVEIEAQVPAEQLMEDKPRAADAFQPLSTVIPIPKSRLAPYRTVIIMRLIILGLFFHYRVTNPVDSAFALWRT

SEQ ID NO: 17810 - protein, 706 aa, Fusarium oxysporum
MAPRGFEDEELTISLSSSHVRRPQQQQQQQSQQQQQHASSDAPTPGSRPADAPLKERIKTEQRIGAYKVLRTLGEGSFGKVKLAIHNGTGQQVALKIIARKKLISRDMAGRVEREIEYLQLLRHPHIIKLYTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPAGAANLIKKMLVVNPVHRATIEDIRADPWFTTDLPAYLQLPVEEFFNTGVDPNKAIKKNDIAPNASEKVQERLHNEVTEKISKTMGYGKSDVEEALQAAEPAAIKDAYMIVRENKMMQVNHNPEALLAEPEGSSPMLSMSSARSTTSQATTTPRPYVSKVGILPSSLPAYHKDYMEREKAGSVENSPPKVLINDEPPSNRTDAEKEETARRLRPHSRSQLRMDEANTRPQGMTPINPPKKNKPVRWQFGIRSRNSPWEALLCIHKALHKLGATYIPDEDYESRTAEERAEASGEGSFADSHDNNRGSSSSIDPKKRYNLPADPWHINVRWDTSAIKKKAASVPGTPSSPSTPEGQHHPKEPFVALHMDIQIYEMEHGVYLVDFKCSGYETAHGRLLEEKDVTSPFPFLDMAAKLIMQLAEAD

SEQ ID NO: 17811 - protein, 339 aa, Colletotrichum gloeosporioides f. sp. malvae
MVVSQPEVDFAREKDRLAEAQPQGQRAASSHDDAAPPPIGMTEPDERRGTRSRHDHSGKRDKVVRFGDYILGNTIGEGEFGKVKLGRKQDGGVQVIPVAVKLIKRDSVGNNPSRLAKIYREIAILRGISHPNIVRLHEMVETERHIGIILEYASGGELFDYILNHRYLKDNAARRLFAQLVSGVGYLHKKGIVHRDLKLENLLLDRNRNIIITDFGFANTFDGTRKGDLMQTSCGSPCYAAPELVVSDSLYTGRKVDVWSCGVILVSTAARYAMLAGYLPFDDDPANPEGDNINLLYKIVNTPLTFPEYVTPTPVTYSAASRSQSPQASGSLRGGRTAG

SEQ ID NO: 17812 - protein, 316 aa, Colletotrichum gloeosporioides f. sp. malvae
MPAPFSARPCLAPFPPKQLFGVSQVLLQIRHPGCRGPGRLWTGLIRTHRISPGPATRILMASMSSAIRIHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYIRNLPFMPKKPFPQLFAQANPDALDLLDRMLAFDPSSRFSVEQALEHPYLHIWHNASDEPDCPTTFNFDFEVVEDVGDMRKMILEEVYRFRQLVRPSRQHPTGAQAAGQAGAGQVPFLWKPRLDSSDPD

SEQ ID NO: 17813 - protein, 476 aa, Gallus gallus
MAVPFVEDWDLVQTLGEGAYGEVQLAVNRRTEEAVAVKIVDMKRAADCPENIKKEICINKMLNHENVVKFYGHRREGATQYLFLEYCSGGELFDRIEPDIGMPEPEAQRFFQQLIAGVVYLHSMGITHRDLKPENLLLDERDNLKISDFGLATVFKHNGRERLLNKMCGTLPYVAPELLRRPEFRAEPVDVWACGVVLTAMLAGELPWDQPSDSCQEYSDWKERKTYLAPWRKIDSAPLALLHKILTENPTARITIPDIKKDRWYCRPLKKGTKRGRVSSGGVTESPGALPKHIRSDTDFSPVKSALGEDKASYSTSQPEPGTGGALWDSSTGSIDRLVQGISFSQPACPEHMLLNSQLLGTPGSSQSPWQRLVRRMTRFFTKLDADGSYRSLRDVCEKMGYGWKQSCTNQVTISTTDRRNNKLIFKVNLLEMESRILVDFRLSKGDGLEFKRHFLKIKGKLSDVVSTQKVWLPPP

SEQ ID NO: 17814 - protein, 349 aa, Ustilago maydis
MSAPAADLQERIAAARREADGLKEKIRAKKDQMADTSLRAMANDIEPLPRIVMKPRRTLKGHLAKIYAMHWASDKRHLVSASQDGKLIVWDAYTTNKVHAIPLRSSWVMTCAYAPSGNSVACGGLDNICSIYSLRGRDPHNIKVGRELSAHTGYLSCCRFLNDQQILTSSGDMSCILWDIDSGTRISEFNDHTGDVMSISLSSNPNVFVSGACDAVAKVWDIRSGKAVQTFAGHESDINAVQFFPNGDAFATGSDDASCRLFDLRADRELNTYTHDNILCGITSVGFSVSGRILFAGYDDYTCNVWDTLKGERVGVLAAHENRVSCLGVSADGMALCTGSWDSRLLIWA

SEQ ID NO: 17815 - protein, 906 aa, Mastigamoeba balamuthi
MGSTLGAERLVNAGSGGSAIASPSKPTYTFEEGDGKNKKLLGGKGAGLCQMTQIGLPVPPGFTVTTEQCKLYYANGKTIKPEVLEEVRSQMAYIERKTGRKFGDPSNPLLVSVRSGAAMSMPGMMDTILNLGLNEETVKGIAAQTGNERFAWDSYRRFVSLFGKIALGVDDELYSKAMDGLKAARGVKLDTELSACDLEGLAKEFVGITEKATSNAFPRDPYVQLETALKAVFGSWMGRRAVDYRKEFKITPEMADGTAVNVVAMVYGNMGNDSATGVAFTRDPGTGENVFFGEYLTNAQGEDVVAGIRTPKAIREMESDADLPGAYKQLEDIRAKLEGYFKEVQDFEFTIEKGKLYMLQTRNGKMNAHATVRTSVEMFGQGLITKEQAILRLKPDMVDQLLHKGIDGNWKGKPLAKGLNASPGAAVGAAVFDADDAVEQSKQGKKVILVREETKPEDIHGFFVAQGILTSRGGKTSHAAVVARGMGKPCVSGAEDIRVDVHQKLAVIGDKTLHEGDIITIDGTSGMVYDGAAPLVDPGVSGDFGTLLTWADEARRLGVRANADTPEGAKKAREFGAQGIGLVRTERMFNAVDRLPIVVDMIMAATLEERKEHLNKLLVLQRQDFVDILRVMSPLPVTVRLLDPPLHEFLPSLEVVLREIYEMKLKGASEEEIAPKDKVLRKVKELMEVNPMIGHRGIRLGVTHPEIYEMQIRAIIEAGAILTKEGVEFHVEIMLPNVTELRELQFMKDKVIDPVAAQVEAESGVKVPSKYGSMIECVPAAMTAGNIATLSEFFSFGTNDLTQGTFSYSREDVEQKFIPKYIENKILDANPFEVLDREGVGRVMDIAVKEGRQTRPNLKVGICGEHGGEPSSIEWCHIIGLDYVSCSAFRIPTARLAAAHAAIRNK

SEQ ID NO: 17816 - protein, 260 aa, Rattus norvegicus
MASSGLTRQNPLANKVALVTASTDGIGLAIARRLAEDGAHVVISSRKQQNVDRAVATLQGEGLSVTGVVCHVGKAEDREKLVNMALKLHQGIDILVSNAAVNPFFGNLMDVTEEVWNKVLSINVTASAMMIKAVVPAMEKRGGGSVVIVSSVAGFVLFPSLGPYNVSKTALLGLTKNFAAELAPKNIRVNCLAPGLIKTHFSSVLWKEKAREEMIKETMQIRRLGKPEDCVGIVSFLCSEDASYINGETVVVGGGTPSRL

SEQ ID NO: 17817 - protein, 371 aa, Bifidobacterium longum NCC2705
MSDARQIEADIYERLSKVIDPELGRSVTDLGMIAAIEAAPASSDAGTYDVTVHVELTVPGCPLSETITSQINGAVSSYPGAQLLPHIEVGSMSRDKLADLVADLKAERKQNPFSKPGVKTRIFAIASGKGGVGKSSVTANLAATFAALGFDTAAIDADIYGFSLPRLFGVHTQPTNLNGMLMPVTAWGVKLISIGMFAGADRAILWRGPRLQRSLEQFLSDVWWGEPDVLLLDLAPGTGDMAISVAQALPNAELVVVTTPQPSASDIAVRSGLVALQVPMKVRGVVENMSYYEHKGEKLEIFGAGGGQRVSEQLTQALGYDVPLMAQLPLEPEVRETGEAGRPAVLDADGALRTDGIGQTFRGLAERLLAV

SEQ ID NO: 17818 - protein, 396 aa, Bifidobacterium longum NCC2705
MSIASNSTVIILGSTGSIGTQGLDVISRHPERFTVTGLAAGGAHIELLAQQAAQFHVSEVAVFDETKVPALQAALAQAGAQGVRVTGGPDSVIAMAGSGANVVLNGITGSIGLEPSIAALKAGSQLALANKESVVAGGHLLFSAQVRENQINPVDSEHSAIWQSLRSGTHAEVAKLVVTASGGPFRGWKRADMENITPEQALHHPTWNMGPVVTINSSTLMNKGLEVIEASRLFNVPPERIDVTVHPQSIVHSMVEFVDGATICQASPPDMRLPIALGLSAPDRMTNVAAACDWTQAATWTFEPLDDEAFPAVQLARHCLAASEKHTAVLNAANEQAVHAFLEHRLPYLGIVDTVKAVLDQMDAELRGNPLFTDVEEMNQLELEARRRADDLINKQ

SEQ ID NO: 17819 - protein, 289 aa, Bifidobacterium longum NCC2705
MTNGHINPANVPDIALKDGHSIPQVGLGVLRIDDEGVVPVVESALEAGYRHIDGAAGYNNEAGVGRALAASGYNKGAKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 17820 - protein, 267 aa, Bifidobacterium longum NCC2705
MTEQSDMARRPMVNLDGRTAIITGSGKGIGAAVAKCLASHGAAVVINYVHDAASAQRTVEDIHSLGGSAIAVQADVCDESQSSKLVGTAVDSFGGVDILVNNAFGRFSFDPRRRSTFAGGDWDEFSAQIEGCLHGAYLMCSHVVPLMRAQTSGRIINISSNLVDSPIVPYHSYITAKGGLVGMTRSLAQELGGFGITVNAIAAGLTAGTASSAATTEDVRERIIAMTPLGRLARPDDIAGGVALLASDMAGFITGQCLHVDGGLTMR

SEQ ID NO: 17821 - protein, 509 aa, Bifidobacterium longum NCC2705
MTEINDKAQLDIAAADDTDAVTSDTPEETVNTPEVDETFELSAAKMREHGMSETAINQFHHLYDVWRHEEASSWIREDDIEPLGHVPSFHDVYETINHDKAVDAFAKTAFLKLNGGLGTSMGLDKAKSLLPVRRHKAKQMRFIDIIIGQVLTARTRLNVELPLTFMNSFHTSADTMKVLKHHRKFSQHDVPMEIIQHQEPKLVAATGEPVSYPANPELEWCPPGHGDLFSTIWESGLLDVLEERGFKYLFISNSDNLGARPSRTLAQHFENTGAPFMAEVAIRTKADRKGGHIVRDKATGRLILREMSQVHPDDKEAAQDITKHPYFNTNSIWVRIDALKDKLAECDGVLPLPVIRNKKTVNPTDPDSEQVIQLETAMGAAIGLFNGSICVQVDRMRFLPVKTTNDLFIMRSDRFHLTDTYEMEDGNYIFPNVELDPRYYKNIHDFDERFPYAVPSLAAANSVSIQGDWTFGRDVMMFADAKLEDKGEPSYVPNGEYVGPQGIEPDDWV

SEQ ID NO: 17822 - protein, 416 aa, Bifidobacterium longum NCC2705
MKVDILTREYPPHVYGGAGVHAEELSKVLAERIDVTVRAFDGKRTEADIPAIPNAADAKGSLKVVGYDTPSELADANPALKTFGVDLQIANDVDADIIHAHTWYACLAGYMAKMLHGTPLVITAHSLEPFRPWKREQLGGGYNLSSWAEKDAYEHADRVIAVSGGMRKDILTAYPNLDPDKVVVVYNGITMADFATPAPDDPGWKVFDRYNIDRSKPTLLFVGRITRQKGLPYLLKALHLISKDIQVVLCAGAPDTPEIAEEVKTAFAKLDEERGNIVWIEEMLPKPELNALEHGCDAFICPSIYEPLGIVNLEAMACGLPVVASATGGIPEVVVDGETGYLVPIDQLHDGTGTPTDPDKFVHDMAAAIDKIMADPELAKKMGQAGYERARDVFSWETIADKTVEVYQSVLDEQKK

SEQ ID NO: 17823 - protein, 215 aa, Bifidobacterium longum NCC2705
MTKAAIFDLDGTLLDSMGVWDQVDIDFLNKRGIEVPPDYMTKVSAMQFRQIAEYTIARFGLTDTPEELMQEWDDMASVAYSTTVEAKPGALDYLRDLKASGVKLGVATSLPPHLREPALRHVGMFELFNDIVSVDDANDVGKDQPDVYLLAAKRLGAAPVDCTVFEDLLVGMKSAKSVGMKVWAMHDDSSASDWPEICHLADGVLFDFHDAPRVL

SEQ ID NO: 17824 - protein, 500 aa, Bifidobacterium longum NCC2705
MRTMGNMKKSITADSDFAAWAAARSQKTNRSLAGARLAIPEPQKHAEIKSQAQQWGMTVEDATMTDEHNEEFLCDGTQSIDSITDMRKASGLEAMEYAEQHMPVLRDTMDSLTTRVDFSGIRIAVCLILEPKTAILLRKLKAAGAIVGVYCGPDSTDPRVAEQLRREGITVESSRDWTAEQAHEAALHLLDEIQPDIIIDDGASFARLASLERPELTANLIGVAEETTSGVRAFQQMQEAGALTYPVVAVNDSVLKTGFDNAHGTGETCVTTMQRILGEHAFDGKNVTVIGYGPVGQGFARRIRALGAEVTICDIDPVASLKAVFDGFAAQDIDEALPCADMVVSATGVRHTVTLEHMRAMHEGAALAVIGGIANEIALDEVSDFTPQVNRDTVQLNVPDGPTLTLIADGDGVNYTVGGGNPIEIMDLSFAVQASAVAYLLEHRGTLDHTLIRLDAATDQRIAASALKARGYRASHAVEDNGYNWRLTRFAENDRENADR

SEQ ID NO: 17825 - protein, 774 aa, Bifidobacterium longum NCC2705
MSHIAQRTNHPFTEMLGALLRHVDLGQCRALAFNFGKTSEGRFEGMRSASGNGFDSSDSFAVSGAAEGTARLHDIPPSITPSHGDDSHLLSRIASPADVKALAPNELAELCREIRATLLAYGHQHGGHIGSNLGMVEATVALHRVFDSPRDRIVFDVSHQSYVHKMLTGRAAAYLDPDRFSEVTGFTNPGESKHDQFVLGHTGTSISLACGLAKTRDMEGPNNSIGNVIAVIGDGSLSSGVAFEGLNNAAEQGGNLIIVFNDNEMSIAGDFGGMYGPLARLRASGGTAQPNLFNAFGLDYRYVEAGNDVSALVAAFEEVRDIDHPVVVHIHTLKGAGYDGEETHADRQTASASPVSFDSPTGVHPTDNVNHSEPWHSDHCNLSDHEPHEGQCEASHWQNPDAAIGKPDDPRKHYGKMAMAALEPRFAAEPGLVVISPATPGSNGITHEFRERAGAHYVDTGITESHAVAYAAGIARAGGTPVVATTASFFQRAYDQFFQEMSLNRSRVTVLDFLGGLSGSDNTHSGAYDVTMFSNIPGVTMLVPTSARDYLADLAWATAPAGSADAPAGPAVIRVPGEAILAAERDATLLPVTGGQIADRPQSASLPASASSASGGISAATVHGTVSVTAQHAGARHMLDWRVNQTGSQVAIIGLGNAYPLAEQTAAALSDDYGITATVIDPRQCTSLDSDVLESLRDGHQQVITLEDGQLEGGWGEKVTAYYANHHVSDGSRNPRVLNFGAAKEFTDRVSLGELNERYGLTVEQVTEAITRCF

SEQ ID NO: 17826 - protein, 275 aa, Bifidobacterium longum NCC2705
MAIQSTIMLNNGTVIPQVGLGVFQTPDGDTTVNAVQTALENGYRHIDTAMIYHNEASVGEGIRRAGVPRSDFFLTTKLWNDDIRARRGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 17827 - protein, 338 aa, Bifidobacterium longum NCC2705
MLSLLLTALIWGFAFVAQVQGMDSMSPMFFNAARFTLGALSLVPILLWMRGRGSADKGDTAGADVVGTEASVAVSTDAASNGASDVVTITGAKLNANKPDSAVARLLANPVVISVICGIVLFTASTLQQYGILYGKSAGRAGFLTAMYIVMVPLLAFVFLRRRIGMLVFVAVALSIAGFYLLCITDGFGSIGLADILLVFTAVLFAVHILVIDTLGGTVDAIKLSFGQFCTTAVLSWAGSLIEGSVDWAGAAHSWIPILYAGIGSVGIAYTLQVVGQQWVPPTRASLLMSLESFFSAVGGALLLGEVMTPRGYLGCALIFLGTLLAQAPARLPKWPQR

SEQ ID NO: 17828 - protein, 474 aa, Bifidobacterium longum NCC2705
MATKETTATKQTAESSEETETKKKASSTTTARKTSAKKSKSAEPSKKTTRKSAAKKTAKKAKDDELVKDEDTQVDDELDDDAEVNDDDLDVDDLDEDLDDVDEDDADDEDLDEDDADDDDVEDDEDEEEAKSKAPEQPKEKGAYVVSDTDDEEENIIPSGNPKRRVIAAGATADPVKDYLKQIGRVSLLNAEQEVDLSERIEAGLYAQHLLDTESEGMEFKRKRELKWAAADGKKAKDHLLEANLRLVVSLAKRYTGRGMLFLDLIQEGNLGLIRAVEKFDWKKGFKFSTYATWWIRQAITRAMADQARTIRVPVHMVEVINKLSRVQRQMLQDLGREPTPDELARELDMPVEKVQEVQKYGREPISLHTPLGEDGDSEFGDLIEDTDAIAPSDAVAFSLLQEQFKQVLETLSPREAGVIKMRYGLEDGQPKTLDDIGRVYGVTRERIRQIESKTMSKLRHPSRSQTLRDFLDQ

SEQ ID NO: 17829 - protein, 320 aa, Bifidobacterium longum NCC2705
MPEPVRERLRALKDAPGSVIVVGSMNADYTVTTKRLPKPGETVNGGAMKVLPGGKGANQASAAARLGVNVQLLGAVGEDSNADFLLSKLDEAGVDTADILHVEGPSGTTVITVSAEGENTIVYSPGSNAKASAGYVQSHRTTIAECAVLGLCLESPIATVIAAAQTAHDAGVTVLLNDSPFMDELPHELVEATDILLVNQHEVAQLLGLPDDDVESLDWYEVAERFTDYGFDRAIVTLGASGSVVIENGRWHRVSAAQVNAVDTTGCGDSFMGTVLAGLAAGHTLLQSAQIGSYVSAYAATKLGAQSAYGTAEEVIAYFS

SEQ ID NO: 17830 - protein, 374 aa, Bifidobacterium longum NCC2705
MSQEIEIGLGKKGRLGYALDDVAIVPSRRTRDPEDVSTSWQIDAYEFDVPVIGAPMDSVTSPATAIAMGKMGALGVLDLEGLWTRYEDPTPLLDEIAGLPADQATERIQQIYAEPVKPELITQRLHEIRAAGVTVAGALSPQRTQQFYSTVVDAGVDLFVIRGTVVSAEHVSSGQEPLNLKKFIYDLDVPVIVGGASNYTAALHLMRTGAAGVLVGFGGGAVSATRQTIGVQAPMATAIADVAEARRDYMDESGGRYVQVIADGGMGDSGSFVKALALGADAVMLGAPLARATEAPGKGTHWGSEARHQTLPRGYRTTVGTVGPLEQVLFGPSHQADGKTNFIGALKRAMASTGYVDVKNFQRCGMVVNPYSAR

SEQ ID NO: 17831 - protein, 690 aa, Bifidobacterium longum NCC2705
MAVFELILCIIAAVVVSSFVSRFVPKVSTPLVQIVLGVLVTYLPFFPDATLDPELFMVLFIAPLLYLEAHEIDKSALLKTLDLSLSLAIGLAIVTMAAVGFTLHAVWPSITLASALALGAALGPTDAVAVSSLGKEASLTQRQRSVLKGESLFNDASGIVGFQFALAAAFTGEFAVGQAAGEFVISFFGGTLFGLVIAAAANWLFETVRSLGWETTTTRILMELFLPFLLYLGAEEFNVSGILSVVAAGLFIRFDRTGVGPNVARTNIVSTSVWGVLSFSLNGAVFILLGMQLPRAMMASWSDPYISNIALIGIILLVTLVVIALRFFWIAAMLRVARDTISGQRRKMTPERWRSAAVMTFGGPKGTITLSLMFTIPYYIAGGAPFPMRDELIFIASGVIIVTLLLANFLLPLLAPNRGKDPSAEMIPVTIDVLRATVEELTGRITPENRRAILMVIDQYTKRIGRLQQRIGDTDPQGFEQLQIEALHWEKEFVRDRLADTKAHPAADTATQELNVEACERMLDQIMNTLRHTSTDPTSGHAVSQIRGRLRMFQRQMSNYAKRTVSKIRHTTPLVSEDQIFARTRELQVEAIHHVIGRLIDEMGQDTYNTEHCSALLLDYRRAEASLQARPTMSGTTETITQVEDVKRESYGIELGMIQDMYEAGDINRAQARSLRRNIYVMQVDADSGI

SEQ ID NO: 17832 - protein, 158 aa, Bifidobacterium longum NCC2705
MRKRHTLVGMEYDEAMRRALELAGQAAAAGDVPVGAVVLDAAGQIVGRGYNTREADGDPLAHAEIIAMRQAAQALGAWNLADCTLAVTLEPCPMCAGACIQTHIGTIAFGAWDPKLGACGSIWDIPRDPHIGHSPEVHGGVLEGECQSILTDFFAQRR

SEQ ID NO: 17833 - protein, 517 aa, Bifidobacterium longum NCC2705
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 17834 - protein, 545 aa, Bifidobacterium longum NCC2705
MRCRTRQRISERSQACVVKVSACSYSVCMATNLDELNAQSAYAPLPPIFAKLGLAYDDVLLLPNETDVIPSEVDTSTHLTRKIVMKAPVLSAAMDTVTESEMAIAMARNGGIGVLHRNLSIDDQAAQVDVVKRSESGMITDPLTVNPEVTLADLDKLCGKFHISGLPVVDKENKLVGIITNRDMRFIASEDYDTLKVKDVMTKENLVTGPSNISKDDAHRLLAQHKVEKLPLVDEEGHLTGLITVKDFVKTEQYPDATKDEQGRLRVAAGVGFLGDAWQRASALMEAGVDVLVVDTANGEARLALDMISRLKHDSAFDGVQIIGGNVGTRSGAQAMIEAGADAVKVGIGPGSICTTRIVAGVGVPQLTAVYEAAQACRAAGVPCIADGGIHYSGDIAKALVAGASSVMLGGTLAGCEEAPGEKVLLHGKQYKLYRGMGSLGAMAPRGKKSYSKDRYFQADVTSSDKVVPEGVEGEVPYRGPLNAVLYQMLGGLHQSMFYIGAHNIAEMPERGKFIRITDAGLRESHPHDIVMTTEAPNYSGFHNN

SEQ ID NO: 17835 - protein, 322 aa, Bifidobacterium longum NCC2705
MSASCLDLLDHLHGSVSVVGSMNVDYTVVTERLPKPGETVNGGPLTLLPGGKSANQASAAARIGAQVRMFGAVGEDTNADFLLEHLRDAGVDTSHIAAVAGPSGTTVITVDANGENTIVYSAGSNGEVSVDYVQQSSDALVAADVLGLCLESPMETVTACARLCHDAGLKVLLNDSPFVAELPAELIEASDILLVNEHEMAQLLDIAEPDDDDWDGLDWSDVARQMHDFGFNQAIITLGGDGSVVIDGDDIYRIAPVAVEAIDTTGCGDAFMGTVLAGLASGHALADSAQLASYVSAYAATGFGAQASYGTAAQIRERFGAK

SEQ ID NO: 17836 - protein, 76 aa, Mesembryanthemum crystallinum
MSKLTTLLVIALLVCSITLINAGRPNPTSLINEGKETEHAEMDENESCQGLNDEECLMRRTLVAHTDYIYTQHHNP

SEQ ID NO: 17837 - protein, 96 aa, Sorghum bicolor
AHHEDGAKAAATATAAASSASDGLVLDESAAVVSGDDELSLSVSSEVMGADQSELEEEEGGVACEEAGNDDEYCMQRRLLHDAHLDYIYTQHKGKP

SEQ ID NO: 17838 - protein, 123 aa, Sorghum propinquum
MGRGRSSSWPPAAPALLLLLVVCFSHGVAAARLLPPLQPATAVPPQVLHQAENVVMAAAADGLVLQEGEAVGNGDELSISEMMGAEEEGAAAVCEGENDECLERRLLGDAHLDYIYTQHKGKP

SEQ ID NO: 17839 - protein, 59 aa, Triticum aestivum
SGKAGNGGEAVSPSEATVDDATAEEEACEEGKEGEECMQRRLLHDAHLDYIYTQHKGRP

SEQ ID NO: 17840 - protein, 87 aa, Triticum aestivum; identical to SEQ ID NO: 4188

SEQ ID NO: 17841 - protein, 98 aa, Zea mays
MARRATVMVLAAALAVLLLASSSSKTAPVASAARDDPSAAAAAAVTSSRDLQNDGSAAAAEGKGKEKECEGANDEDECMMRRTLAAHTDYIYTQQHHG

SEQ ID NO: 17842 - protein, 118 aa, Zea mays
MRRRSGSMPLPLAAAALLLLLVCFFHCSAAARLLPPSPVPAQLVHRENGVGGLALQEGGGVGNGDELSISGDEMMAAEVEEGAVACEADDDEDDGCMQRRLLQNAHLDYIYTQHKGKP

SEQ ID NO: 17843 - protein, 108 aa, Zea mays
MMIRRGSSNISSPLALLCLLLLLLLVCSSSNCAAAARLLPAGPLPPLRAAAPSGGDEHSAASEVTTQDTTKGAEACEEGNDDKDECVQRRLLLDAHLDYIYTQHKGKP

SEQ ID NO: 17844 - protein, 487 aa, Haemophilus somnus 129PT
MLRIKQEALTFDDVLLVPAHSTVLPNTANLSTNLTKEIRLNIPMLSAAMDTVTEAKLAISLAQEGGIGFIHKNMTIERQADRVRKVKKFESGIVSEPVTVSPTMTLTELAELAKKNGFAGYPVVDEQKGLVGIITGRDTRFVSDLNKTVADFMTPKDRLVTVKEGATREEIFHLMHEHRVEKVLVVDDSFKLKGMITLKDYQKAESKPNACKDEFGRLRVGAAVGAGPGNEERIEALVNAGVDILLIDSSHGHSEGVLQRVRETRAKYPNLPIIAGNIATAEGAIALADAGASAVKVGIGPGSICTTRIVTGVGVPQITAIADAAEALRERGIPVIADGGIRYSGDIAKAIAAGASCVMVGSMFAGTEEAPGEIELYQGRAFKSYRGMGSLGAMSKGSSDRYFQSDNAADKLVPEGIEGRIPYKGLLKEIIHQQMGGLRSCMGLTGCATIEELRTKAQFVRISGAGIKESHVHDVTITKEAPNYRMG

SEQ ID NO: 17845 - protein, 481 aa, Haemophilus somnus 129PT
MNIQHLLKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 17846 - protein, 618 aa, Haemophilus somnus 129PT
MKNLKYFAQKYVDWVIRLGRIRFSLLGVCILAVVALLTQIVVSLIFIGTIYWQDVARSIIFGLFSAPFVLYFFTLLVEKLEKSRLDLAKLVDNLRNEVSERILAERKLSVALSEIEKTSQDKTALMTTISHELRTPLNGIIGLSQILLDDKLTEQQRNYLKTINVSAISLTHIFSDIIDLEKIDANRIELHYQPTNLCSFLNDITNFATLMAAQRKLKFELVCDKDLPDWLMLDSARLSQILWNLINNAVKFTPAGKIKLKVSRLTDDTFSFALSDTGVGIAKGELDKIFTMYYQVQETDHKPIGSGIGLAVSKAIAGLMGGDLTVESQLHQGATFTLTLQAKAVEKPAESESNVPNTLTILLVEDIEVNIIVAKSVLEKLGYCVDVAMTGKEAIQKFEQNYYDLVLLDIQLPDMSGFTIAQYLREKYEQGVYDFLPPLIALTANIMQSKTEYQKQGMDDVLRKPLSLEALVNCLSDYFGDELNTKIIKKSSFVEFSALSDVLNMELLVELNDILGKEFIGKNLLLFKQTMPSYVNELLDSYEQYKQDSAVKKDLLSNVHKIKGAAASVGLLRLQQVASLAQDANHENWETHIDEWINTLANDWLVDTATLEDWLNDL

SEQ ID NO: 17847 - protein, 464 aa, Haemophilus somnus 129PT
MKLTRFQQYHTEAKKLIAIATPILLAQVAQNSMGLVDTIMAGRVSAADMAAVAVGASIWLPLVLFGHGLLLALPPTISYLNGSGQRDHIAHQIRQGLWIVFISCIPLGLLIYNSDFVIQYMKMEEKLANITIGYLRAMLWGLPGYLLLINFRCLNDGIAKTKPAMVITFFGLLCNIPLNYIFIYGKLGIPAFGAVGCGIATAIVNWIMCLMMIVYSKHARNQRDLKVFEHLFEKPDTKTLAKLFRLGLPIAVSLCCEVALFALTSLLLSPLGTQVVASHQIALNTSSFAFMLPMSLGMATTILVGQRLGEGKIDNAKQISFSALTVGLSIAFLTASIIFFFRYEIAAIFVNDKEVIAISSSLLMIVALYQFSDTAQVVSSGALRGYKDTQAILYITLFCYWGIGMPLGFSLSRTDWIIPSIGAAGFWVSFVVSLTIAAILLLWRMYKIQQQPAPILLAKLDKLK

SEQ ID NO: 17848 - protein, 373 aa, Haemophilus somnus 129PT
MTIHFSHNLSESQKQQLQECFRQFSHTTLQKDLISLGAVKKIELGGNMLRIELVMPFAWNTGFAQLKTALSDKLEAITRVTEIKWLLSYQIATLKRANNLPAVKGIKNIIAVSSGKGGVGKSTISVNLALALQTQGAKVGILDADIYGPSIPHMLGVSQNRPTSPDNQHIDPIQAHGLAASSIGFLMEPDSATIWRGPMASSALSQLLQETLWANHGELDYLVIDMPPGTGDIQLTLSQKIPVTGAIVVTTPQDIALLDAIKGISMFQSVQVPVLGIVENMSVHICSQCGHHETIFGTGGAKKMAQKYQIKLLAQLPLHIQLREDMDNGIPTVISAPESEISQSFLQLAEKVATELYWQGEIIPGEILFKEVN

SEQ ID NO: 17849 - protein, 575 aa, Haemophilus somnus 129PT
MISGITASPGIVFGKALVLKEEKIVLDTQKIKDEQIDIEVARFYSGRAAAIEQLIAIKDRALVSLGEEKAAIFEGHLMILEDEELEEEILDYLRSNKVNAGVAASKIIDQQVAMLSEIDDEYLQERAGDIRDIGNRLIKNILGMKIVDLGDINEEAILVAYDLTPSETAQLNLDKVLGFITDIGGRTSHTSIMARSLELPAIVGTNDITSKVNTGDYLVLDAVNNAIYVNPTQEEIERLKALERQLAEEKAELAKLKDLPALTLDGHQVDVVANIGTIRDCEGADRNGAEGVGLYRTEFLFMDRDQLPTEEEQFIAYKEVVEAMNGRLVVLRTMDIGGDKDLPYLNLPKEMNPFLGWRAIRIGMDRREILHAQLRAVLRASAFGKLAVMFPMIISVEEIRELKSVIESLKQELRDEGKAFDENLQVGVMVETPAAAINAKFLAKEVDFFSIGTNDLTQYTLAVDRGNELISHLYNPMTPAVLSLIKHVIDASHEEGKWTGMCGELAGDENATLLLLGMGLDEFSMSAISIPRIKKLIRNVNYQDAKLLAEQALQQPTAAGILSLVNDFLVEKALN

SEQ ID NO: 17850 - protein, 1639 aa, Haemophilus somnus 129PT
MNKIFKTKYDVTTGQTKVVSELANNRQVASRVEGAESQPKCGVFFGGMLGAFKVLPLALVMAGILGVNNVAYGDYKEIKIDEDSGQVGTEDLEKDENVVLAKKSSLETNNGRQTKKTVVIGAGDVQAKYTNQFNWTFGVEKGVVIGYAAKARANESIAIGAEAVAGDNENAKGSTAVGYLAKAKGSDSVAVGKNAESVSKGTSIGASSKVIGEQGTALGNNVYAAGQGTALGSDVMAAGYGSIAIGNDDIVKNGYTDKLPEDTIFLIYGYKDNHNYGDDNKTYKDILTKEAFQRKYVKDGNKDNRIYSPTYAAGLGSIALGSRTVAFGQTSLAVGALSFALADDSTALGVRAFVDTKAKGGVAIGDESRVFAENSFAIGNRAESTSQGSLSFGSNAKAVGVGSIAIGPSVASNAKLAGTGDEDFARYIMEKTKTASPTVTISGATANIEYSSETDKKLKFGNHSHLVSKGFGSQNFKNGQKKGNPVTDIINEVIKLKEDKNNPIKYSYDTNNEKLETTEKIYTTEKEGEHAISLGYHLSNNGDNTITIGSASVVRGANSVVLGALNNIGKYATNTIALGIGTNVFKENSVAIGTGVNVAGAGVVAIGSGVGVTQDNTIAVGYGAYGLSAESIVLGNAAGLEENAKKSIVIGNKAKVINKKAEEAIAAAAAGQPTTRTTSTKINQDMSAISIGTGSYVYSEKGMAFGDAAKVENNAENAIAFGTSSKATKVSSIALGNEAHSTMLNSVALGYKSRTDYAHLDTAPYSPKGALTIPTSSNVGLISVGAQNYTRRIINVAAGSQDTDAVNVSQLKGLEEKVELLSGSIGDNSTPYFGVEQTNNSSEAKTISDGINKQKNYDRYVYLAGEYASLLNRQKNGGEVFNEKSLQEIQEEIDKIGTPEIKRKANQITRVLNELKSAPQNKNSMQLTQKSNQIERAITTDKVKKVNAISEDVVKKSNYKGNYAEGVDSIAIGYGAHTTSTANHAVALGYKAEAQKADSIALGSNSVADTAGDITGFDTVTGEVKKTADYGAWKSKYAALSIGKVSGNDKITRQITGVAAGSEDTDAVNLAQLKEATLHFVSVNGGSNTDKNYANNGAIGKNSIAIGVGVQSKSENSIVMGNNSTIETDISKSISIGVNNHIRAKKGNAREDLTNTVALGSDNIITGRKVVNLGSGNKIGNTGNDYQTDKHAGAVSIRLIGDDNIAHGVWNTVIGEGNKLESSSWAQVMGDYNAVTKSDYAIVISSNKANKKEPITTDTVTDSKYAIVIGNNAKATSAEKGVVIGQGASVTVANSVAIGSGSKTSGDITTMGYDPSTNTTYSSTNTDDDYKWKPTAGEFAVGDTTYTVEQGKGKNKQTVKKPQTRRITGVAAGIEDTDVVNVAQLKKILSDALAAKPNNNAGANPQTQAEVEAAKQGAVDAKNEAVTAKDEAEAAKQGAETAKNQAESFATQADTAKQGAETAKNQAESFATQADTAKQGAETAKNQAEDAKTAALDAKQGAENAKNQAETFATQANTAKQGALEAKDKAEQAKADAVAAKLGADAAQTLAVNAKNKALEAQGKAEAAQAAAQNSASQAQTAQNKAEAAKLGAEQAKAQADAAKNQAVLAQAGAEQAKQDALDAQEKQSMQNGCRCCER

SEQ ID NO: 17851 - protein, 113 aa, Haemophilus somnus 129PT
MMKKIEAIIKPFKLDDVRESLADIGITGMTVTEVRGFGRQKGHTELYRGAEYMVDFLPKVKMEIIVPDEIVEQCIEAIIETAQTGKIGDGKIFVYDVNRVIRIRTREENEEAL

SEQ ID NO: 17852 - protein, 617 aa, Haemophilus somnus 129PT
MNKYPLLSLINSPDDLRLLSKDKLPQLCQELRSYLLESVSQSSGHLASGLGTVELTVALHYVFKTPFDQLLWDVGHQAYPHKILTGRRDKMSTIRQKGGLHPFPWREESEFDVLSVGHSSTSISAGLGIAIAAQKENLGRKTICVIGDGAITAGMAFEALNHAGSVHTDMLVILNDNEMSISENVGALNNHLARLLSGSIYSTLRESGKKILSGLPPIKEFVKKTEEHVKGFVSPVGTLFEQLGFNYIGPIDGHNIHELISTLKNMQSLSGPQFLHIKTKKGKGYAPAEKDPIGFHGVPKFDHKLGELPKSSTTPTYSQIFGSWLCEIAVQDEKLIGITPAMREGSGMVEFSQQFPQQYFDVAIAEQHAVTFAAGLAIAGYKPVVAIYSTFLQRAYDQLIHDVAIQNLPVLFAIDRAGIVGADGQTHQGAFDLSFMRCIPNLVIMTPSNENECRQMLYTGYKCGKPAAVRYPRGNAIGVKLEPLAELPLGKSKLIRQGKNIAILNFGTLLSEATKVAEDLDATVVDMRFVKPLDTQRIQEIAQTHSLIVTLEENAIQGGAGSAVAETLYQQQQKVSLLQLGLPDNFIPQGTQKEMLAELKLNAEGIFEQIKQFLQKI

SEQ ID NO: 17853 - protein, 436 aa, Haemophilus somnus 129PT
MSIYTYICFLSTISILIGFVTQKISDRIQYTIAITATATVGSLILLIAGSTNLFHLDDIAQNVMQRIDFKDFLLNGILGFLLFAGALGIKLPVLKSQKLEITILALFSTIASTLFIGVLFYGISALLRLHIDFIYCILFGALISPTDPIAVLAIIKNLKAPKKLSMKVEGESLFNDGVGLVIFTTIFTVAFGGHEPTAMEITKLFLAEAVGGIFFGLILGVIAHFLISATDDGSLEILLTLTIPTAGFMLANLLHVSGALAMVVAGIMISNWTRHSGFSEQSQHYLDHFWEMIDHFLNSLLFLLIGSAMLLVNFTSQAIILSLIAIPVCLFCRYASVWIPFKFLSMKTVYNPYTLRILTWGGLRGGLSLAMALSIPATSAFLENIGMNVRDLFIIITYSVVLFSILIQGTTIETMIRKSKEATLQKRGYIGLKNQT

SEQ ID NO: 17854 - protein, 433 aa, Haemophilus somnus 129PT
MAKIVKVIGREIIDSRGNPTVEAEVHLEGGFVGLAAAPSGASTGSREALELRDGDKARFLGKGVLKAVSAVNNEIATALVGKEASNQAEIDQIMIELDGTENKSKFGANAILAVSLANAKAAAASKGMPLYAWIAELNGTPGVYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEGLCKEYPIVSIEDGQDESDWDGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEKAPFLGLKAVKGQA

SEQ ID NO: 17855 - protein, 206 aa, Haemophilus somnus 129PT
MKHLIIFTHPNNQTSFNQAILEQTVKTGQKLGVETRVRDLYALDFNPILSWEELQAAQQKITPAEIRYEQELIDQSDLITLIYPLWWMGFPAILKGYLDRILSHGVAYKTENGVSEGLLHGKKIQQFITMGNNLQKYQERGFAQSLQNCLVDGLFNYCGVTDIDHSFFGDIHILDEQAKQHILQEVREKTVKNLTALLALQKEGIA

SEQ ID NO: 17856 - protein, 242 aa, Haemophilus somnus 129PT
MAKTVLITGSSRGIGKAIALNLAAQGYDIVVHCRSRIAEAENVAQEVRALGQNARVLQFDVADREKVRSILEADVEENGAYYGIVLNAGLTRDNAFPALTDDDWDSVLRTNLDGFYNVLHPIMMPMIRRRQAGRIVCITSVSGLIGNRGQVNYSASKAGLIGAVKALAIELAKRKITVNCVAPGLIDTDILDENVPIDEILKMIPAGRMGDPEEVAHAVQFLMDEKAAYITRQVIAVNGGLC

SEQ ID NO: 17857 - protein, 408 aa, Haemophilus somnus 129PT
MQNLIRGKRIVIGITGGIAAYKTIELIRLLRKAQAEVRVVLTNAATEFVTPLTLQAISGNAVSQSLLDHEAELAMGHIELAKWADLIVIAPASADFIARMAVGMANDLLSTICLATNSPIFLAPAMNQQMYAQTVTQQNLAQLMTRGVQFIGPNSGEQACGDVGIGRMSEPFEIFTALCQSFLHTQDLLDVSVVITAGPTREAIDPVRYISNHSSGKMGFAIAEAFAQRGAKVTLISGPVNLATPHNVQRINVVSAQEMYQHAIQSAEQNQIFIGCAAVADYRVEQIAEQKIKKIPGNDEMVLKLVKNPDILATVANLMENRPFVVGFAAETQNVEQYAKDKLQRKNLDMICANDVSGGQVFNSEQNALQLFWQNGQEGLALKHKSDLAKQLVDKIIVRYKWKLEESK

SEQ ID NO: 17858 - protein, 286 aa, Haemophilus somnus 129PT
MVKNLKMQLLLYWEENAKGSNMSIEVWSLIRAEAAKLAENEPMLASFFHATILKHNNLGSALSYILANKLANPIMPAIALREIIEEAHQNQPQIIESAACDIRAVRQRDPAVEQYSTPLLYLKGFHALQSYRITHYLWQQGRKALAIYLQNQISVAFDVDIHPAARIGCGIMFDHATGIVIGETSVIENDVSILQGVTLGGTGKESGDRHPKIREGVMIGSGAKVLGNIEIGRYAKIGANSVVLQSVSEYTTVAGVPSQIVGKNKGAKPAFDMDQYFIDDAINLNI

SEQ ID NO: 17859 - protein, 241 aa, Haemophilus somnus 129PT
MQGKIALVTGATRGIGRAIAEELASKGAFVIGTATSEKGAESISAYLGKQGKGLVLNVADQDSIDAVLSAIKAEVGDVEILVNNAGITRDGLLMRMKDDDWFDIMQTNLTSIYRLSKAVLRPMMKKGGRIINIGSVVGSMGNPGQTNYCAAKAGVIGFTKSLAKEVAARGVTVNVVAPGFIATDMTDVLTDEQKANILTNVPAGRLGQPKDIAKAVAFLASEDASYITGTTLHVNGGMYLP

SEQ ID NO: 17860 - protein, 417 aa, Haemophilus somnus 129PT
MDFFLYKDGHLMAENVSVKKIAEQFGTPAYIYSRATLERHWYAFDNALGDHPHLICFAVKSNPNIAILNIMAKLGSGFDIVSQGELERVLFAGGDPKKVVFSGVAKSEQEIARALEVGIRCFNVESAAELIRINQVARKMGKIASISLRVNPDVDAHTHPYISTGLKENKFGVSVEQAREVYRQASQLENIKIVGIDCHIGSQLTELQPFLDATDRLIVLMEQLKKDGITLEHVDLGGGLGVTYSDEKAPHPSEYATALLEKLKNYQNLEIILEPGRAITANAGILLTRVEYIKSNESRHFAIVDTGMNDMIRPALYQAYMNIIEVDRTLSRETKVYDVVGPICETSDFLGKQRSLAIAQGDFIVQRSAGAYGASMASTYNSRPRAIEIMVDGEQVHLIKRREEFAELWHLEKLLEM

SEQ ID NO: 17861 - protein, 402 aa, Haemophilus somnus 129PT
MNNKQKLVILGSTGSIGTSTLSVIAKNPEQYQALALVGGKNVELMLQQIIKFQPHFVAMNDESAAKKLREKLAFLESKTEVLSGQKAICELAAHPEADQVMAAIVGAAGLLPTLSAVQAGKRILLANKETLVTCGKIFIDEVRKNKAQLLPVDSEHNAIFQSLPPQAQQQIGFCPLTQLGISKIVLTGSGGPFRYTDLKAFEHITPEQAVAHPNWSMGKKISVDSATMMNKGLEYIEARWLFNASADEMEVIIHPQSIIHSMVRYIDGSVIAQMGNPDMRTPIAETMAYPHRTFAGVEPLDFYQLSGLTFLKPDYQRYPCLKLAIEAFSAGQYATTALNAANEMAVEAFLNKRIKFTDIAKINTAVLEKIESQVITSIEDVLLVDKQARELANSFVLRTSGT

SEQ ID NO: 17862 - protein, 336 aa, Pseudomonas syringae pv. syringae B728a
MPTPMRCTSRSAAASNRSEIPASARRAWERTGRRFACSRRQYFKRRIFGGHTGLFANKFAPTAFGQNQKLTCLNLQKNSATGVIFMSEFWNKAFDLNGRCAVITGGAAGIGLACASLLVARGARVALLDRDPAVAEVAAGLGSGHLGIAVDLRRVDQVNSTIDSVFEHFQRIDYLVNSAGVAMLDKAVDVSEEAWDTTLDINLKASFFVAQACARHMLGQGSGRIVNLASQAAVIGLDRHVAYCASKAAVVGMTKVLAMEWAPHINVNAISPTIVETALGKKAWAGEVGERAKTQIPAGRFAQPEEIAGLALYLLSDAASMITGENVVIDGGYSIQ

SEQ ID NO: 17863 - protein, 255 aa, Pseudomonas syringae pv. syringae B728a
MSRTQLFDLDGKVAFVSGASRGIGEAIARLLAQQGAHVIVSSRRLEGCQAVADAIVSEGGKATAIACHIGELEQINSAFAQIRQQFGRLDVLVNNAATNPQFCNVLDTDPGAFQKTVDVNIRGYFFMSVEAGKLMRENGGGSIINVASINAVSPGAYQGVYSMTKAAVVNMTKVFAKECAEFGIRCNALLPGLTDTRFASALVKNDAILNVALSQIPLKRVAAPSEMAGAVLYLASEASSYTTGVALNVDGGFLS

SEQ ID NO: 17864 - protein, 1172 aa, Pseudomonas syringae pv. syringae B728a
MNRTSVVDEQRFRKLLGRNVGLPLGVGVLSAVFFILLISYLLTAIQWVEHTDRVINNTNRSMKLSIDMETGMRGFLLTGDQHFLDPYEVAKPLLLAELQGLEKLVDDNPTQLDRFRRLSTLQQEWNAFAQEMITLRRTNGDYQTPVLAGRGKRITDQIRTEYDQAVEMEQQLRLTRNAEVTRSTILSVTLYLIFVVVVSAILAYIGRRDLLSLSNTYSENLRLQEVNTERLQKVAWLRNGQSELAEQVLGQLTLNMLGRNILQFLTQYLGASVAAVYIRQDHGGLTRAASYGFSREQEQQDQTIHSDEGIVGQAAQQDRIITLDELPDNYFKVASGLGEGSPRSVVVVPTSNDDQVNGVIELGFLRALTERDIEFLELVADNVGTSIEAARYRQRLQEVLAETQQLNEELQVQQEELRTANEELEEQSRILKESQAHLETQQAELEQTNEQLADQSQALAEQRDALDRNNEELNIAQAELQARADELQRASKYKSEFLANMSHELRTPLNSSLILAKLLAENPGENLTAEQVKFAESIYSAGNDLLNLINDILDISKVEAGKLEMRPENSSVSRLVEGLRTLFQPLAAEKKLAFTVDIQAGAPTMLFTDRQRLEQILKNLLSNAIKFTEAGSVSMVVSRQPGAGIAFIVRDSGIGIAEEHQQGIFEAFRQADGTTNRRYGGTGLGLSISRDLAALLGGSISVTSAPGQGSIFSLVLPEHYVEQDDREPGSDLPIVSAPAALQPYAPVLPVIAQPVPAPVPMDTPVPVFDDDRDKAPFQRRCILVIEDEVRFAQILYDLAHELGYDCLVAHAADDGFNLASRYTPDAILLDMRLPDHSGLTVLQRLKELAPTRHIPVHVISVEDRQEAALHMGAIGYAVKPTTREELKDVFAKLEAKLTQKVKRILLVEDDALQRDSIARLIGDDDIEITAVGFAQEALDLLRDHVYDCMIIDLKLPDMLGNELLKRMSMEDICAFPPVIVYTGRNMTRDEEAELMKYSRSIIIKGARSPERLLDEVTLFLHKVESQLSNERQKMLKTARSRDKVFEARKILVVDDDVRNIFALTSALEHKGAVVEIARNGLEAIARLNEVEDIDLVLMDVMMPEMDGYEATIEIRKDPRWRKLPIIAVTAKAMKDDQERCLQAGSNDYLAKPIDLDRLFSLIRVWLPKMERI

SEQ ID NO: 17865 - protein, 481 aa, Pseudomonas syringae pv. syringae B728a
MEKVFMYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 17866 - protein, 493 aa, Pseudomonas syringae pv. syringae B728a
MSLTRFQMCIDGQWVDALSGKTFDSLDPALAEPWAQLPDADEADVERAVQAAQKAFEGQAWRGLTATARGKLLRKLGDLIAENKEQLAQLESRDNGKLIRETRGQVGYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPQDEGTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 17867 - protein, 506 aa, Pseudomonas syringae pv. syringae B728a
MGQAITTIKAGVNMSASDGTPLLQRAIEAECVFNGDWIPSSSPSLPVIEPATGELLMNTAMADAADIAVACREAALAQPAWAALGPREKADIFLLAADHAVCAFDELALYVARETGGSLHKGQHEVNETIVLLRQAAGMLSQAHGHGLILPSQAGRLSYARRVAHGVVGVISPFNFPLVLSLRSVAPALAAGNAVVLKPDPQTPISGGFLIARLFEEAGLPKGLLHVLPGSADAGEALCRDTNVQMITFTGSTGAGRKVAEAAGRNLKKVSLELGGKNPLVILEDADLDLAASNAAFGAWLHQGQICMATGLILVHESIVADLTRKLADKARALTVGNAARGEAALGPLINKRQLQHVHQVVSDSLQAGARLETGGEYEGLFYRPTVLSGVKPGMRAFDEEIFGPVAVVVSFSTDEEAIELANRSEYGLAAAVISPDVGRATAIGDRLKCGMLHINDQTVADECVNSFGGRGASGNGSSAGSPSDWDEYSQWQWVTVKNQAPAYPF

SEQ ID NO: 17868 - protein, 266 aa, Pseudomonas syringae pv. syringae B728a
MHISLKQQVAIVTGASSGLGAGAARALAEAGAAVVINYNSKPEPAEKLAEEIRAAGGKALAVGADVSKEEDVERLFAKTIEHFGALDILVANSGLQKDASIVDMSLEDWNTVINVNLTGQFLCARAALRQFIKQGMRPEVSRAMGKIIHMSSVHQLIPWAGHVNYAASKGGVDLLMRSIAQEVGELKIRVNSVAPGAIRTPINADARKGDAEKEMLKLIPYGRIGEPEDVANAVLWLASDASDYVHGTTLFIDGGMTLYPEFRGNG

SEQ ID NO: 17869 - protein, 262 aa, Pseudomonas syringae pv. syringae B728a
MSVLNRLVPYAGLRVLISGGAAGIGEVLAAAYLEAGAKVHVCDVSEAAIAAFLDRHPGSVATHADVADPAQIEAVFRVQRARFDGLDVLINNAGIAGPTAGIDAISEEEWQRTIDINLTGQYRFAHHAVPLLKASPNAHLIHIASVAGRLGYAWRTPYAATKWAIVGLMKSLASELGESDIRVNALLPGIVEGPRMDGVIRARAQQMNVPEEEMREEYLKKISLKRMVTAEDVAAMALFLCSPAARNVTGQAISVDGNVEYL

SEQ ID NO: 17870 - protein, 381 aa, Pseudomonas syringae pv. syringae B728a
MALIITRKQLDSFCGSIRPIIEPWRTIMHPKNAWYVACTADEVADKPLGRQICNEKMVFYRDQNQQVVAVEDFCPHRGAPLSLGYVENGQLVCGYHGLVMGGDGKTVSMPGQRVRGFPCNKTFAAVERYGFIWVWPGDREKADPALIHHLEWAVSDEWAYGGGLFHIQCDYRLMIDNLMDLTHETYVHASSIGQKEIDEAAPVTTVEGEEVVTARHMENIMPPPFWQMALRGNNLADDVPVDRWQICRFTPPSHVLIEVGVAHAGKGGYDAPKEFKASSIVVDFITPETDTSIWYFWGMARNFNPADEALTASIREGQGKIFTEDLEMLERQQQNLLQHPHRNLLKLNIDAGGVQSRKILERLIAAEQAGPGEQIPVMATK

SEQ ID NO: 17871 - protein, 1210 aa, Pseudomonas syringae pv. syringae B728a
MRKRMSKRFRQLLILATSLCIGWGAEAGVHAADHYTLLGRSSPAHMDVKLDNNQWQWVRGQRELILGTSNPDYPPFDITMSGNDYEGITADYAGIISDALDLPIRVQRFETRDAAIKALGAGQIDLLGTANGFEAVDRTIRLSQPYSVDQPVLVTRVGDNRPLNEGLKGMRLSMVYHYLPPAEVEASYPGATLKTYPSFQNAINAVAFNQADVFLGDTISTQYIINKGYLNNVQMSNFGKHEPNGFSFAVSSENPQLLGIINQTLKAIPVDERVNISRRWSTGSDLMLTDQKLQLTQREERWIAQHPTVRVVVNEAYAPLTFFDAKGNFRGITADLLELVRLRTGLRFDVKRSPSLTDMLNQVSEGQADMIGALVSSDAREDRLSFTRPYIDNSFVLVTRKEPGAPSYLEQMDGKRLAITQGSPVLDWLSRKYPRVVPLEIDNPFQALDMLSLGRAEGAVISLLSADYFLSSGIFEERLQMTATVGEDPALISMATSRNAIELSSILDKALASIAPQDLAAINNRWRVYTPSRANWHDYERLIYQIVVGAGLLLLGLLAWNAWMRRQIRQREAAERALGDQFEFMRALVEGTPHPIYVRDREGMLRMCNDSYLRVFSAQREDIIGKSATEGVLGNAFEAREYAADYQRVMASNTALILDRPLRIGDRQLTIYHWILPFRDSLGEVQGIIGGWIDISERRQLIEDLQAAKEQADAASRAKSTFLATMSHEIRTPMNAVIGMLELALKRADHGELDRSAIEVAYSSANDLLDLIGDILDIARIESGRLSLNPERANLRRLVEAVLRVFDGLARQKDLELVLELDSRINADVLIDPLRFKQILSNLVSNAIKFTPMGRIKVVLLAAESPDPQLLHLHITVQDSGIGISVEDQQRLFEPFAQADNTGQMARTGAGLGLVICRSLCMMMGGNLSLDSTPGHGTRISMNLVLTTLEPLTGQPVVAQPAAVVHQTLRILIVDDHPANRLLLCQQLRFLGHHCEMAENGAQGLDRWKNDAFDLVVADCNMPIMNGYDMTAAIREQERACERQRCPVWGFTANAQPDEIERCRAAGMDDCLFKPISLSMLSERLTAIAPLAPARALPFSLDSVSNLTGDRPEMVERLLAQLLHSNHEDRLLLARLMPENNRQKTRDLAHRIKGAARIITASRVVDACDALELACEPDTPDEQFYTCQQTVELAMIELEDALMLQQAKPD

SEQ ID NO: 17872 - protein, 405 aa, Pseudomonas syringae pv. syringae B728a
MHMDTSFWKAGHKPTLFAAFLYFDLSFMVWYLLGPLAVQIATDLQLTTQQRGLMVATPILAGAVLRFFMGLLADQLSPKTAGIIGQVIVIGALLAAWQLGIHTYGQVLVLGVFLGMAGASFAVALPLASQWYPAQHQGKAMGIAGAGNSGTVLAALIAPVLAASFGWSNVFGLALIPLVLTLIAFTLMARNAPQRSKPKSMADYLKALGDRDSWWFMFFYSVTFGGFIGLASALPGYFNDQYGLSPITAGYYTAACVFGGSLMRPLGGALADRFGGIRTLTVMYAVAAIGIAAVGFNLPSSWAALALFVAAMLGLGAGNGAVFQLVPQRFRKEIGVMTGLIGMAGGIGGFLLAAGLGTIKQNTGDYQLGLWLFAGLAVLAWFGLLNVKRRWRTTWGSAAVTAARV

SEQ ID NO: 17873 - protein, 849 aa, Pseudomonas syringae pv. syringae B728a
MLAGPESPQFSFFARMLSNTRFCTPDLYVRADTPEATPHVAQVNELFPTTNTVSGEITLVEYVVSLDKLGVHDVEHVGGKNSSLGEMISNLAGAGVSVPGGFATTAQAYRDFLELSGLNEQIHAALDALDVDDVNALARTGAQIRQWIMEAEFPEQLNAQIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEAKAGRSVKVIDVEPADRARFCLSDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKESVDKRIAGYDDPVGFYVDKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILAEEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 17874 - protein, 682 aa, Pseudomonas syringae pv. syringae B728a
MVGLPCAAGPIRDHRANRHGRINRTTSAMRCARGAQPMKFRHWDINTRTQIISLGPALLLTALLISFFTFVRIQDLRQELNHTGQLIANQLATAVEPGVTTGDIEGLKALMRATLSMPSVRYVEIQDSSNTAVIYIDQPRENEQQTRQMEVFLAPVQPQRTTIHGNPGAPAAGKGQPAQGASQSYLGRVLVGMSSEAFSRRQQEILLKAGVLAMVALLFAFLLARSLALSLSRPISDMGEALKAIQQGDYHTPMPVSDDAELGALARHINNLAENLHRASLEQQRSVAQLIQTREEAEQANRAKSDFLAMMSHELRTPMNGVLGMLQLLETTHMTHEQSEYATLATESTEHLLRVINDILDFSRIERDALQMEGIPFNLAELVSASTHAFNHSAAQRNLLLELHIQPGLETMNVIGDPTRIRQILVNLIGNALKFTERGKVCVDARWAMLDDERLHFTCAVQDSGIGIDAERLESMFDAFKQADSSISRRYGGTGLGLPIARTLAERMGGTLYAESKEGSGSLFTLQIPLPLSRDASVAIAKPLSILDAHGRERSILLVEDNPVNRTVVQAMLRNLGCEVDIAVDGAEAVMKARAGNHALILMDCRLPVMDGYEATRRIRQLSGLERIPIIALTANALQGDRDACLQAGMDDYLPKPFKHADLQQVLQRWLSFEAPATGDKC

SEQ ID NO: 17875 - protein, 779 aa, Pseudomonas syringae pv. syringae B728a
MTAHASSRWEGLPLRGKALVAISLPLAILMFSLVLIYIAERQTARAEEDVRRVLLVQGDIQTLHTQIAEGAASVRGYLLTHQEDFLPGYLNAQPLIEAALARLNTNVRDEQMREHLKAIEPLINTKVEGLEKLRSMNREDRETVARILIENKYVLDQLRERIGIMREREDALLAERTEAAAATRERLLLSTLLAAACGIFGAILAVLMLSKGIVARVHQVQRNAQRLALGHPLLPQPPEKDEIGQLGTRLVEAGQLLAERERALRDNEERLRLIIEGVKDYGIFALDRNGFITTWNAGAERIKGYTEQEIIGQHFSVFYLQQECPQHPDMALHEATVNGRYTEEGWRQRKDGSRFWASVVITAQYDSNDELRGFSKITRDISDRRVAEIALGTAREEAERASRAKSEFLSRMSHELRTPLNSILGFAQLLDMDSPASQRPQIGHILRAGQHLLKLINEVLDIARIEAGHVSLILEPVSLSNVLEEALVLVSPMAADANIELKPLPSLPDDIGVVADRQRLIQVLLNLLSNAIKYNRPAGQVRIEIEQIAEQVTISVVDTGYGIAPERIGQLFKPFERLDANPSVEGTGLGLALSKSMLEMMHGTLSVQNTPDEGCRFILALPLVRVQPPAATLPRQADTRLEITPDARSPARPAYHGKLLCIEDNLSSMALIETLLQRRPGIQLLSSMQGQLGLDLARQHAPQLILLDLNLPDIKGLEVLQRLRQLPATAQTPVLMITADTSDKAHRELKQAGATAIVIKPIQVPVFLALLDQYLPEPT

SEQ ID NO: 17876 - protein, 249 aa, Pseudomonas syringae pv. syringae B728a
MIEHLKLAGKVALVQGGSRGIGAAIVQRLAKEGAAVAFTYVSSEVSALEIQDSIVANGGRALAIRADSADEKAIRQAVQTTAETLGRLDILVNNAGILAIAPLNEFSMQDFDKTLAINVRSVFIASQEAARHMEEGGRIINIGSTNADRMPFAGGATYAMSKSALIGLTKGMARDLGPQGITVNNVQPGPVDTDMNPAQGEFAETLKALMALPRYGTSEEIASFVAYLAGPEAGYITGASLTIDGGFSA

SEQ ID NO: 17877 - protein, 312 aa, Pseudomonas syringae pv. syringae B728a
MSMNPYLSIAPSVSRPAWHQAIPLPLLEAALVLTWSSGFVGARFSLDHAPPLLVVFWRCVVVTLILLPFVARQLRSIPAATLLKNAGIGLLAMTGYVAGVTQGIALGVPAGLAALFADLLPMGMALLAAVVLGQRLAWPIWAGLFVGLIGVVLVTYSALAVGDAPLWAYGLPLLGMFSLAIATLWQKQSGTAQPMALLPNLWLQCAVSSVAFAIIQGTQGRLAPVASTGFALSVLWTVGLATLGGYGLYWVCLRRASATRVASVLYLSPPVTMLWAWAMFDEPLSWQMASGMAVSGIGVWMVVRAEQRQSAS

SEQ ID NO: 17878 - protein, 302 aa, Pseudomonas syringae pv. syringae B728a
MSRNLVRLLLPETCLFNRSLAAYLIAGGHMRTLELAGRTVPVLGQGTWHMGEKGHQRSAEIAGLCLGIEQGLTLIDTAEMYADGAAEEIVGQAIAGQRDKVFVVSKVYPHNASRAGIPTACEASLRRMNTDYIDLYLLHWPGQYPLTETVEAFERLREAGKIGAWGVSNFDVPDMIELNNPRCATNQVLYNPEQRGIEFDLMLWSADRHLPLMAYCPIGQAGDLLYHPALHEIAKRHDATPAQISLAWVLRQDNMIAIPKATNPEHIRLNIAAEQIRLTERDLADIDLAWPAPTRKVPLAMV

SEQ ID NO: 17879 - protein, 460 aa, Pseudomonas syringae pv. syringae B728a
MQHSALKELWIILRLAGPLIASQMAHMLMVFTDTVMMGKIGPEALAGGGLGAATYSFVSFFCVGVMAAVGTLVSIRHGAGDTEGATRLTQAGLWLAWGMALVAALLLWNLEPILLQFGQAEANVHMAAQFLITLPFALPGLLSFMALRGFTSALGRAGPVMTISLAGAAANFVLNYALIHQWLGLPNLGLMGIGLVTAIVTNCMALALALHIRLHPAYAAYPIRKGLSKLSRSHLGELWRLGLPIGGTYAVEVGLFTFAAFCMGAMGSTQMAAHQIALQTVSMAFMVPVGMSYAVTMRIGQHYGAGNLLMVRMAGRLGIGFGGCVMLMFGLLFWLAPHLVIGLFLDINDPAFAEIVVLATKLLAIAALFEFFDGTQTIAMGAIRGLKDARTTFLIGLGCYWLIAAPAAWLLGFSTDAGASGVWWGLALGLFCSAVALTYAFEWKTARLLRQDAAGLPVPG

SEQ ID NO: 17880 - protein, 480 aa, Pseudomonas syringae pv. syringae B728a
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVRKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEEGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 17881 - protein, 485 aa, Pseudomonas syringae pv. syringae B728a
MLKNQLKDPSLLVDRAYVDGQWISADDGATLTISNPATGEALAQVPALQGVETRRAIEAADRAWPAWRARPAAERAALLERWHQAMLDNVEDLALIMTFEQGKPLNESRGEIRYGASFVKWFAEEARRSYGETIPAPSADRRLMTLKQPVGVCAAITPWNFPNAMITRKCAPALAAGCPIIVKPSDLTPLSALALALLAERVGIPAGVFNVITGMPTGIGEELTGNPVVRKISFTGSTPVGRLLMRQSAEHIKRLSLELGGNAPFIVFDDADLEQAVTGIMLSKFRNAGQTCVCANRILVQNGIYDRFAARLVEEVSKLKVGNGLEEGVTIGPLINPAAVSKVARHIDDALSQGAKLLHGGSPDGTSQFVQPTVLGDTHAGMLLANEETFGPVAPLMRFTDEAEALALANATPYGLGAYYFTQDLRRSWRFGEALEFGMVGLNTGIISMEVAPFGGVKQSGLGREGSSYGLDEYLEVKAFHVGGL

SEQ ID NO: 17882 - protein, 415 aa, Pseudomonas syringae pv. syringae B728a
MDAFNYRDGELFAEGVALSAIAERFGTPTYVYSRAHIEAQYRAYADALSGMPHMVCFAVKANSNLGVLNVLARLGAGFDIVSRGELERVLAAGGKAEKIVFSGVGKTREDMRRALEVGVHCFNVESTDELERLQEVAAELNVRAPISLRVNPDVDAGTHPYISTGLKENKFGIAIAAAEDVYIRASQLPNLEVIGVDCHIGSQLTTLEPFIDALDRLLALVDRLGDCGIHLHHIDLGGGLGVRYRDEEPPLAADYIKAVRERLAGRDLGLLFEPGRFIVANAGALLTRVEYLKHTEHKDFAIVDAAMNDLIRPALYQAWMDVTAVRPRDSEPRAYDIVGPICETGDFLAKGRELALAEGDLLAVHSAGAYGFVMSSNYNTRGRAAEVLVDGSQAFEVRRRETVAELFAGESLLPE

SEQ ID NO: 17883 - protein, 112 aa, Pseudomonas syringae pv. syringae B728a
MKLVTAIIKPFKLDDVRESLSEIGVQGITVTEVKGFGRQKGHTELYRGAEYVVDFLPKVKIDVAIDDKDLDRVIEAITKAANTGKIGDGKIFVVNLEQAIRIRTGETDTDAI

SEQ ID NO: 17884 - protein, 499 aa, Pseudomonas syringae pv. syringae B728a
MQMTTLTRADWEQRARNLKIEGRAFIQGEYTAASSGETFDCISPVDGRMLAKVASCDAADAQRAVDSARSAFNSGVWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAASAAASAIAFNQGEVCTAGSRLLVERSIKDRFLPMVIEALSAWKPGNPLDPATTVGALVDTQQMNTVLSYIEAGHSDGAKLVAGGKRILQETGGTYVEPTIFDGVNNAMKIAQEEIFGPVLSVLTFDTAEEAIQIANDTQYGLAAAVWTANISKAHLTAKALRAGSVWVNQYDGGDMTAPFGGFKQSGNGRDKSLHAFDKYTELKSTWIKL

SEQ ID NO: 17885 - protein, 360 aa, Pseudomonas syringae pv. syringae B728a
MRTALFAYSDRNCCFFRLNVCRRVVIAAARTVGRHPSHQGESSVSDIPEASADGRSSHWQLQRIVSQLRGAREDWRARNRRVSGEHGGRELPSRAAMGEILEALSGALFPMRLGPVDLREESEDFYVGHTLDVALNALLAQARLELRYVAHQQGGDLKSIDARALELIQGFAMALPGIRLLLDTDVLAAYHGDPAARSVDEVLLCYPGILAVIHHRLAHYLYRAGLPLLARISSEIAHSATGIDIHPGAQIGPSFFIDHGTGVVIGETAIIGERVRIYQAVTLGAKRFPSDEDGQLQKGHARHPIVEDDVVIYAGATILGRITIGKGSTIGGNVWLTRSVPADCNLTQANLLQQDDCSRK

SEQ ID NO: 17886 - protein, 336 aa, Pseudomonas syringae pv. syringae B728a
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 17887 - protein, 436 aa, Pseudomonas syringae pv. syringae B728a
MIFSLPAQPCPEVFVNPAVAPPTPDLNTSSVQSSTLPGDTYIEKNTPLFKRTALALFAGGFSTFTLLYCVQPMMPTLSSEFSLTAAQSSLILSVATAMLAIGLLITGPISDRLGRKPVMVMALFCASLFTIASALMPSWEGVLITRALVGLSLSGLAAVAMTYLSEEIHPTHLGLAMGLYIGGSAVGGMSGRLIVGVMIDYVSWHAAMLVVGGLALIAAAVFWKILPASRNFRPRSLHPRSLLDGFVVQFRDAGLPLLFLTGFLLMGAFVTLFNYIAYRFLSAPYNLSQAVVGVFSVVYLSGIYSSAKIGSLADRLGRRQVLWAVIVMMLAGLLLTLFTPLPLVIVGVLIFTFGFFGAHSVASSWVGRRATTARGQAASLYLFCYYAGSSVAGTGGGVFWHYAGWNGIGVFIGVLLLIALGVALRLARLQPLGSQV

SEQ ID NO: 17888 - protein, 242 aa, Pseudomonas syringae pv. syringae B728a
MTESILVTGSSRGIGRAIALRLAQAGYDLILHCRTGRSEAEAVQAEVVALGRQARVLQFDVSDRAACKAVLEQDVETHGAYYGVVLNAGLTRDGAFPALSDDDWDQVLRTNLDGFYNVLHPLTMPMIRRRTAGRIVCITSVSGLIGNRGQVNYSASKAGLIGAAKALAIELGKRKITVNCVAPGLIDTAMLDENVPVDELLKMIPAQRMGTPEEVAGAVNFLMSTEASYITRQVLAVNGGLC

SEQ ID NO: 17889 - protein, 166 aa, Petunia x hybrida
MVVLPLKREREAEFKSITTMANYLMLFSHQENHFNTMMDNSPSRVFECKTCNRQFSSFQALGGHRASHKKPRLMGELNFQLPTSPPKPKTHECSICGLEFPIGQALGGHMRRHRAVMNENNLQVTPVVKKSNSRRVLCLDLNLTPLENDNLEFKLGKAARIVDCLL

SEQ ID NO: 17890 - protein, 475 aa, Pseudomonas syringae pv. syringae B728a
MEWRLSMSAVMTPAEFNDYKVADISLAAWGRRETIIAESEMPALMGLRRKYAGDQPLKGAKILGCIHMTIQTAVLIETLVALGAEVRWSSCNIFSTQDQAAAAIAAAGIPVFAWKGETEEEYEWCIEQTILKDGQPWDANMILDDGGDLTEIIHKKYPAMLDKIHGVTEETTTGVHRLLDMLAKGELKIPAINVNDSVTKSKNDNKYGCRHSLNDAIKRGTDHLLSGKQALVIGYGDVGKGSAQSLRQEGMIVKVTEVDPICAMQACMDGFELVSPFIDGENDGTEASIDKALLGKIDLIVTTTGNVNVCDSNMLKALKKRAVVCNIGHFDNEIDTAFMRKNWAWEEVKPQVHKIHRTGPGSFDAQNDDYLILLAEGRLVNLGNATGHPSRIMDGSFANQVLAQIFLFEQKYADLAPAKKSERLTVEVLPKKLDEEVALEMVRGFGGVVTKLTKTQADYIGVTVEGPFKPDAYRY

SEQ ID NO: 17891 - protein, 365 aa, Pseudomonas syringae pv. syringae B728a
MPTTHLNYVTYEPLGTVLQITPWNAPIFTCGWQIAPAIAAGNAVILKPSELTPLSSLMVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQESIFEKFTNALAVAATQFKVGDPSDPETQIGPINNAKQYNHVKNMVEQALKDGAKLVGEHADPIPEKPGYYINPTVLAGTNALYCAQEEIFGPVVVAIPFKDEEDAIRIANDSRFGLAGGVWTRDVGRAHRVARQVRAGTFWVNGYKTIHVSSPFGGYGESGYGRSSGLDALREYSEVKSVWVETAAKPAASFGYGASLE

SEQ ID NO: 17892 - protein, 630 aa, Pseudomonas syringae pv. syringae B728a
MPTTFKEIPRERPVTPLLDRADTPHGLRRLGEAELETLADELRLELLYSVGQTGGHFGAGLGVIELTIALHYVFDTPDDRLVWDVGHQAYPHKILTGRRARMSTLRQKEGVAAFPRRSESEYDTFGVGHSSTSISAALGMAIASRLQGSERKSIAVIGDGALTAGMAFEALNHAPEVAADMLVILNDNDMSISRNVGGLSNYLAKILSSRTYSSMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLNAPAAQKKISAPKYSGVFGQWICDMADADARLVGITPAMKEGSDLVAFSERFPERYFDVAIAEQHAVTLAAGMACEGSKPVVAIYSTFLQRGYDQLIHDVAVQNLDVLFAIDRAGLVGEDGPTHAGSFDLSYLRCIPGMLVMTPSDENELRKLLSTGYLHTGPAAVRYPRGTGPNAVIEASLDPLEIGKGVVRRQGQGVAILAFGVQLAEALVVAEKLDATVIDMRFVKPLDEALVSEAAANHELLVTLEENAVMGGAGAAVSEFLARANILKSVLHLGLPDVYVEHAKPAQMLTECGLDAQGIEAAINERLALIG

SEQ ID NO: 17893 - protein, 506 aa, Pseudomonas syringae pv. syringae B728a
MRYAHPGTEGAIVNFKERYGNYIGGEFVAPVKGQYFTNTSPVTGKAIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPLLMAAWKLAPALAAGNCIVLKPAEQTPLGISVLIELIGDLLPPGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLDIAKGEGAELLTGGKVEKLEGSLSTGYYIQPTLLKGNNKMRVFQEEIFGPVVSVTTFKDEAEAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 17894 - protein, 254 aa, Pseudomonas syringae pv. syringae B728a
MNRFTQKVIVVTGAGSGIGEATAKRFAEEGASVVLVGRNHDKLAKVAAQLKGEGHLVRATDVADPSDVEALFKEVATRFGRLDVLVNNAGIVKSGKVTELGIEDWKELMSVDLDGVFYCTRTAMPALIASKGNIINVSSVSGLGGDWGMSFYNAAKGAITNFTRSLAMDHGADGVRVNAVCPSLTRSELTEDMLGDKALMAKFMERIPLGRPGEAEDVGDVIAFLASDDARFVTGVNLPVDGGLSASNGQPPQA

SEQ ID NO: 17895 - protein, 310 aa, Pseudomonas syringae pv. syringae B728a
MSFFHIHISRSHMTQGTTVILDGGMGRELQRRGAPFRQPEWSALALSEAPEAVSAVHAAYIESGAQVITSNSYAVVPFHIGEERFAREGQALAALAGQLARESADASGGRARVAGSIPPLFGSYRPDLYKPEQATDVLKPLVAGLSPYVDLWLAETQSCILEAQTIRAGLPNDGKPFWLSFTLQDEDTDEVPRLRSGEPVADAARAAAAMGVATLLFNCSQPEVIGGAIDAAREVFTSLNVDIAIGAYANAFPPQPKDATANDGLDELREDLDPQGYQQWAADWVKRGATHIGGCCGIGPEHIAVLSRSL

SEQ ID NO: 17896 - protein, 576 aa, Pseudomonas syringae pv. syringae B728a
MPTSPVDRPLVDAQSRAEKIVESRRQKILLKTGALQDAIFNSAYFSSIATDEHGVIQIFNVGAERMLGYHSEDVVDKITPADISDPAELIIRAAALSHELNTPITPGFEALVFKASRGIEDIYELTYIRKDGSRLSAMVSVTSLRDSAETIIGYLLIGTDNTARKQEEEAQALLDQRLRDQQFYTRSLIESNIDALMMTDPQGIISDVNKQMMALTGRTRDELIGAPCKNFFTDPASADAAIKRVLSEHKVSDYELTVRAYDGTETVVSYNAATFHDRDRKLKGVFAAARDVTERKRFERTLEEKNIELEHASHMKSEFLATMSHELRTPLNAVIGFSEALRDGMVGDMTDAQRRYIGDIFNSGQHLLSLINDILDLSKVEAGMMTLELESVDLDELLSNSLLIVREQAALQHIQLKLETEAEFGELELDRRKTKQIVYNLLANAVKFSEPGGWVTLAVRLVPASQAGLIDGDWPTYGFALASGDCEQFLELSVSDTGIGIAQSDMNKLFKAFSQIDSGLARKFEGTGLGLAMVKQLTELHGGCVAVASVKDLGARFVVWLPIRSPESAEARWPRS

SEQ ID NO: 17897 - protein, 473 aa, Pseudomonas syringae pv. syringae B728a
MSSSSTSAAAGQQGRQRAASNRLIFISVLVATMGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 17898 - protein, 581 aa, Pseudomonas syringae pv. syringae B728a
MLSTSPSTPLASPVERELSLRAVITGVVLGILLTPSNVYAGLKIGWSFNMSIIALLIGYAIWQGLSKRSSGQLPWTLHESNINQTVASAAASIISGGLVAPIPAYTLLTGQQLDAIPMIAWVFSVSFLGIWIAWYLRPSLLNDASLKFPEGMATLETLLHIYNHGREAATRLKVLLSTALLSALAKWVDTFIWAFPRWSPSAQLERLTFTADPSLLLVGFGAIIGIRVGLTLLIGALLAWGGLAPWLLEQGLVTLPADSSGPQFAALVEWLLWPGVSLMVCSTLASLAIRLWTLHASTKASGGTPWSMPKPGPAAGFALAILLVVSLQALLFGINLWMALLTIPLAICLAAVAARVVGATGIPPIGAIGQLSQLSFGIVAPGQVPINLMSANTAGGSAGQCTDLMNDFKVGRAIGATPRKQLIAQTLGIFVGSIVGVLAYMALIPDPQSMLLTEEWPAPAVATWKAVAQTLTHGLDSLSASIRWAIFIGGLAGLLLGILDSTLPAHRARYLPSAAALGLAFVLPASVSLMMALGAVLTWLVNCRWPSLTERFAITAAAGLIAGESITGVGASLWQMVQNGG

SEQ ID NO: 17899 - protein, 259 aa, Pseudomonas syringae pv. syringae B728a
MMFERLREDIQSVFHRDPAARNAFEVLTCYPGMHAIWLHRFAHILWRNGWKWPARVVSNFGRWMTGIEIHPGARIGRRFFIDHGMGIVIGETAEIGNDVTLYQGVTLGGTTWNAGKRHPTLEDGVVVGAGAKVLGPFTVGAGAKIGSNAVVTKAVPAGATAVGIPGRIIVKSDDEVEARRKAMAEKLGFDAYGVSADMPDPVARAIGQLLDHLQAVDGRLEGMCDALGRLGSDYRAKELPELRDEVFDCVKDCQEGKVG

SEQ ID NO: 17900 - protein, 489 aa, Pseudomonas syringae pv. syringae B728a
MLRISQEALTFDDILLVPGYSEVLPNEVSLKTRLTRGIELNIPLVSAAMDTVTEARLAIAMAQEGGIGIIHKNMTIEQQAAEVRKVKKFEAGVVKDPITIEADATVRDLFELTRMHNISGVPVLHNGDLVGIVTSRDVRFENRLDVPVREVMTPKERLVTVREGADKNEVRELLHKHRLEKVLIVDANFALKGMMTVKDIEKAKAYPLASKDDQARLRVGAAVGTGKDTGERVTALVAAGVDVVVVDTAHGHSKGVIDRVRWVKENFPQVQVIGGNIATGEAARALVAAGADAVKVGIGPGSICTTRIVAGVGVPQISAIANVSAALEGTGVPMIADGGIRFSGDLSKAIVAGASCVMMGSMFAGTEEAPGEIELFQGRSYKAYRGMGSLGAMSQAQGSSDRYFQDSSAGAEKLVPEGIEGRVAYKGPLSAIIHQLMGGLRSSMGYTGSADIEQMRTKPEFVRITGAGMAESHVHDVQITKEAPNYRVG

SEQ ID NO: 17901 - protein, 525 aa, Pseudomonas syringae pv. syringae B728a
MAGAGEPGIAVDRCKKPERASLPCPAFLRLDFSSWYPPLSFPKCRCIVFAPRICSQMRSVVVFEVAPFMSFTRRQILTGIAGLAVVGLGAGGASRYWMGRRESEAGSDFVLIAAPLDVELVAGHKTPAWAFGGSAPGTELRVRQGEWLRLRFINQLPVETTIHWHGIRLPLEMDGVPYVSQLPVKPGEYFDYKFRVPDAGSYWYHPHVSSSEELGRGLVGPLIVEEREPTGFAYERTVSLKSWHVDEQGAFTEFSVLREAAREGTAGRLSTLNGIPQAVIELPAGQITRVRLLNLDNTVTYRLNLPDAEAQIYALDGNPVKPRPFGDEYWLGPGMRICLAIKAPPAGEEISLRNGPVRLGTFRSVANNDAPGQWPPELPANPVAEPDMANAEKINFNFEWVGSMSVNTDNGKPPSLWQINGEAWDITDKTCADRPIARLKLGKSYIFELKNMTQYQHPIHLHGMSFKVIASNRRKIIPYFTDTFLLGRNERARVALVADNPGVWMFHCHVIDHMETGLMAAIEVA

SEQ ID NO: 17902 - protein, 396 aa, Pseudomonas syringae pv. syringae B728a
MSGPQQISILGATGSIGLSTLDVVARHPALYQVFALTGFSRLDELLALCIRHTPQYAVVPDQVVARKLQDDLAAAGLDTRVLVGEGGLCEVAADPRVDAVMAAIVGAAGLRPTLAAVEAGKKVLLANKEALVMSGALFMQAVRQNGAVLLPIDSEHNAIFQCLPGDFARGLGAVGVRRIMLTASGGPFRETPLEQLHNVTPEQACAHPVWSMGRKISVDSATMMNKGLELIEACWLFDARPDQVEVVIHPQSVIHSLVDYVDGSVLAQLGNPDMRTPIANALAWPARVDSGVAPLDLFRIGQLDFQAPDEERFPCLRLARQAAEAGGSAPAMLNAANEVAVAAFLDGRIRYLEIAGIIEEVLDHEPVTAVEGLEAVFAADAKARLLAGQWFERHGR

SEQ ID NO: 17903 - protein, 432 aa, Pseudomonas syringae pv. syringae B728a
MFTTMAKIVDIKGREVLDSRGNPTVEADVLLDNGIIGSACAPSGASTGSREALELRDGDKSRYMGKGVLKAVANINGPIRDLLLGKDPVDQKALDHAMIELDGTENKASLGANAILAVSLAAAKAAAQDQDLPLYAHIANLNGTPGVYSMPVPMMNIINGGEHADNNIDIQEFMIQPVGAKSFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKILTDKIGEKTQLVGDDLFVTNTKILKEGIDKKIANSILIKFNQIGTLTETLEAIQMAKAAGYTAIISHRSGETEDSTIADLAVGTSAGQIKTGSLCRSDRVSKYNQLLRIEEQLGSKAVYRGRAEFRG

SEQ ID NO: 17904 - protein, 370 aa, Pseudomonas syringae pv. syringae B728a
MIKSRAAVAFEAKKPLEIVEVDVAMPKAGEVLLRVVASGVCHTDAYTLSGADPEGIFPSILGHEGGAIVEAVGEGVTSVVVGDHVIPLYTPECRQCKFCRSGKTNLCQAIRATQGKGLMPDGTTRFSYKGEPIFHYMGTSTFSEYTVLPEISVAKIDKQAPLEKVCLLGCGVTTGIGAVLNTAKVKPGDTVAIFGLGGIGLSALIGAVKAKAARIIAIDINPAKFEIAKQLGATDCVNPKDFDRPIQEVIVDMTDGGVDFSFECIGNVQLMRAALESCHKGWGESVIIGVAGAGQEIATRPFQLVTGRVWRGSAFGGVRGRTELPSYVDMAQTGEIPLDTFITHTMGLEGINKAFDLMHEGKSIRTVIHF

SEQ ID NO: 17905 - protein, 335 aa, Pseudomonas syringae pv. syringae B728a
MALGNEAPEFDIDDEVLLMEAGIVLKEASNEKQPAAVSGRTKVKHSTSLKQHKYIDYTRALDATQLYLNEIGFSPLLSPEEEVHFARLSQSGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVGEVKRMLGLNERVSSVDVSLGPDSDKTLLDTLTDDRPTDPCELLQDDDLSQSIDQWLSELTEKQREVVIRRFGLRGHESSTLEDVGLEIGLTRERVRQIQVEGLKRLREILEKNGLSSESLFQ

SEQ ID NO: 17906 - protein, 1013 aa, Pseudomonas syringae pv. syringae B728a
MVVYCVPQHWVTAWATRRKMPTRWPQKSTGKGVSTARTLATEPLPVSVAKTRNNRSDQPLQTEAGRLLRYSRFLPGIHSRRDFIVRWLRIAIASTVGLLTLLFMLSAQAEHGAGWSTLLDEKAHLTLDEIRSARYQNQFSPIELERVTAADRDSALWLHYRLQPTQHEQLLRIFAPDLSSADMYVMDGDRQIDHVRTGNDVPIEDQRLPSNDFLLPVPQSSAPLDIYLRLVSAQKMRPSITLEPAIASAANETQPLLFGLLFGALSMLIVQNLTRYGHTRSRSNLWLAACESLLGLSALLLLNLLRPIDPWNIAQTPSAHLALLLAAVAGLIYTYCFFVHRNARKLDRLLLGNAVLMGIGALLVLFDEKLPINFLTFGLVSLTTLSILAVSMWHWQKGYRSARLFVLGMITFNIGYMVVLPGLLWLSLVPPQWLILALLSVFCISGVLMSLALSERHRSITEDRFSISRDQAASTAEINAKAEFLAKISHEIRTPMNGVLGMTELLLGTPLSVKQRDYVQTIHSAGNELLTLINEILDITKLESGQIELDDVQFDIGALVEDCLNIFRAKAEQQQVELISQIQPQVPRVINGDPTRLRQTLLSLLENALKKTDEGEILLAVSLESSKSGNTRLRISVQDSGESLSDEEREELLHAELHSRNFLASSRLGGHLGLVIARQLIVLMDGEFGIQNTGAQGNTLWLNLPLDAKLLEQPTIDLDSPLKDARVLVVDDNDTCRKVLVQQCSAWGLNVSAVASGKEALALLRTKAHLRDYFDVVLLDQNMPGMTGMQLAAKIKEDPSLNHDILLIMLTGISNAPSKIIARNSGIKRILAKPVAGYTLKTTLADELTQLNKGVVSNKPGPVVTPPVNVPGDFRILVAEDNSISTKVIRGMLGKLNLNPDTASNGEEALRAMKAQRYDLVLMDCEMPILDGFSATEQLRAWEVGNQRVRTPVVALTAHILTEHKDRARQAGMDGHMAKPIELSQLRELVEHWVAHRDKARGLTSDGEHYRQN

SEQ ID NO: 17907 - protein, 304 aa, Pseudomonas syringae pv. syringae B728a
MPQSVRVSPLLIGAFLALYLIWGSTYLVIRIGVESWPPLMMAGVRFLIAGCLMYGFLRFRGVPAPTWREWKAAFVIGFLLLACGNGGVTLAEHAGVASGVAALAVATMPLFTLLFGLFWGNRTTNLEWAGIVLGLIGIGLLNLGSNLQASPYGAAVVIFAAAAWAFGSVLSKHLPLPKGPMASAAEMITAGATLLIGSALSGERLAHMPTAAGWGALLYLVVFGSIVAFSAYMYLLKNVRPAAATSYAYVNPAVAVMLGVVFAGETIGVEECMAMVVIISAVVLIGLPQWRRSPPPEVASTRTS

SEQ ID NO: 17908 - protein, 387 aa, Pseudomonas syringae pv. syringae B728a
MPINVEDYYSAETFKKMKAFADKQETPFVVIDTDIISKAYDDLRAGFEFAKVYYAVKANPAVEVINLLKEKGSSFDIASIYELDKVLSCGVGPERMSYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 17909 - protein, 917 aa, Pseudomonas syringae pv. syringae B728a
MLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 17910 - protein, 266 aa, Pseudomonas syringae pv. syringae B728a
MNVLIVYAHPEPRSLNGSLKDFAVDHLQNNGHQVQVSDLYQMGWKPIIDANDAPGLESSSRFDPALESQRVFAAGIQPPDIEAEQARLLWADAVIFQFPLWWFSMPAIMKGWIERVYACGFAYGVGEHSDQHWGDRYGEGTLAGKRAMLTVTMGGWDSHYSERGVNGALNDVLFPIQHGILFYPGFDVLAPFPVYRAGKVDSATFARICADYGNRLDTLFTLEPLPFRRQNDGDYEIPALTLRPELAAGRQGLGIHLRDEDGPADL

SEQ ID NO: 17911 - protein, 386 aa, Pseudomonas syringae pv. syringae B728a
MGCWQNRYDSRLFQSVFLRSKPMSAVNRAAVETILRQYTDPYLNQDPVTAGCVRSIDIQGAQVSVQLELGYAADLFRNGWAHVLKTAIENLDGVSSATVAISSVISAHKAQSQIPGLANVKNIVAVASGKGGVGKSTTAANLALALSREGARVGILDADIYGPSQGVMFGIPEGTRPKIKDQKWFVPVEAHGIEVMSMAFLTDDNTPMVWRGPMVSGALLQLVTQTAWNDLDYLVIDMPPGTGDIQLTLAQKVPVAGAVIVTTPQDLALLDAKKGVEMFRKVNIPVLGVVENMAVHICSNCGHAEHLFGEGGGAKLATQYDVELLASLPLSMLIREQADGGKPTAIAEPESQIAMVYQELARHVGARIVLQEAASPAMPTISVSDD

SEQ ID NO: 17912 - protein, 253 aa, Pseudomonas syringae pv. syringae B728a
MTRKVAVITGAASGIGQALVVAFARQGVAVAGGFYPADPHDPDETRRLVAEAGGECLMLPLDVTFTESVDDLAAQAVKAFGRIDYAVANAGLLRRAPLLEMTDERWNEMLDVDLTGVMRTFRAAVRHMGEGGALVAISSIAGGVYGWQDHSHYAAAKAGVPGLCRSLAVELAAKGIRCNAVIPGLIETPQSLDSTNSLGPEGLAQAAKAIPLGRVGRADEVAALVRFLCSDEASYLTGQSIVIDGGLTVRWPE

SEQ ID NO: 17913 - protein, 371 aa, Pseudomonas syringae pv. syringae B728a
MDTLFAQLADDTNDTFYTVDPRWITQNAQQFSGCFPGTVLYAMKANPLVHVLEALSQGGINHFDVASLAEVQTVHNTLPNAVQYLMNPVKSRHCLHEAYYRHGVRSFVLDSEEELSKLRDVLPERDSTISMFVRYAPSESTAVYDLRGKFGASPALATQLVHQVAASTDWSLGLSFHVGSQAIEDGPWLAALDDADAIVRDTAQHVRHLDIGGGFPGNYLNSMGNTPDLVGRVCEHIQTSPTLKDLNLICEAGRGLVYGGMSLFARVLSRREHSVFCGAGIFGGLLSAQQWLQFPARVWRDAAPYAGSAEATFNIFGPTCDSMDRLAFPYSLASDIREGDWLEFQSTGAYSVSLRTPFNGFYADRIISLPS

SEQ ID NO: 17914 - protein, 759 aa, Pseudomonas syringae pv. syringae B728a
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELALFQNALEGVRGDMRTLSAKLATQLRPEERALFDVYLMMLDDASLGSEVTDVIKTGQWAQGALRSVVSEHVKRFELMDDAYLRERASDVKDLGRRLLAYLQEARQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPSSVKGH

SEQ ID NO: 17915 - protein, 664 aa, Pseudomonas syringae pv. syringae B728a
MSSASSSSSGMVRMNAPVFYFAASFILIFGIVVIAFPQASGEWLLAAQNWAANTVGWYYMMVMTLYLVFVVVTALSGFGKIKLGADHDEPEFSYLSWAGMLFAAGISITLFFFCVSEPLTHLLQPPQGEGGTAEAARQGMQLLFLHWGLHGWGVFAFVGMALAYFAYRHNLPLALRSALYPLIGKRINGPIGYAVDGFGIIATIFGLGADMGFGVLHLNSGLDYLFGVAHTHWIQVGLITLMMGAAILVAIAGVDKGVRVMSDINMLLACALLLFVLFAGPTQHLLNTLVQNIGDYLGALPSKSFDVYAYNEPSDWLGGWTVFYWAWWIAWAPFVGLFIARISRGRTIREFVFGVLLIPLGFTLAWMSIFGNSAIDQVLNHGMTALGQSAIDDPSMTLYLLLETYPWSKTVIAVTVFISFVFFVTSADSGTVVLSTLSAKGGNPDEDGPKWLRVFWGVATALITSGLLFSGSIDALKSAVVLTSLPFSLILLLMMWGLHKAFVMESQRKIAQLYSLAPVSGSRRGGWRQRLSQAVHYPSRDEVYRFLDQTVRPAIEEVTAVFVEKGLNVVNVPDPSNDSVTLEIGHGEERPFIYQVQMKGFFTPSFARGGMGSKQLNNRRYYRAEVHLSEGSQDYDLVGYTKEQVINDVLDQYERHMQFLHLVR

SEQ ID NO: 17916 - protein, 419 aa, Pseudomonas syringae pv. syringae B728a
MLELAAGFICLTALLTYVNYRFIGLPPTIGVMVTALMFSLLLQGLSFLGYPGLEDRVQQLIGQIDFGDLLMNWMLSFLLFAGALHVNLGDLRSYRWPIGLLATFGVLIATTVIGALAYWIFALFGWHVSPLYCLLFGALISPTDPIAVLGVLRTANASKPLKTTIVGESLFNDGTAVVVFTVLLGIAQLGETPTVGETALLFVHEAVGGVLFGGLIGYAVYLMIKSIEQYQIEVMLTLALVIGGSAMASELHVSGPIAMVVAGLIIGNLGRNLAMNDMTRRYMDGFWELLDDMLNALLFALIGMELLLLPFSWQHLIAASLLAAAILLSRFVTVAPAILLLRRWRKVPHGTIRILTWGGLRGGVSVALALALPTGPERDLLLSITYIVVLLSILLQGLTIGKLVNAVTRAPQAKDPAEH

SEQ ID NO: 17917 - protein, 291 aa, Pseudomonas syringae pv. syringae B728a
MRWRFFRMTTSLQPAYALVPGANLEAYVQTVNSIPLLTPERERELAESLYYEQDLDAARQMVLAHLRFVVHIARSYSGYGLAQADLIQEGNVGLMKAVKRFNPEMGVRLVSFAVHWIKAEIHEFILRNWRIVKVATTKAQRKLFFNLRSQKKRLAWLNNDEVHRVAESLGVEPREVREMESRLTGHDMAFDPAAEADDDSAFQSPANYLEDHRYDPARQLEDSDWTDNSTANLHQALDVLDERSRDILYQRWLAEEKATLHDLAQKYNVSAERIRQLEKSAMNKLKTSIAA

SEQ ID NO: 17918 - protein, 490 aa, Pseudomonas syringae pv. syringae B728a
MARFELQKLYIDGGYVDASNPETFDAINPANGEVLAQIQRAGKDDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 17919 - protein, 616 aa, Pseudomonas syringae pv. syringae B728a
MSGKAQQQSRIKELITLGREQKYLTYAEVNDHLPEDISDPEQVEDIIRMINDMGIPVHESAPDADALMLADADTDEAAAEEAAAALAAVETDIGRTTDPVRMYMREMGTVELLTREGEIEIAKRIEEGIREVMGAIAHFPGTVDHILSEYTRVTSEGGRLSDVLSGYIDPDDGIAPPAEVPPPVDPKAVKAEGADDDEEESADASDEEDEVESGPDPVIAQQRFGAVSDQMEITRKALKKFGRDDKHAIAEMVALAELFMPIKLVPKQFEGLVERVRGALERLRAQERAIMQLCVRDARMPRADFLRQFPGNEVDESWTDALAKGKSKYAEAIGRLQPDIQRCQQKLSALEEETGLKIAEIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATREVLSGLTAREAKVLRMRFGIDMNTDHTLEEVGKQFDVTRERIRQIEAKALRKLRHPTRSEHLRSFLDE

SEQ ID NO: 17920 - protein, 463 aa, Pseudomonas syringae pv. syringae B728a
MTTVSSNTHAISINPATGEQIGHYAFESATALDQSLSRAAAGFAGWKRTPVQQRAQLIVAMGQALRDDVENIARMISQEMGKPVAQARGEIEKCAQLCDWYAAQGPAMLVAEATQVENDKARIEYRPLGPILAVMPWNFPIWQVLRGAIPTLLAGNTYVLKHAPNVMGCAYLMLDAFKRAGFPEGVFEVINVTPDGVSNAIADPRIAAVTLTGSVRAGQAIGAQAGAALKKCVLELGGSDPFIVLNDADLDQAVKAAVIGRFQNTGQVCAAAKRLIIEQGVVEEFTRRFVEQTRQLVTGDPLSGETYIGPMARFDLRHELDAQVQDTLAEGATLLLGGKKAEGQGNYYEPTVLGDVTDRMTSFRQELFGPVASIITARDAQHALELANDSDFGLTATVYTRDLQLAERMTEELETGGVFINGYSASDPRVTFGGVKKSGFGRELSHFGVREFCNAQTVWRDRH

SEQ ID NO: 17921 - protein, 1353 aa, Pseudomonas syringae pv. syringae B728a
MKKSSLTWLVGWMAVVLLAGLSVSFIASHEQRRSIDARIGQALKEAGEGIGDNLQARLRVYEYRLRGLRGAVHMLDLQHINSSQMGRYSKGRNIEKEYPGARGFGFIRRVAASDEAEFVRRVREDGRPDFSLSRLSGPGTRQGDRFIIQFIDPLDRNVQALGLDITSEEHRRDAALQAMRSGAATLSAPITLLQDNDDHMRAFLFLLPVYSTPEIPTDIAQRETSLIGWTYAPLAMREVMSNLDPLNHRLHLKLYDVNEGRQLIYQTPENDHDQEVLQTYAFEREIYGRVWRMEVGAHPAFIAALDPVPAGRVFIIGTLVSLMLTVLVGTLLLSRQRKQQVVAGQARLATIVENSSDAIIGEALDGRIITWNRAAEQMFGYDEHEVLGRPLAPLLVPPELVHEDEQLLERVARGERGPTLETRRLHKNGQLIDVTITCSFIRETDGTLLGAAKMMHDITDRKRVERYLMEFNAQLEQQVSERTAELSRVAGLLQGVLDASSEVSIIATDTQGQIFVFNRGAELLLGYSNSEMLSGNGPGVFHLPEEVAARSAELSREYGTLIEGIDVFCYKASREGSETRQWTYVRKDGTTVPVLMIITPIRTADGELIGHLGIAQDITERLHHSAELHAAKSSAEAANAAKSLFLANMSHEIRTPMNAVIGISHLLHNTALNDQQRQLLTKLQIAGRTLLGIINDILDIAKIEAGEMRLEHNPFSPRQLLDELGELFTPQAQEKGLRFSVNVVASLPGQLIGDALRVNQILMNLVGNALKFTSVGGVDVTVSREDDHADTCCLRFSVQDTGCGIPGDVLGQLFSPFTQADASTTRRFGGTGLGLSVVRGLAEQMGGRIGVESELGTGSEFWVELPFQISQSDLEPSGPGSSLEVMLLSDDAQSSMALQRLCRGLGWRVASLTGEHDLRTALQERNHVNAALPDVLLVDWQQPQVEEVQQLIEATPLPVILVTSSEIRAELHPLVDKVLLKPLDSSALFNAVNACIARYQGSTERVIQATRMDTSMTLWLSGLHLLLVDDSEINLEVASLLLQQQGAVVQTCSNGLLALERLRQTPDFFDAVLMDVQMPEMDGYEATRRLRSELGLTRLPVLALTAGALAEERRQAELAGMDDFLTKPLDPAALIRAVRRAVERVRGAPLAVGTLLQEASTGSAWPVIEGIDTQEVAARLGNDVPLFLSSLRRFFSEFAAFGESESVLARARQNPDQTMADLHKLRGSALLLGATQVGLHAGQAETLLRNAADPEQAVRALSAAFRSLQERTPVLEERPLAPRIDADPDVSRQALSTLRELLENHDIAALDQFPLAAVALQELAGQALVEQLWQTIEGLEFEQALHLLERAEL

SEQ ID NO: 17922 - protein, 394 aa, Pseudomonas syringae pv. syringae B728a
MTGTYRCSAQRQRSKARASSIGENHMKSRAAVAFEPGKPLQIVEIDVEPPRKGEVLIKITDTGVCHTDAFTLSGDDPEGLFPVVLGHEGAGIVMEVGEGVTSVKVGDHVIPLYTAECGECLFCKSGKTNLCTAVRATQGKGVMPDGTSRFSYNGQPLYHYMGCSTFSEYTVVAEVSVAKINPDANPEHVCLLGCGVTTGIGAVHNTAKVQPGDTVAVFGLGGIGLAAIQGARQAKAGRIIAIDTNPAKFELARSFGATDCVNPKDHEQPIQQVIIEMTGWGVDHSFECIGNVHVMRAALECAHRGWGQSIVIGVAGAGQEISTRPFQLVTGRTWKGSAFGGVKGRSQLPKMVEDAMKGEIELAPFVTHTMGLDRINEAFDLMHEGKSIRTVIKY

SEQ ID NO: 17923 - protein, 486 aa, Pseudomonas syringae pv. syringae B728a
MTSQSLNSHHVDPDTALKLYIDGRWSAPLDPVSIAVINPATEEVVAHVASGSAADVDRAVAAARAAFAGWSGSSPHARAQVIGRIHELILERKEQLAQAISLEMGASISSARAMQVPLAAEHVRVARDLLATYRFHTVEGSTAIEREPIGVCGLITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFAKAVPPGVMAAFRNVGQSCSAPTRMIVPRNRLAEVEALAAETAAAIVVGDPQLEETVLGPIANEAQFQRVQAMIDAGLSEGAKLVCGGPGRVQGHERGFYTRPTVFSEVDSSMRIAREEIFGPVLCLIAYDTVEEAIAIANDTVYGLGAHVQGQDLEQARAVASRIRAGQVHLNYPAWNPMAPFGGYKRSGNGREYGVQGFEEYLETKAIVGFA

SEQ ID NO: 17924 - protein, 249 aa, Pseudomonas syringae pv. syringae B728a
MKLEGKIAVVTGASKGIGAGIAKALGAEGARVIVNYATGKADADAVVAWIAEHGGSAFAVQADMSQSADVIRLFETVGTKYGALDILVNNAGVAVFQMIDDLTEEAFHTQFNLNVLGYLLAVREAVKLLGPTGSIINISSILSTDPYLASSVYAATKGAVDTLTFALARELGARGIRVNSILPGHTNTPATHGHFAGELGEKILAGTPLGRFGEPEDIAPLAVFLASQDSHWVTGESIRASGGVRGVGY

SEQ ID NO: 17925 - protein, 244 aa, Pseudomonas syringae pv. syringae B728a
MGDKKKLLLTGASRGIGHATVKHFNAAGWEVFTASRQNWVDDCPWAEGLLNHIHLDLENIDSVSESMAAIKDKLGGRLDALVNNAGVSPKTEDGGRMGVLESDYSTWIKVFNVNLFSTALLGRGLFDELKAAKGSIINVTSIAGSKVHPFAGVAYATSKAALSALTREMAFDFGPHGIRVNAIAPGEIDTSILSPGTAEIVERLVPMHRLGKPEEVASLIYFLCTAGASYVNGAEIHVNGGQHV

SEQ ID NO: 17926 - protein, 240 aa, Pseudomonas syringae pv. syringae B728a
MLTLRKASDRGAADHGWLKSFHTFSFAGYRNPQEQGFSDLLVINDDRVSAGKGFGQHPHRDMEIFSYVLEGALEHKDTLGTGSVIRPGDVQLMSAGTGVAHSEFNHSHTEGVHFLQIWIVPNVAGAAPNYQEKHFSPEQKRGRLQLIISPEGENGALKVRQDARVYAGLFDGDETATLELAANRYAYVHVARGSVVLNGEQLGEGDGVRVRDEQTLSLSAGVDAEVLVFDMRPNELPQMP

SEQ ID NO: 17927 - protein, 796 aa, Pseudomonas syringae pv. syringae B728a
MLGRHRAPEVAVLMDISLKNRLSFKQARLAVSIGFVLGTLLSLFQIAIDYASEDASINREIKSLLEIIQNPASRIAYNIDSELAQELTLGLLRSPAVVSARLTDNNDAVLSSVERPMATGRYRVFSDWLFGESRQFQEKLHLNHLPNETIGTLYLTVDTFAFGSHFLQRAEITLLNGFVRSLALAGILTILFYATLTKPLVRVIRELSSRDPRNPDQGKITCPPYHAQDEIGVLVETFNRQFETMSSEFSRRRAAEDRLTDHLNELENIVSARTNELKASNLRLRESNEELQIARSTALDMAHARSAFLAHMSHEIRTPLNGLLGMLALSLDSPLGAEQRQQLMIAHDSGKVLVELLNDILDMSKFDAGHLEIERIPFDLGMLIEDTANLLSQNAAPSVELTCLIAPDFPAMVTGDPTRVRQIVSNLLSNALKFTRFGRVDVRLTHHRDASSGEHRVRIEVRDTGIGIAQDAQTRIFQPFTQAETAITRQYGGTGLGLALTNNLCEAMNGTLSIQSQSGFGSQFCAELPLPVHVPAVTQTPLKGRVTVISSAGSGLVELLGSLLPFWGVDLKRRSIDDRAQAVDLDGSSDLVITDCPECLFTIRPTTPVPILLVTAYGNFMPGEQVAALAPLQQQARPLARNALYHTLRRILGQEETGLKDTQALEHTAPRLARVLLVEDNPVNQLVAKGILGKLGCEVIISSHGGEALEQLEQGHFDLVLMDCNMPVMDGYEASRQIRSSGRWPNLPIVALTANAMPDERERCKAAGMNDYLAKPFRRAELVSILDQWIPITGID

SEQ ID NO: 17928 - protein, 1239 aa, Pseudomonas syringae pv. syringae B728a
MSDRSARHQAFLTALKQRILILDGGMGTMIQSYRLEEQDYRGKRFADWPSDVKGNNDLLILTRPDVIGAIEKAYLDAGADILETNTFNATQVSQADYGMESIVYELNVEGARLARKVADAKTLETPDRPRFVAGVLGPTSRTCSLSPDVNNPGYRNVTFDELVENYTEATKGLIEGGADLILIETIFDTLNAKAAIFAVQGVFEEVGFELPIMISGTITDASGRTLSGQTTEAFWNSISHAKPISVGLNCALGASELRPYLQELANKANTHVSAHPNAGLPNAFGEYDELPSQTAKIIEEFAQSGFLNIVGGCCGTTPAHIKAIAEAVSGYAPREIPDIPKACRLSGLEPFTIDRQSLFVNVGERTNITGSARFARLIREDNYTEALEVALQQVEAGAQVIDINMDEGMLDSKKAMVTFLNLIAGEPDISRVPIMIDSSKWEVIEAGLKCIQGKGIVNSISMKEGVEQFIHHARLCKRYGAAVVVMAFDEQGQADTEARKKEICKRSYDILVDEVGFPPEDIIFDPNIFAIATGIEEHNNYAVDFINACAYIRDELPYALTSGGVSNVSFSFRGNNPVREAIHSVFLLHAIRNGLSMGIVNAGQLEIYDQIPAELRDCVEDVVLNRNPEGTDALLAIADKFKGDGSVKEAETEEWRSWPVNQRLEHALVKGITTHIVQDTEESRVGFARPIEVIEGPLMAGMNVVGDLFGAGKMFLPQVVKSARVMKQAVAHLIPFIELEKGDKPEAKGKILMATVKGDVHDIGKNIVGVVLGCNGYDIVDLGVMVPAEKILQVARDEKCDIIGLSGLITPSLDEMVHVAREMQRQDFHLPLMIGGATTSKAHTAVKIEPKYSNDAVIYVTDASRAVGVATQLLSKELKPAFIEKTRLEYVEVRERTSARSARTERLSYGAAVAKKPQFDWENYTPAQPTFTGTRVLQDIDLNVLAEYIDWTPFFISWDLAGKYPRILTDEVVGEAATALYADATQMLRKLIDEKLISARAVFGFWPANQVNDDDLEVYDDDGKPLAKLHHLRQQTIKPDGKPNFSLADFVAPKDSGLTDYIGGFITTAGIGAEEVAKAYQDKGDDYNSIMVKALADRLAEACAEWLHQQVRKEYWGYAQDEALDNEALIKEQYMGIRPAPGYPACPDHTEKGTLFALLDPLPEGSAEHTAGKSGVFLTEHYAMFPAAAVSGWYFAHPQAQYFAVGKIDKDQVESYTARKGQDLSVTERWLAPNLGYDE

SEQ ID NO: 17929 - protein, 592 aa, Pseudomonas syringae pv. syringae B728a
MPTRTSRRTFVKGLAASGLLGGLGLWRSPAWAVANPGQPNGLSGTEFDLYIGETQVNITGNAKTAQTINGGIPGPLLRWREGDTVTLRVKNRLDEATSIHWHGIILPANMDGVPGLSFDGIAPDGMYVYRFKVRQHGTYWYHSHSGFQEQSGVYGPLVIDPKEPEPFEYDREHVIMLSDWTDEEPVQLMKTLKKQSDYYNNNQRTVGDFINDVGEKGWSETTRDRWMWAQMRMDPTDLADVSGATYTYLMNGQAPNMNWTGLFKPGERIRLRLINGSAMTYFDVRIPGLKMTVVASDGLHVKPVTVDELRIAVAETFDVIVEPAEGAYTLFAQSMDRTGYARGTLASRPGLQAAVPPLDPRPLSSMDDMGMAGMEHGSMNHAAAPATHDMSGMDHSKMGHDAMPGMDHAQTPAQKTPTPQSHPESENNNPLVDMQAMSTSPKLDDPGIGLRGNGRRVLTYADLRSTFEDPDGREPSRTIELHLTGHMEKYAWSFDGVKFSDAKPLMLKYGERVRVVLVNDTMMTHPIHLHGMWSDLEDENGQFMVRKHTIDMPPGSRRSYRVTADALGRWAYHCHMLYHMEMGMFREVRVEE

SEQ ID NO: 17930 - protein, 606 aa, Pseudomonas syringae pv. syringae B728a
MESRTSRRTFVKGLAAAGVLGGLGLWRSPSWAASGSAALSVLSGTEYDLSIGEMLVNITGKRRTAMAINGGLPGPLLRWKEGDTVTLRVRNRLDAATSIHWHGIILPPNMDGVPGLSFAGIEPGGVYVYQFKLQQNGTYWYHSHSGFQEQVGVYGPLVIEAKEPEPFKYDSEHVVMLTDWTDEDPVALMRTLKKQSDYYNFHKRTVGDFVNDVADKGWAATVADRKMWAEMKMNPTDLADVSGATYTYLLNGQAPNMNWTGLFRPGEKVRLRFINGSAMTYFDIRIPGLKMTVVASDGQYVNPVKVDELRIAVAETFDVIVEPTAEAYTVFAQSMDRTGYARGTLAVREGLVAQVPPLDARPLVTMDDMGMGGMDHGSMGSMDSGADDGMQTMSSMGGNSMPAMDHSKMSTMQGMDHGAMPGMDHDSMGGMVMQSHPASEKNNPLVDMQAMSPTAKLNDPGLGLRNNGRKVLTYADLKSTFEDPDGREPSRTIELHLTGHMEKFAWSFDGIKFADAQPLVLKYGERVRIVLVNDTMMTHPIHLHGMWSDLEDEDGNFRVRKHTIDMPPGSKRSYRVTADALGRWAYHCHLLYHMEMGMFREVRVEE

SEQ ID NO: 17931 - protein, 333 aa, Pseudomonas syringae pv. syringae B728a
MIKLDGTSDKSRLGGNAILGVSLAVARAAASALNLPLFQYLGGEQAARMPVPMFNILNGGVHANWQGPDFQEFMIAPTGAGSFKEALRWGSEVYHELKAVLKDAGYSTAVGDEGGFAPALKKNSDAIELIIKAIERAGYTPGSQIEIAIDPASSGFYENGLYHLRSEGRKVDAQELINLYSSWVDKYPIAVLEDGLAEDDWSGWKLLNAALGDRIELVGDDLFVTNVERIQRGITENVANAVLIKPNQIGTLTETKAAIEMAYGANWGAMVSHRSGETVDSSIADLTVAMGTGHLKTGAPCRGERVEKYNQFLRIEEDLGSRAFYAGHDAFVR

SEQ ID NO: 17932 - protein, 278 aa, Pseudomonas syringae pv. syringae B728a
MNSIVSIRPRAIVHRTTGRTRGPITRLVSPGDLGQVLKPFVFLDRIGFTSEPGKTGFGMHPHSGIATLTYMIEGELTYEDTTGKSGTLLSGGVEWMSAGNGVWHDAQPISGSAVRGFQLWVALPEAQENGPAQSVYLSAAQVAQQGPASVLLGRYGSAKSSLPAPEGMNYLAVQLKDGEHWRYTPPAGHSVGWLAVNTGQLDAGGQVGAGELVIFEESDRPIDIVAKGDTHFVLGSAVKHPHELVTGYYSVHTSKAALIQGELEIERIGALLREEGRL

SEQ ID NO: 17933 - protein, 967 aa, Pseudomonas syringae pv. syringae B728a
MAPWRCTGVKAMLELTLEQISMAQSAVDKTAALKLIADHLVADGLVAEGYLTGLMNREQQGSTFLGQGIAIPHGTPETRDLVFTTGVRLMQFPEGVDWGDGQMVYLAIGIAAKSDEHLRLLQLLTRALGEEDLGQALREAKTPEDLLKLLQGAPQELALDAQMISLGVSADDFEELVWRGARLLRKADCVSNGFAAVLQQVEALSLGDGLWWLHSEQTVKRPGLAFVTPDKPMRYLGQPLTGLFCLASLGEAHQALLERLCLLLIEGRGHELGHATNSRAVLEALGGELPAEWPTRQIQLANAHGLHARPAKILAQLAKEFDGEIRMRVLETGEAAVSAKSLSKLLSLGARRGQTLEFIAEPTIADDALPALIAAVEQGLGEEVEPLPAVSQTEAAPAPAPAAAKPLSAPPAGSVLQAVSASPGIAMGPAHVQVLQSFDYPQRGESVAAERERLHKAIGEVRSDIENLIQRSKSKAIREIFITHQEMLEDPELTSEVEARLNNDESAAAAWATVIETAAVQQEQLQDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDEATLQRAVQDRDAREQRLKAAAAARMEPAVTRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRSADSGPLRIMFPMIGTLEEWRQARDMTQRLREEIPVSDLQLGIMIEVPSAALIAPVLAKEVDFFSIGTNDLTQYTMAIDRGHPTLSAQADGLHPSVLQLIDMTVRAAHANGKWVGVCGELAADPLAVPILVGLGVDELSVSARSIGEVKACVRELTLSSARELAQNALTAGSAAEVRALVEAV

SEQ ID NO: 17934 - protein, 284 aa, Pseudomonas syringae pv. syringae B728a
MTQFRKVLSIQTGQPASDGAGVKLTRVFGGRGVEQFDPFLMLDEFGSDKPDDYIAGFPPHPHRGFETVTYMLEGRMRHEDHMGNVGLLQGGGVQWMTAARGIIHSEMPEQEEGTMRGFQLWLNLPGKNKLSDASYQDIQPENVPSITTQAGVQVVVLAGHFDDGQVQQAGAVQRPDTEPLYFDFDMPAGSRISPHVPDGHLVLLYVYEGSVELEGSAQPIGKRHMARLSDSGAVQISSTAGARLLLIAGKPLREPIVQYGPFVMNTKEEIEQAIRDFREDRLTA

SEQ ID NO: 17935 - protein, 207 aa, Pseudomonas syringae pv. syringae B728a
MLKIWGRKNSSNVRKALWIAEEVGVPYETQDAGGAFGLVNEAAYRAKNPNGRIPMIEDGDFVMWESNAIVRYLAARHAPDSDLYPADLQARANADKWMDWTTSTIAAPFSPVFWGVVRTPAEKQDWPAIKQGIKTLHSLLLVADEALSRQPWLSGDAFGMGDIPLGCFAYGWFEMPIERPPLPHLQAWYERLKTRPAYRKAVMTPLT

SEQ ID NO: 17936 - protein, 229 aa, Pseudomonas syringae pv. syringae B728a
MSEQQKQRGPIKAVIFDMDGLLLDTEGVYTEVTHLIASRHGRTFDWSVKQHTIGRGARDFSDYVIKALELPMSIDEFLEVREPMLEERFPRAAAMPGAEALVRHLAAHNIPIAVGTSSSVHYFEAKTTLHRAWFELFDTVVTADDPEVGAAKPAPDIFLVAARRLGVSPADCLVFEDSPFGVTAAKAAGMYAVAVPDSHMPVEQYEHADLLLGSLADFPLKAWGLPELA

SEQ ID NO: 17937 - protein, 139 aa, Desulfovibrio desulfuricans G20
MPTILIVEDDPITRGILRDIVTSYGHKVLDVADGRTAWERLQNDPDIDLMITDVRMPGLDGMELVGMLRSNDRLQGLPVIITSGVVGLRQIARLLRRGASSFIAKPIDPKELQHCIQNTLAAGTGVPHSSRPDDVSARS

SEQ ID NO: 17938 - protein, 408 aa, Desulfovibrio desulfuricans G20
MSPASVNAHLAFTGYLGRRLHMGVCGSVAAYKALDLLRRFKDTGADTGVTLTDSACQFITPLSFEALGASPVYTGMYPVGDDVFGHLTPGDACHAFLIAPATAATLARLACGLADDMLSCQALAFEGPLVIAPAMNPRMWNNPATQENWARLKQRGHVAVEPGCGRMACMDVGQGRLADLDTIFLYTLRAMTPQDMTGQQVMVTLGPTREQWDGVRFWSNPSSGVMGACFAVAAWLRGAQVHAVCGPATPWLPADITRHDVTGAAQMYQAAADLWPRMDTGIFTAAVADFSPEPFGAEKFKKSGTETLSIRFTPNTDILKTLGTAKRENQRIVGFAAETGNLHENAVGKLRRKNADMIVGNIVGTPESGFQSATNKVFVADKTGRTEEWPVQPKTEVAWRILDWLLQM

SEQ ID NO: 17939 - protein, 108 aa, Desulfovibrio desulfuricans G20
MKLLIAYIRPEKLSTVKKALYARGIYAMSVTNALGSGQQKGFTETYRGIVTEVNLLKKVRIEVGVPADKAEDALAALQTGAHTGREGDGIIFVQDVARTVRVRTGEAP

SEQ ID NO: 17940 - protein, 557 aa, Desulfovibrio desulfuricans G20
MPDGRPLHKDETVNEQSNKNSTPEADTKPSWFHLEVHPWVFFGSAGLIFLFVGITLVFQHFLGDVFQTMQSYMSTYTGWFFIATMNIVLLFVLLLTVSRYGDIRLGGPDAEPEFSTMAWFAMLFSAGMGIGLLFYGVAEPMFHYVANPLTEPGTTEAARKAMDITFLHWGLHPWAVYSVVALSLAFFSFNKGLPLSIRTAFYPVLGERIYGPVGNAIDIMATVATLFGVATSLGLGVKQVNAGLDHLWGIGQSTGIQVILIAAITAVATWSVVAGLDKGIRRLSEINIVLAGMLALFVLFLGPTLFILNATLENIGYYIQFLPQLSTWNETYEHTEWQHGWTIFYWAWWIAWSPFVGMFIARVSFGRTIREFIMGVMLVPTFITFLWITIFGNTALNIEMFGAGGIATAVQENLPVSLFVMLENFPLSSVTCFLGIVVVITFFVTSSDSGSMVIDIITSGGDPNPPVLSRLFWALLEGVVAAVLLMGGGLVALQTATITTGLPFAVILLGMCYSLHKGLKEYSGPQEFTLGIPKQQVRFRVKRKPVLDRTFGRRKFW

SEQ ID NO: 17941 - protein, 415 aa, Desulfovibrio desulfuricans G20
MSESCGCSAGGNCSSGGCHENKSPEDLRLESSVSRIRNKVVVMSGKGGVGKSTIAANIAVSLALAGQKVGLLDVDVHGPSIPRLLGLDKAEIRMEERSLLPVPWNANLSVMSVGFMIPDPQQAVIWRGPVKMGFIKQMLSEVAWGDLDFLVVDCPPGTGDEPLSVLQLLGTDARAVIVTTPQAVAVDDVRRSIGFCRELGNPIAGVVENMSGFACPQCDHVEPLFGQGGGEALAKETNVPFLGAVPATSLMSRCGDKGLVFVQAQPENPVAEAIGRIVKPLLAHAGTLHEREGAVPAPQAEGTVKVALPLANGSLCQHFGHCEQFAIVTADTTAKTVLGTENITPPPHEPGVLPRFLAEQGVNVVLAGGMGARAQSLFTGQGINVVTGISGGSPHEVVSAWMQGSLTAGANTCDH

SEQ ID NO: 17942 - protein, 479 aa, Desulfovibrio desulfuricans G20
MTDARKALPLDLSLENKVKDLSQADFGYKEMQLSEREMPGLMELIAKHGAEKPLKGLKVTGSLHMTIQTAMLIKTLYELGADIRWASCNIFSTQDHAAAAIADSGMAKVFAWKGETLEEYWWCTEMALTWPDGSGPDLIVDDGGDATMLIHKGVEAEKNPALLEKSYDNKEFQIVMNRIALSMKNDPGKWTRVAAKVRGVSEETTTGVHRLYHMEKDGSLLFPAINVNDSVTKSKFDNLYGCRESLADGIKRATDVMIAGKTVVVLGYGDVGKGCAHSMRGFGARVLVTEIDPICALQAAMEGFEVVTMDEAAPEGDIFVTATGNFKVITGEHMERMKDEAIVCNIGHFDNEIDMAYLEDSTECSCLNIKPQVDKWTLKSGRSIIVLAEGRLVNLGCATGHPSFVMSNSFTNQVLAQLELASNPDLERKVYILPKKLDEEVARLHLARLGAKLTTLTDEQAEYIGVDKTGPFKPDHYRY

SEQ ID NO: 17943 - protein, 321 aa, Desulfovibrio desulfuricans G20
MRNCSKEPDNICADGMDWLDDVVETMCSPESCSKVFSKPLNNAPMPSLEELTEIVDRLKAALFPGYFGKSSIEMESMRYHLAANLDSIYRKLADQIRRGGCFTCAEFANDCHSCDVYSHDLAKRFIEQLPQIRGLLLGDVTAAFEGDPAAKTPGETVFCYPSITAMLHHRIAHALYDLDVPLIPRIISEMSHSRTGIDIHPGARIGEDFFIDHGTGVVIGETCIIGKGCRLYQGVTLGALSFPKDASGTLIKGNPRHPILEDNVTVYAGATILGRVTIGKGSIIGGNVWLTHDVPEGSKIVQQRSTRPQADEKMLGTKNGR

SEQ ID NO: 17944 - protein, 355 aa, Desulfovibrio desulfuricans G20
MRGLLAFGRDPPYSRRSTFPTQEPAVPQSRSAAAAPFALFIAVTLWGSSFVATKIGLRQLEPLSIVWLRQLVATLAILPFWLPAWLRHRHAATVRRSDTGLLLLLAFFQPCLYFVCESYALQLTTASQAGVVSAMMPLMVAVVAGAMLGEQVTRRMWGGFALSVTGVVWLTLASAPEESAPSPMLGNMLELAAMACGVGYTIACRKLGSTFSPVIITGVQILAGFLFFLPGAFMLPAGFTSMAAQALTTPGSDAAISLFAVGYLGLFVTLGAFALYNFGVSALSASKASAWINLVPVVSIVLGHLVLGETFSPYQAGGALLVLGGLYLCQRTPAPPRHGIMQVQKPQRAGALEKE

SEQ ID NO: 17945 - protein, 620 aa, Desulfovibrio desulfuricans G20
MNSINHSYAGGKYGMPRGMACPCIHEEQRLLKNKASGLSGEFRPASCPVAYVWCRTLLSDFKQKAETHMASRQEMTESGAIAACGEGADSRSLEAEILRLRQREKELLHERQMLKDILKAIPDMLTVHDRDGNVMFSNCKPNEDCWQHHGGTKHGLRCYQCHFHGDRNCEDCYIPDVFDSGEQRVVEMYNPDMKSFRSITVFPVRDGQGDVTMVAEYVRDVTATRNLERELRVAKEAAEAADRAKSEFLASMSHEIRTPMNGVLGMLDLAMTTSLDEEQREYLEAVQNSAEALLSLINDILDFSKIEAGMVELDQQVFRLSKRLSSLHTMFVHRAAERNLEFAINISPDVPDGLSGDPLRLRQIVVNLLDNAFKFTDQGQVVLSVEVLERGAENVLLQFSVQDTGPGILERHQERIFDSFAQADASFTRRHQGSGLGLAICKRLTGLMGGDIKVRSTPGEGSTFVFSARFGVAVLDEEPVRVRSRTAEPAPVRGRILVAEDHPMNLMFIEKFLKKQGYESVSVTDGSEVVPALTRSRFDLVLMDIAMPAMDGMEATRAVRAATGMKTPSDVPIIAMTAHAMKGDREQFLEAGMDDYIGKPINSDNLRSMIIRHLQARRKS

SEQ ID NO: 17946 - protein, 773 aa, Desulfovibrio desulfuricans G20
MNRTPLKRRFTVTLMLFTLLCCALYTVTASSFMHYHNAQITSRTERLLHALVLQRENDLANQIFVGHIRALRSTAADLQETDDVYSITVYDKSGKPLIHTRPERPLPLTGAEMAILAQGDVDARGTENGVPLLYHTSALMVIGELQGFVTVAYDLSHVRRDTILLSAMLTILLLGTVIAAGMVCSHFITQHIRRPLTALRDAMHRARSGELQHRAPIEAQDEVGRLAESFNAMVATLQRNESSLRHAQTIYKDIFENALEGIFQITGRGYLINANPALARMLGYSSVMELLAERGTTPLKSLVNRRDLARMLRMLRAKGAVDGYETRVYTKGGGITWISVSARTIAKEETGQPESFRYEGFVKDITEHRRLRELEQTRTAMIEADKAKSDFLAHMSHEIRTPMNSVLGMAEQMLRTPLSAEQKECMDVLKNSGESLLHLINDILDLTRVEGGQLALASAPFTVHAVVYGVRDMLSLQARQKNILLAATIAPDVRKNHMGDAQRLQQILVNLLGNAVKFTDNGEVSLHVSRAPDAVHDGDLLFTVRDTGIGITPAEQSRLFQKFSQASTAIHSRYGGSGLGLAISRHLVDLMGGTIRLESEPGVGTTVTFTARFAAVPEETARTGHEAEQPDTAGDDATALPALTVLLAEDTPSNRAVVRMMLQDTPCTVIEAEDGQQALHLFGQYDIDVVLMDINMPVMDGMEATRQLRRQEHGSGRRTPVIALTANAFQQDIIRYRQAGCDGHLVKPVTRKALLTALQSCAGGGATHSGSGA

SEQ ID NO: 17947 - protein, 434 aa, Desulfovibrio desulfuricans G20
MSNVRSAVTDELDFYGLSTPMELVETYGSPLYVYNENVLRRRCRELKGLSSHPGFRVNYSAKANANLSLLRIIRSEGLVVDAMSPGEIAMHLAAGFTPDEITYVCNNVSAEELRNAVDHGLLVSVDSLPQLDLLGQVNPGGKVMIRINPGIGAGHHKKVVTGGKETKFGIGPDDGDAVRRILKRHNLTLAGLNQHIGSLFMEPDSYMEAVEFLLREAEQWDSLEVIDFGGGFGIPYRKYEKQPRLDMEATGRMLDDCIGRWAERTGYNGRFMIEPGRYVTAECGVVLGTVHAVKNNGERRFAGTDLGFNVLQRPVMYDAFHDVEIYREDGVPQQETMQQTIVGNICESGDIMAAARELPEIQEGDIIAMLDAGAYGFAMSSSYNQRLRPAEVLVDKDGRDRLIRRRETLDDLLACFPEHAEKTGGSVRVAGGRG

SEQ ID NO: 17948 - protein, 847 aa, Desulfovibrio desulfuricans G20
MRLRWRRLADTPVIMAYCQLTLCLQTREALMMYAVHALLKALWRLEKENETLRSALSGTQHAAQARPLGGLPYAEVALRPGAGEQTGGEAGKQADTSPEMGRDLYVSHVSDALLELAGMTAPLKDPADIFTAVPWQLALLCTQSTPVLVSIPLRIRTAQGGSLPVLAMPLPLPHHDSAASRTSWRFMVLPVDGVPCEDGINLTRAMADNMIDMLWAKDTKGRYLFANRAICEKLLCCDGIDPLGRDDIYFARRQRALGWQHTFGELCLNSDDIVLLSQKPGRFVEDGLVQNKYLALEVQKSPLYDPRGVLIGTVGTGRDITRQKEAEEALRRSEHRFGMVLRATSDIIWAYDIAKDTMTCGKMDSPDPFRAMQECHCLPVHHEELKDIKDHVSRFFREGGDNLQHEFNLTAHDGNTIWLLSRGRVMEFDEKGAPLLAVGSHTDITELKTAQVAAEAAAKAKSAFLATMSHEIRTPLNGVLGMLQILGNEITDPKPLRLTRTALDSGRKLLAIINDILDFSTIDAGAAPLDHAPLRIRETVNSVLANFSEEVRQKGLTLTAVVDRAVPDVLVGDESRIRQILFNLVGNAVKFTREGSVRVDVLLLTAPADEEARLLVTVEDTGIGMEAEMLPRIFDPFFQVDGTYRRRYQGTGLGLGIVRSLVSMMNGNISVESTPGVGTTICCSLLLRKAQQQEQPAGGQEQEIPALPPARILLAEDEEVNRMAATYLLRKMGHTVTAATSGLHVIELLQDHEPDCILMDIQMPDMDGIETTKVIRGGQIAGLENIPIIALTAHAMKGDKEIFLAAGMDGYISKPIDAAELQRELYRILHTGKNKKPPHTKHDGTQE

SEQ ID NO: 17949 - protein, 431 aa, Desulfovibrio desulfuricans G20
MSTIVSVWAREILDSRGNPTVEVEVSLESGHSGRAAVPSGASTGSREALELRDGDKGRYLGKGVEKAVDNVMGEIAENIVGMDALRQVAVDNALIDLDGTDNKDRLGANAMLGVSLATARAAANFIGMPLYQYLGGINSKVLPVPMMNIINGGEHAPNNLDIQEFMIMPVGAPTFSEALRMGAEIFHNLKALLAADGHVTSVGDEGGFAPNLKSHDEAFRYIMRAIETAGYIPGSEVALAIDAAASEFYKDGKYHLKGENKVLSSSEMIDWLMDFTQRYPLISIEDGMAEGDWEGWQEMTVKMGDSVQIVGDDVFVTNPDILAQGIDEGVANSILIKLNQIGTLTETLDTVEMAKGAGYTTVISHRSGETEDHFIADLAVALNAGQIKTGSLCRSDRLAKYNQLLRIEEDLDDEGIYFGPYMASHFGLGEE

SEQ ID NO: 17950 - protein, 308 aa, Desulfovibrio desulfuricans G20
MTPSQARMLPVLALLVTMLLWSSSFIAMKVAVMELDPMLVMFGRMTAASLCFACCWRSLRRVTYRKGDWKPLLFMSLCEPCAYFVFEAYALRYTSASQAGMVVSTMPLFVAMAAFIFLRERLSRQVWAGFAVALCGVVWLTLAGEATEHASNPLLGNILECLAMASATGYVVTAKRLSSHYPPLFITAVQAFTGMVFFMPLAFRPGTALPETIPLLPALAVVYLGVAISLVAYGFYNYGVSKMPAGQASAFINLIPVLTLLMGQVFLDEVFTPQQYVAAALVLAGVVLSQTGSAADSGQQDTGRQNTV

SEQ ID NO: 17951 - protein, 1118 aa, Desulfovibrio desulfuricans G20
MHTRHAQQPAGHTAPRNFRHAHYHGLVPDLSQHRKNSACRPRSATAGTMKINLSISSIRLRVILVTLLVALVPVCTMTVAGLLVSMQQTASALSLQSRTALDKVSAAISRTTREAENVSRLVAGFNTLQGNPEPDSLRDMLFSRQHFWDKGFVEVFDAQGRILARSVPLRTANRQWMTPPEDPLVMQGILLHTASDIVRTPAGLAARAVAPVYRPSSLQAIGAVVTTFPLDRSMLQHIKEQTQADITLHYPDLRVESTLHDASKLPVTHDWDNTYDVMRNAEGPAQYEAQIAGSTYALSSIPLRNNAGVTQAVLSVALNRNMLRQYLHDAVQTLVLTLVLALVMAAGLGMWTAEKLTRPLHEMVQAIRRMAGGNLSVRVTEGGSDELGELAQSFNKMAGRLEEQRAHLLDALHEHEETTLRLANANKGLEYANRELLSAREEYRKIFEGSVQGIYQTTLEGRFIKANRALARMLGYGSAEELIGTVTDIGSQLYVNPADRQRLKSLLSTRSSLSDFETRFYRRDGSQVPVSISVRLVYDENDLPQYLEGALTDITERERRREAEQQREAAEAASKAKSEFLARMSHEVRTPLNAVVGMADLLWESDLTPDQRLYVDIFRKSGQTLLALLNDILDYSRLEAGRLTLERLPFSLRDTLTMTVNMHAAQAESRQLSLSLHVDETLPDNYCGDSLRLRQILGNLLSNSIKFTREGSVEVHVGPAPGQQELTAGEPVMVRICVRDTGIGIPENVQQTIFESFTQADSSITRQFGGTGLGLSICRMLTTMMGGRIWLESTQGQGTAVYVEMRLDLHDRSAAETQPEECAMPVQAAPLRILCVEDSANNRLLFRMYLKNTGHEVDEAENGEEGLRLFMLNSYDIIFMDLEMPVMDGYMATTAIRDYEQRHRMPAVPVVALTAHALEDFKQRCLAMGFTDYLTKPFRKQQLLAMLERNTGAPAPQYQADGAKRPAPEEHTAGQNAEKLAEQTAEEQAARKQTSGKQPPAAAQHTTEHMTDRQADKSATTVTTDRQAEQTSGQPPAGAAGDTATTGQSGEGTAAADAAQEVTMLENQRTGHTVIPQTGRQQTDRQQTEGTSDNDDTEPHREARKTQREPSQSPAHKT

SEQ ID NO: 17952 - protein, 661 aa, Desulfovibrio desulfuricans G20
MHTACHVVCRFSGIAAVITGQKGMSQTGMTIDNVLDSIQHPTDVAKLDADQLRQLADELRERIIGTVSQNGGHLAPSLGVVELTLALLSVFNPDKDKFVWDVGHQAYAWKLLTGRRDEFSTLRQYQGISGFPKMAESPYDHFGVGHSSTSISAAAGMAMARDLAGDDNDVIAIIGDGSMTAGLAFEGLNQAGHQGRRLLVILNDNEMSISKNVGALSLFLSRNLSSRWVRRMKRDVETWLKSVPGIGEEMLNYAKRSEHSLKSFFTPGMLFEAFRFNYVGPVDGHDVRNLAKVMQMARALDEPVLLHVLTKKGKGYEPAESNPTYFHGVGRFELETGAACKFVDSDSLPSYTEVFGSTLCSLAEKDERVIAITAAMPEGTGVGEFSRRFPDRFVDVGICEQHAVTFAAGLAAQGFRPVVAIYSTFLQRSYDQIVHDVCLQKLPVTFCLDRGGLVGEDGPTHHGAFDLSYLRHIPNLTIIAPKDEAELQQAMKTALAGEGPVAIRYPRGIGVGACLSADPGVLEHGRGELLKKGADVAVIAVGSRVHPALAVAEEIERSTGKAVSVFNARFVKPLDAEQLVALARSHDSLLLLEENTTTGGFSSGVLELLADHDCLAGVHVRRLGLPDDFVTHGTQKQLRKLTGIDRAAIRRTLLEMLGLQE

SEQ ID NO: 17953 - protein, 360 aa, Desulfovibrio desulfuricans G20
MTPAKDTVKKHTAAAATDSNAAEDSAAEVLTGDDETTYDIEIDQEEDDEDIDIDEGDVIDVSDTDLPAPLPPGNKPTRDSLHLYLREISRFPMLKPDEEFELARRVQLHNDSDAAFRLVSSHLRLVVKIAMDFQRRWMQNVLDLIQEGNVGLMRAVNKFDPDKGIKFSYYAAFWIKAYILKFIMDNWRLVKIGTTQAQRKLFYNLNKERQKLIAQGYDPDAAMLSERLDVTTEQVVEMEQRLDASDMSLDVQVGDENGSASRMDFLPALGPGIEDTLANNEIAAMVQERIRDIVPLLNDKELDILNSRLLSEDPVTLREIGEKYDITRERVRQIEARLLQKIRDHLFKEIKDFSSDWITR

SEQ ID NO: 17954 - protein, 841 aa, Desulfovibrio desulfuricans G20
MFFSRPKRFILPNRGGTRRFFTKSFCEEIAAVPDFRRALSDDTLLFFDGAMGTMLQGRGLPAGMSPEVFCLSNPAVLQGVHLDYARAGADVLTTNTFGGTRLKLPEGMNVVEFNREMARAAKAAAGQAGRTVFVAGSVGPTGHFVKPLGDLEFSELVDIFREQIRGLVQGGIDLVLAETHFDLAEVRAVVLAARAECNLPVGVSMTFEDGVSLTGTRPEVFVHTMQNMGVDLIATNCSAGPEQMAGVVAGLTAAGDIPVLVMPNAGLPELENGNTVFRLGPEEFAAQTADFVRAGVRCLGGCCGTTPDHIAALAREARSKPRPAVEKRRRSGIVLTTRAACLRIGHDQPCRIIGERINPTGKKELTAQLQAGDFTLAMQFAQQQIDAGAPLLDVNVGAPMVDEKVLLPQLISDLAAAHGVPLSIDSSDMDAVEASLAVYAGSPLVNSISGEPGRMERLGPLCRDYGAPFVLLPLKGRKLPVTAAERISIIDELLLQADDLGIPRRLVMVDVLALAVSSKAEAARHCFDTIRYCNEELGLPTTIGLSNISFGLPARELLNATFLAMAVGAGLTSCIAHPGNVRLREALAAAEVLMARDSNAERFIAGYSGWTSGGGSGGIIAGGGEEKKRPVSLEEAVIRGERDIILELVEDELARGAQPYALVNERLIPAITEVGDKYERKEYYLPQLLRSAETMQKAFGRLKPLLEEASGGETKPVIIMATVEGDIHDIGKNIVCLMLGNHGFDVVDLGKDVKAVDIVDAAVEHNAKLIGLSALMTTTMVRMEDTIQLLRERGLSIPVFVGGAVVTPAFAEAIGAAGYSRDAVEAVRIARGLVEAPARVQ

SEQ ID NO: 17955 - protein, 155 aa, Desulfovibrio desulfuricans G20
MLGRTNRQRRQEYLMNVLLVDDEVAFVEALARRLTRKNMTVHTVHNGPEALDFLRKNPSVDAVVLDVVMPGPDGLKVQEIIRKEFPLVEVIMLSGNSTTAMAVQGMKQGAFDYLSKPCSTEELIEKLHEAKRRRDTYCEELAALKAGDIVLRRGD

SEQ ID NO: 17956 - protein, 123 aa, Desulfovibrio desulfuricans G20
MSKHILIVDDSKTVRNLVAFIMKKEGFRVTMAEDGLDGLEKLYSAEETVDLIISDVNMPRMDGFTFIKTVREQDTYRDLPIVVLSTEGQEKDIQMGMSLGANLYMVKPAQPDKMVKNIKMLLG

SEQ ID NO: 17957 - protein, 839 aa, Desulfovibrio desulfuricans G20
MVGLVIVSHSAVLAEGVRELALQMTQGRVRIALAGGVDDAEHPIGTDPTRVMAALEEVQDGDGVLVLMDLGSALMSAETALDLLPPEVTANVRLSAAPLIEGCIAAAVQAAAGASLDDVQAEAESALAAKSAQLGSAVPDMAASSAGAAGAVPDAAAEHVRTLAVTVPNRLGLHARPASRIVGALAGLDADVRLAHGGHVVNARSLNQIATLAVRLGDSIEFRAAGADAQQALDALQALHAANFGDPREPEEGQADSHGAAPVRPAGAVAASAGYAAGPAVRFRAALPEVAEIQVDDQAAEKRVLQDALKQAADEIALVEKQTAGNVGGAESEIFGMHRMMLQDPELRDAALHELEERRCNAAAAWRRVIVSTAERYRGLDDDFMRARAADVLDVGARVLRIITGEAPQGPDIAEPSVLLAADLGPSDMARLDVTKVLGIVTEQGGATSHAAILARSMGIPAVAGAAAQIAGVTDGTPVGLDGNTGEVWAPADEHTVQRLRGLRRQWEESLRSEREKAAAPAVTRDGRAVRVHANIGSPADAHAAVRNGAEGVGLFRTEFLFLDRPSAPTEDEQTAAYTEAAQALDGRPVIIRTLDIGGDKPVPYLQQGQAAEANPFLGVRGIRFCLVHEDLFVTQLRALLRAAADHPVQIMFPMVAHPGELRAARTLLEKARAQLLAEGRPCGHDVPVGIMIEVPAAVALADQLAAEADFFSIGTNDLAQYVMAADRGNSAVAALSDALHPAVLRQIQQTVEAGHAAGIHVGMCGELAGAPLAVPLLAAMNLDSLSMSGPAVPRAKEIIRSIDAAALQPLVEQVLELPDAAAVRNLLQQAAGESADRA

SEQ ID NO: 17958 - protein, 114 aa, Desulfovibrio desulfuricans G20
MNIYVGNLSYQMSEDDLRGAFEEFGAVDKVRIITDHDTGRSKGFGFVEMAEDSEANAAIEALNGREMGGRSITVNEARPRPERSGGGGGGFRRSGGGGGYGNRGGQGGGYGRRY

SEQ ID NO: 17959 - protein, 417 aa, Desulfovibrio desulfuricans G20
MNMKQQENDGVNGYISPLPDAAWNSRFPRSLVLLGSTGSIGTSALRVVERQPELFRITALAGARNVRLLARQAAAYRPPHLAVINGNAADELASLLPAGYRPRIHTGQEGYEFLAALPEADCVLSAQVGAAGLRATVAAARAGKTIALANKESLVLAGGLIRRLCHETGASVLPVDSEHNAIFQALQGHDAAQMRRIILTASGGPFRGRDRTFLQSVTREQALNHPNWSMGAKISIDSATLMNKGLEVIEACHLYNAPLEKVEVVVHPQSIIHSLVEYNDGSQIAHMGTPDMRIAIAYCLGWPRVMHTGVEPLDLLSVGSLTFESPDISLFPCLELARKAYAGGNGLPVVLNAANEVAVDLFLQGAIAFLDIPRLIEAAMQAHDAAPHQNMYDEVESILTLDKTTRRVTADLAGARG

SEQ ID NO: 17960 - protein, 557 aa, Desulfovibrio desulfuricans G20
MTPGAAQSEVERLESAVEAVQNELTQARNRVPAELKDHAAIIDSHLLIAADPKLIKDAARRIQEQNITAEWALEQAVEAIALAFSSIEDDYIRERVQDVRVVADRISKRLMGASGCLKRPLQERMVLMAHDLAPADTMELPLDKIMSFATSEGGKTSHTGILARSMLIPAVVGVSNLEEHVNDGDLVIVDALRGFIIVDPNEDELADYTELKFQFEAYQKALHKECRLPAETVDGYRVEVVANIEMTEEVAQVLDSGGEGVGLYRTEYAYLSRPALPTEDQLYEEYSELASIMAPGKVIFRTLDVGADKMLTEQTLMREPNPALGLRAIRYCLRNIDVFKTQLRAILRASVHGNVALMFPMISGLQELRQAKVLLNEVRMELDRARQPYNPNMPVGIMIELPSAVLIADSLAQEVDFFSIGTNDLIQYSLGIDRGNKHVSYLYQPLHPAIVRSIKFVVDAAHREGIEVSVCGEVAADPYCIPILLGMQIDAISIAPQSIPGIKRIIRRTNMEECKTLLNEVLRTATVARINRVVKDTIFKQFPEELTFYSSLIDHDD

SEQ ID NO: 17961 - protein, 298 aa, Desulfovibrio desulfuricans G20
MSSCKSRPDSVKDGDIAKNAFGVSQQELNIQSVLQRIRYKLFVMSGKGGVGKSSVTVNTAAALAAKGFKVGILDVDIHGPSVPNLLGIKSGLEVDEKTRRICPAPYSENLFVVSMDSLLRDKDSAVLWRGPKKTAAIRQFVSDVEWGELDFLLIDSPPGTGDEHMTVLKTIPDALCVVVTTPQEVSLADVRKAINFLQYAQSNVLGIVENMSGLVCPHCGGEISLFKKGGGKALAERYGLPFLGAVPLDPATVVAADVGRPVVLLEEDSHAKKGFLDLAENIVHACENSLEVIASVHA

SEQ ID NO: 17962 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 17963 - protein, 589 aa, Desulfovibrio desulfuricans G20
MGNIKEIQQIKTLIAKGKVAGFLTFEEVNKALPAEVNTPEQIEEIIGIFDQLDIAIVDSEKDGKKISVSPAEADDEGGDGGLELTDEDDPADYSSRSTDPVRMYLREMGAVPLLDRDGEVNIAKKIETGEQDVLYALVEVPIAVEELISVGEDLKENRIKLKDVVKTIEEDDPSEDEMNQRQRVILLLDEIQSTFKKKRKVYQRLDECCTLERRVYGIQKEIIAYKEEIVSRLRDIKLEKTLIDRIIETVEDYVRQMHNCQRDLSAYILSTGKTQTEMRELFRQLDDREINPVVAADSLNLTVEELFSFKEMIMGKMEILNRLQEKCCHNVTDLEEVLWRIKRGNSHAMRAKQELIRSNLRLVVSIAKKYTNRGLQFLDLIQEGNIGLMKAVDKFEYQRGYKFSTYATWWIRQAITRAIADQARTIRIPVHMIETINKLIRTSRYLVQELGRDPTPEEIAERMDYPIDKVKKVLKIAKEPISLETPIGDEEDSSLGDFIEDKKAVAPAEEVVNTKLSEQIAAVLADLTPREEQVLRKRFGINEKSDHTLEEVGKLFNVTRERIRQIEAKALRKLRHPVRSQTLRSYYES

SEQ ID NO: 17964 - protein, 415 aa, Desulfovibrio desulfuricans G20
MHHFTYRDNELFVENVAVQELVATYGTPLYIYSKATFQRHFTAFDSAFGALPHLTCYSVKACSNMHILRFLGKMGAGMDIVSGGELFRALRAGIQPAKIVYSGVGKTRTEILQALEAGILMFNVESMGELEKISEVANQTGHTANVALRINPDVDPHTHPYISTGLKENKFGLDMEQSYAAYMRAMELPAITPMGIDCHIGSQLTSLSPFREAVEKILLFREKLCSAGLCIDYIDLGGGLGIPYDTEEPPHPQEFGKLLTDMLSGLGITLILEPGRVIAGNAGILVTKVQYTKKTATKEFVIVDAAMNDLIRPSLYQSHHHIAEVSPRGRAKHTVDVVGPICESGDFLARDRLMPAVEPRELLAVFSAGAYGFTMSSQYNSRPRAAEVLVRGDTAHLIRRRETYEDLIAPEETRS

SEQ ID NO: 17965 - protein, 647 aa, Desulfovibrio desulfuricans G20
MGKDVPLDLVGDPLRLGQVLTNLVSNAIKFTSSGEVIVSVKLVKGSGEKSRIRFAVKDSGIGISSSDLAKLFNPFSQADGSITRKYGGTGLGLSISNKLVQLMGGEMHVESEPGRGSIFSFELEFERHRTDSAAEHLSFTGLEGTRVLVADDNFTSRAILKEVLESLRFDVTLAESGEEAVDLVQKTAEPFKVVLLDWRMPGLDGLACARHIRQLDLPVRPTILIITAYGREEVLGEIPSEIIDGVLLKPVARSLLLNTILDALPEYSSRPEQESRIIQIDTAQLRQELADTSVLVVEDNKINRQIAKELLEGVGVRVTLAGDGLEALALVENYDFDLIFMDIQMPRMDGLEACRRIRQLQHKKQPPVVAMTAHALAGDRETSLRAGMNDHITKPIDPDELYAALANWIKRNHAPEGPDGIASSAEMELPQPDDAGDDADQPYSSRYADAPLLDFESGLKRIKGNRKLYNGLLREFADEFATYPQTIRQYIGQDMPDEARRVNHALRGVAGNIGAKRLYNISIEISDCLKEQLLECAPLVTELGSSMLMTLREIEHYLETLEAEHAPESGHVSSEGLAEQVEKLRALLKVHDTRALESVEGLKSVLQGSQPDIYDDLVRALNKFDFKAALKLLDRIHLQTEENGMVQ

SEQ ID NO: 17966 - protein, 172 aa, Desulfovibrio desulfuricans G20
MSLSDNGMKQKMQIIPPVPSGWKSWEALMELALEQAVLAQLHGEVPVGAVVVAPDGAVLGSGRNRPIATCDPTAHAEILAIRQACIHTGNYRLDDAVLVVTLEPCHMCTGAIIHARLAGVVYGASDKRAGAVDSCLDGLELPFHNHRPWYMSGVCEAECSRLLAEFFKEKRQ

SEQ ID NO: 17967 - protein, 550 aa, Desulfovibrio desulfuricans G20
MHSTPCRKRIWGSLHPFVEHGDIMGRSVANTQFLKELFQQNPYDEYHFFLQNESQCRQLVRWIQLALPDFAAEDRVRVTTRPQLPDALKTTAYHCFHLSDCIEDTASLARVRNLHGCNIFPITGPTHSLSYAWYPSAFLGHMWQGTCARDAVIATSRAAKCAVENIYASLRQAYGLDERYRAPAVALIPLGAHLPEKKDSCGTRDTARKELGLHGESRVVLITGRVSHYSKMDLLPVLRAFQRLFAAGHGPGSITLIVAGWTEQGDTTPDVLSGLASAMGLQLRFFHRPDDQVRDALYRAADIFLSPSDNVQESFGLTVLEAAAAGLPVIASDWNGYRDLVEHEKTGLLVPTLGPADTRAADTAARVVYDNHYHLQLAQQTAVDVPALTAALDLLLTFPEKAKTMGAAGRKRVLEQFTWHSVVRRHIALWDSLAATAVDEQALRAIRHPQQMDYAAIFAGHPTDRLHGGLMLQWSRAGQAVYRGADHPVIYAGVDDRIPRNALHRMLFAARSPVCAANIEAVLVQHCGMTAEDACFLLLWALKQDLLERV

SEQ ID NO: 17968 - protein, 341 aa, Desulfovibrio desulfuricans G20
MKKSSTPPDLILYTPARRPMLCLTFTPASRSRAGRLPQPEYGTRFLQFHAGISMIYLKLVLSALIWGGTFVAGRLAAAELGPFSCAFLRFAMASVCLTFLARLQEGGLPALTRKTLPGVLLLGLSGVFAYNAFFFLGLQTVAAGRAAVIIALNPVFIALFAALLLREPLSGLRLTGIALSVCGAITVISRADPLALFTHALSAGDMAIFGCVASWVTYSLAGRKVMADLSPLASVTWSCITGALMLFPFALSEGLPARMGSISLTTWTSITYLALLGTVAAFTWFYQGVKAIGASRAGVFINIVPVSAILLAALLLDEPVALSLLGGAVLVGCGVWLTNRH

SEQ ID NO: 17969 - protein, 601 aa, Desulfovibrio desulfuricans G20
  unsure (1)..(601): unsure at all Xaa locations
MMNNMLRYGVRGVQTRICLLTLVVSTLVALAFGSYEYVTALDAEYARLERFAVSQADRVARLLLVPVWNVDRQASMSIIDTEMDDERVHAVIVYDEGGSIFIGRQRGSGGVLVNTSRSIPRGEFIVTSRPLRQGSLRFATLQLYVTPEYVHRTMKDNVVAAVMHMLALELVLVLGILLVVRRSLIVPLSALTAWVRRESPLYDYGTRIPKQADDELGELVDSMNGMLSEIEKRDRMLNDHSKHLEKLVAERTQELEHARHTAEQASKAKGDFVASMSHELRTPMNAIIGMIEIALKTELTVKQREYLTIIRSSARSLLGVVNDILDISKIEAQKMELEHIPFSTQEMLEEVTDLFRERVGMKGVELVLDIEADVPAVLVGDPLRLKQVLVNLVTNAFKFTKQGEVRIRVAVGSRSQDVVQLEFSVRDTGLGIGEEARNRLFDTFSQAEGSTARLFGGSGLGLSIARELVRLMGGTITVASEPGKGSDFRFTGRFSLPVEAVEARHHRTGEAPRGRVLLVEDNESNRLVXXXXXXXXXXXXXXXXXXXXXXXXXXXXXXXXXXXXXXXXXXXXXXXXGCPVWTGWRCWKNCVRKSSPCPLCS

SEQ ID NO: 17970 - protein, 363 aa, Desulfovibrio desulfuricans G20
MCRPAGRFHTFFITFRRAARNSSAAFPPVFTRVRSGSFNRISGTFIMSYRMILAALAVVHIVWGGGFIVLKVVQEHLALEHILLGRVILASLLYLLLWKRIPSPCYRKGDWKVLLLLALCEPFLLFTFETLGLRYTSASQGGMIVACVPLTVALGAFAVYREKIGRRCLAGIVCAVCGVVVVSALATAGDQAPAPLLGNFFIFCAVLASTCYALSVKHLCARYHYMYLAGVQVFGATVLFVPGALMQPLPPAHVLFSPQVAGSLLYLGLGITFLVYFVINYALTRIKAAVVIQFANLIPVSTLVFAYIFLGERLSPTQYAGVGLVLAGVLLAGASGSGELNTGKTQGEAHAQKACAAEGAAGD

SEQ ID NO: 17971 - protein, 485 aa, Desulfovibrio desulfuricans G20
MGTILGKALTFDDVLLVPGYSEITPDQVDVSTMLTAQIKLNIPLISAAMDTVTESAMAISMARNGGVGVIHKNMTIDEQRLEIEKVKKSESGMIIDPVTIAPDYTVAQALQIMREYRVSGLPVVKDAELVGILTNRDVRFVTDLEGTRVHEVMTSEELVTVPVGTTLDEARHHLHEHRIEKLLVVDENNRLKGLITMKDIDKVQKYPQACKDDKGRLRVGAAIGVGGECEARAQALLGAGADFLVLDSAHGHSQNILKTVEMVKNTFPDCQLIAGNVASYEGAKALFKAGADTVKVGIGPGSICTTRIVAGVGVPQITAIMEAVRAAREFGRHIIADGGIKYSGDIVKALAVGANTVMLGSLLAGTEESPGETVLYQGRTYKIYRGMGSIDAMKDGSSDRYFQEKTKKLVPEGIVGRVPYRGHVGDTVFQLVGGLRSGMGYTGAATIAELDEKAQMVQISVAGLRESHVHDVIITKEAPNYNMDK

SEQ ID NO: 17972 - protein, 544 aa, Desulfovibrio desulfuricans G20
MRHRMAECALPRVLAIDDESSVRQSLAIFFEDCGYEVLEASDGYEGIETALRERPDVILVDLRMPGIDGIEVLRRLSSELPDTPAIAVSGVGVLEQALEAMRSGAWDFISKPVEDFEVLRKAVESARERADRKRRKRGYHQHLEREVAARTRELAMAKEEAELASRAKSQFLANMSHELRTPLNGIIGLTDLLLCAPAGGDHREYLEMVKQAGQELLTIVNNLLDMSSIEACRLVLRETPFSLRESVGEVKRILEIQARWKNLDFAVFFDDGIPDLFVGDAGRLKQILSNLLVNAIKYTDKGGVSLRVSSAPCTAGDTVRLCFYVQDTGVGIDPEKRETIFEPFVLGESFMTKKSGGAGLGLAISRELARKMGGDVHASRCAEGGSLFECIVELRKCEEEAPVAAEKTCPLARTSKPLRILLAEDDIINRKLAVFFFEKMGHAVRAVGTGIEVLQALAQEPFDLILMDIQMPDMDGVEATRAIRSAQGGRIRSDIPIIAMTAHAMKGDKERFLTAGMDGYVSKPVDFPALMQRIEALSQQQSKL

SEQ ID NO: 17973 - protein, 494 aa, Desulfovibrio desulfuricans G20
MSVITHSSSFPYTSHLILFRSILMFFSSLRARWGMPNGYRDVLGVGLPLVISMASSTVMQFTDRLFLSHYSVDAIAAALPAAIVNLLFLLFFTGVAGYANVFIAQYCGSAAPARVGAALWQAIHFSLMGGVLLALLWFVAPFMFSFAGHPAPVVRLEVIYFRVLTVGAVFMLLSSALSCFFSGRGLTRPVMVANIAAMIINIPLDYALIYGAWGLPELGIAGAGIATVAGWALTFFFLALATFTRRHDAMFGVLRNWRFERALFLRMMRYGLPSGVNYFFEIFAITFFVFVIGRLGRVELAATNIVFSIDSLAFLPMLGLNIAVSTMVGQAIGAGKPDAAGTAAMNTLHLALAWMLCIGVMFIIFPGVLLDMFRPQDVSVQEYVPIREAGVVLMRFVAFYCLFDALSLVFFGAVKGAGDTYFVMWAMVVGCACMVAVIVIMRLWFDAGLIALWVVLTCYAVALSLSALLRYRGGKWRSMKVVETVRRSPDAGPC

SEQ ID NO: 17974 - protein, 974 aa, Desulfovibrio desulfuricans G20
MDNAMENEVELLKKQIVELQRENEILKSGNVFTGSSREHDLLLRLFDSVKEYVYVADMETYELLYVNRTLEKDIGPCTGKKCYQFLQGLEEPCPFCTNDIIRNDPDSSHIWELYNPVLKRWYRCIDRAIPWVGNRLVRYELALDISDIRTAEEEMRRFRMALEASSDAVYLTDLRTGLFVDVNSRAYTQLGYTREEILGMRPEDINIAVSEHGLEPYLRNVLDGRDEGAVETYHRHKDGTLLPVEVGLRRLTTVSSELLVSVARDISERRDAQRDLATRLMYERVLSTCARELLSQFSSLNAMHTTLESLRETVDVCRVYIFENFINDDGQLCCRHRFEVCSEGVASQFGKSELECVPYLPAFSRWAQTLEQGKALSGLVDEFPEEEQPLLRAQDIQSILVLPLKVGGQWWGLIGFDDTRTMRRWTQLDEQLLMTAAEIIAAAIERNRAQKQLEKTSREAEAASRSKSEFLANMSHEIRTPLNAIIGLTELSLQEDLPEGVGENLRASLSSAEALLDIVNDILDLARVESGKLHLEEVEFSLPRFLGGVMRVMRHEAERKGLDFSMFLGRGLPRELMGDSGRLRQILVNLIGNAIKFTEEGGVNVAVECVSSSGGYIAGVQRVRFTVQDTGIGIPEHLHGIIFENFRQADGSITRKYGGTGLGLTISRQLVEMMGGSISLRSEAGKGSRFEVELPFKVAETHACAIEEGEDVPEMLPLRILLAEDNALNRRTMILALKKLGHQADAVQNGAEAVEKAALKRYDCIFMDVQMPVMDGLDATRAIRGFTPDTAATAPDVHIIALTAHALAGDKERFVQAGMSSYLSKPVRLEALKKHLVQLQAGTADGGGADAPLMPAYDAHPVMEPYTGGQREAYRFRRFLVTVAALRESLWSAFDRGNLLELHSLAHTLMHEADKMGAPRVCVMASRLESRVRDARPEEVRPIFLLLMDAINHLEHELLKIFPDARGAEGHHAG

SEQ ID NO: 17975 - protein, 907 aa, Desulfovibrio desulfuricans G20
MKSSPPAHTGLQRGRLLFLLPALALAAFIVCLISFVYISQRQTLEARQLRIMAQAERQASAISHLIGEIKLDAALLFRQQDFIDFSDSTPKSVQPGQTHPAGREAVRRLLTDFIASKALSGERLYNRIVLFSSTGRMLMDTSANKEPVHLPAGIARALASDVDYPLVFSLTPEIKELTFAVPLVTDSTRAGYAVVFCNTRAVTSFLESLWDLNDAYILLLQGQSGIALHRAEQISPEWIRQASRLEPGLLYTLSSEGEPEMLQHGAATSRETGIRHHVDNSPFDLLLVFSGPSIGGAVSPNVTLVAVALLAAIIAVSFYHVFRSTMRAREHKARAEAAAASEKRILQQNALLNAEIEERIKAEHALREAKELAEEADKAKGEFLANISHEFRTPMNAIIGMSEVILKTELSAPQRNHLTVLNKAAHSLLDLLNTILDFSRYESGKATLALSPFMLHAPFTQVHEMFLSAAAAKGLPLQLELAPDMPRAVEGDEGKIRQILVNLVSNALKFTDTGNITITCKAFPAPSGRADICFSVSDTGIGIEKEKHSAIFDSFTQADGSYTRTYGGTGLGLSICKLLADMMGGSITVRSAPRQGSTFTVCLPLKAVPEERVFPAAENPAVRPSKAASPLSVLVAEDNEFNREVIREILGLSGHSSTLVQNGEQALQALSTQDFDVVLLDIQMPVMDGVQTAQKIRSGACGNRNAGIPIIALTAHSMEGDKKRFLQAGMTEYLAKPVTPDHLNHVLGKYAPLPAAAPTGQSSAAHGFQPAAGKGSTAQADAEIPPPDLSLALSMLNGKQKVLTVMLGTFVRTMPDRIAALHDALQKKDIQALAEQGHALKSTLHSIGSLPGRSVAEQLENAGRSGNTEAAVTLAPRLIHVLEFMTEHLRRQIDSSQSHHQPSSGGR

SEQ ID NO: 17976 - protein, 327 aa, Desulfovibrio desulfuricans G20
MEAPQKNLALDLVRVTEAAALASARWLGKGNQDAGDQAAVDAMRLCFNSLNISGVVVIGEGEKDNAPMLFNGEKVGAGNGPALDVAVDPVEGTKLLAYGRPNAISVIGVAPAGTMYNPGPSFYMQKLVVPGAAKNVVDLDAPVAENLHKIAKALDKDVDDLVVFVLDKPRHASLIEQVRAAGARIQLHTDGDVSGALMAVDPRSEVDVMMGTGGTPEGVLAACAIKGIGGEMFARLDPQSYVEKEAILEAGIDLREIHTVDTLVRSDEVFFSATGISGGTFLKGVQYTGTGAVTHSMVIRGRTGTLRYIESINNWDKLMKISSVKYD

SEQ ID NO: 17977 - protein, 299 aa, Desulfovibrio desulfuricans G20
  unsure (1)..(299): unsure at all Xaa locations
MTEQQTPAADDSPRAGNGQTAFAPFARKMRLHGLSEGLIRLFNSYYDEIVARHTGYLHEAELLPVSAADLPHVDSLESFREAGRQAARQAVVIKLNGGLGTSMGMTHAKSLIPVFGEMRFLDIIMQQALLQQKECGGPLPLALMNSFSTHEETLQALADIREEDCRQCTPVCFVXXXXXXXXXXXXXXXXXXXXXXXXXXXXXXXXXXXXXXXXXXXXXXXXXXXXXXXXXXXXXXXTRRPVCFAGHFRRAGRSALPRAPLCLCLQLRQSGCRAGYAHSRIHGRQRVALYHGGGSAHSF

SEQ ID NO: 17978 - protein, 267 aa, Desulfovibrio desulfuricans G20
MLDDLLSHGRRYAFVSNSDNLGAVLDMRILGYMAGNELPFIMEVAPRTASDKKGGHLAQHRDGGLILRELAQCPPDETDAFQDIRRYGLFNTNNLWVDLHALKKRIEKEGLLRLPVILNPKTVNPRDKSSEPVWQVETAMGAGISMFTGAQAVVVNRDRFIPVKKCSDLLAVMSDCFALNQGTVSFSPECRYPTPQVTLDDRYYDHYDKLLQRIPYGPPSLKECSSLTIKGDVTFGRNVVIRGDTTITTGGTAHIPDNTELEGEVIL

SEQ ID NO: 17979 - protein, 268 aa, Gossypium raimondii
GAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNMPTSVSKSSSIKNPSLDFNYNEFQFKSNTDSLEEPNCTASSGMTTDEEQQEQLHKQQQYDPSNGQDLNLELSIGIVSADSSRVSSANSAESKPKVDNNNFQFLEQAMVAKAVCLCWQLGFGTSEICRNCQNSNS

SEQ ID NO: 17980 - protein, 265 aa, Gossypium herbaceum
TKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNSPTSVSKSSSIKNPSLDFNYNEFQFKSNTDSLEEPNCTASSGMTTDEEQQEQLHKKQQYGPSNGQDINLELSIGIVSADSSRVSSANSAESKPKVDNNNFQFLEQAMVAKAVCLCWQLGFGTSEICRNCQNSNS

SEQ ID NO: 17981 - protein, 263 aa, Gossypioides kirkii
AWTKEEDQRLIDYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNTPTSVSKSSSIKNPNFNYNEFQFKSNTDSLEEPNCTASSGMTTDEEQQEQLHKKQQHDPCNGQDLNLELSIGIVSADSSRVSSANSAESKPKLDNNNFQFLEQAMVAKAVCLCWQLGFRTSEICRNCQNS

SEQ ID NO: 17982 - protein, 157 aa, Gossypium hirsutum
NKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKIINHDVRTEQTSSSEQIVPHKAWETVQMEEEEVVKGSDEIENSEFSIDVDEFFD

SEQ ID NO: 17983 - protein, 157 aa, Gossypium hirsutum
NKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKMINHDVRTEQTSSSEQIVPHKAWETVQMEEEEVVKGSDEIENSEFSIDVDEFFD

SEQ ID NO: 17984 - protein, 157 aa, Gossypium raimondii
NKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKMINHDVRTEQTSSLEQIVPYKAWETVQMEEEEVVKGSDEIENSEFSIDVDEFFD

SEQ ID NO: 17985 - protein, 157 aa, Gossypioides kirkii
NKGSWTAEEDRRLAKYIEIHGAKRWKTIAIRSGLNRCGKSCRLRWLNYLRPNIKRGNISDEEEDLIIRLHKLLGNRWSLIAGRLPGRTDNEIKNYWNSRLSKKIINHDVRTEQTSSSEQFVPHKAWETFQMEEEEVVKGSGEIENSELSIDVEDFFD

SEQ ID NO: 17986 - protein, 181 aa, Gossypioides kirkii
NKGAWTAEEDRKLAEVIAVHGAKRWKTIPTIAGLNRCGKSCRLRWMNYLRPNIKRGNISDQEEDLILRLHKLLGNRWSLIAGRLPGRTDNEIKNYWNSHLSKKVNQKEKHSGASAGQVCKFAQKRLVENAKEQVREENTSTGVEESNISFDVNDFFDFSNVDTRNFEWVNRFLEVDEGFKF

SEQ ID NO: 17987 - protein, 226 aa, Gossypium raimondii
MRKPCCDKQGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVACKLRVFSTENDDGVSDAASYLEDETPPTGISNLDLDLTIAFPSSPIKNIIEESQKKTASIVTNNKEEQYTVPTLLLFR

SEQ ID NO: 17988 - protein, 209 aa, Gossypium herbaceum
KQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVARKLRVCSTDNDDGVSDAASYLEDATPPTGISNLDLDLTIAFPSSPIKNIIEESQQKIASIVTNDEEEEYTVPTLLLFR

SEQ ID NO: 17989 - protein, 218 aa, Gossypioides kirkii
QGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVVPLNPTTTNSMDVACKLRGCSTDNDDGVSDAASYLEDETPPTGISNLDLDLTIAFPSSPIKNIIKESQQKIASIVTNDEEEQYTAPTLLLFR

SEQ ID NO: 17990 - protein, 356 aa, Leptosphaeria maculans
MDIVLEVCDTFLFDPLYATLLPAQASSFTANATANATLSSIRQEPTAYALPHASWQYEPATKYFSIEPSKYAYMSSWPRDDWRRQALTLYLITWLFGVCVYYLFAGLSYLLVFDKATFNHPRYLKHQIKLEMKQANIAFPIMAIFTVPWFLAEVRGYSKLYDTTEKGPGRWYDYLQIPFFIAFTDLCIYWIHRGLHHPMVYKHIHKPHHKWIMPTPFASHAFHPIDGYAQGLPYYIFPFLFPLSKIASVAFFVFVNIWTVLIHDGEYAHNSPIINGAACHTMHHLYFNYNYGQFTTLWDRLGGSYRKPNDELFKRELKMCQDEWNKQAKAVDMMVEQVEGENDRSYQGEPESKKVQ

SEQ ID NO: 17991 - protein, 48 aa, Glomerella acutata
VIYEETRGVLKSFLEGVIRDAVTYTEHAKRKTVTSLDVVYALKRQGRT

SEQ ID NO: 17992 - protein, 50 aa, Glomerella cingulata
AIRRLARRGGVKRISAVIYEETRGVLKSFLEGVIRDAVTYTEHAKRKKVT

SEQ ID NO: 17993 - protein, 64 aa, Glomerella acutata
AIRRLARRGGVKRISAVIYEETRGVLKSFLEGVIRDAVTYTEHAKRKTVTSLDVVYALKRQGRT

SEQ ID NO: 17994 - protein, 60 aa, Colletotrichum sp.
AIRRLARRGGVKRISAVIYEETRGVLKSFLEGVIRDAVTYTEHAKRKTVTSLDVVYALKR

SEQ ID NO: 17995 - protein, 507 aa, Plasmodium yoelii yoelii
MANGWDAEKIFGSTISYTYDDIICMPGYIDFPLSEIDLSNNLTKDISLKTPIISSPMDTVTEHKMAISMALCGGLGIIHNNMSIENQIEEVKKVKRFENGFIFDPYTFSPEHTVADVLCVKNKVGYKSYPITSDGKVGSKLVGIITGIDYLYLTNPDVKIKEIMTTELVTGKYPISLSDANKVLCDEKKSILPIVNDNYELIALVCRNDMHKNRIFPHASKRENKQLIVGASISTRESDLEKVNKLAQNMIDIICIDSSQGNSIYQIDMIKKIKSAYPDMPIIAGNVVTSNQAKNLIDAGADVLRIGMGSGSICTTQDVCAVGRAQGTAVYHVSNYAHTRNIKTIADGGIKNSGNIVKALSLGADFVMLGNLLAATEESCSEYYFENNVRLKMYRGMGSMEAMYNKQFNSKSRYLVEDKIFGTVYDPTNDIKISQGVSASLVDKGSVLNLIPHLVKAVKHGFQSIGIRNIQQLHSKLYSGDLKFDIRSINSIKEGKVSDNLIFNTKK

SEQ ID NO: 17996 - protein, 284 aa, Plasmodium yoelii yoelii
MYNSNGNNNAGNIAGTTYGAVYNQGSYGYSNEKEQGNKDYYNSKTQATPPNGGLYDEHSLNEYTSTKIRHGFIKKVYSILSLQLLITFGVSTLAVLYKPFNTFLIANHVLFLVLGMAFSLPIMLALICFPNIARKYPQNYFILLAITIGITSIVALTSAILNSEVFFYSLGTTSVVVIGLTIFAFQTKWDFTGWYVYVFISFLILLFLGIIGIFIRSKIFNLIFAGVNALVLSVSIIVDTQLIIGGKHKKFEFTVDDYIFATLSLYMDIVDLFLSIASIFSNAK

SEQ ID NO: 17997 - protein, 341 aa, Plasmodium yoelii yoelii
MKENDKNEYGTFPITINENYGDQIGDLKYKNFYKSLYEKIKLALLFITWYTLNVFYNVDNKKILNITKLPWTASCAQLFIGWIFISAYWGTGYKKIPKIFSYELFLKNIIIQSICHNMVHFGAVIAMSSTSVSFTHVVKACEPVFTAILSIVLLKHYLKFSKYVCLIIIVGGVICASVKEIHFTMFAFVCALISNLGSSLRSIYAKKMMINKSSIGDNLTGSNIYAFITIFSALISLPVVLIVEGKQAYKFITEFETTQSKHTLNEIYIRLILSGVWYYLNNEVAFMCLERVNQITHAVANSLKRIVIIVSSIIIFKTQITFLGAAGSAVTIIGAFLYSII

SEQ ID NO: 17998 - protein, 371 aa, Plasmodium yoelii yoelii
MRMQSVSNILKSSLKKSVQINGKNKIIQGGICTNFPRCFSTTNNLKTKKMNMFTAINSAMHTVFENDPKSILLGEDVAFGGVFRCSLDLRNKYGDKRVFNTPLCEQGIIGFAIGLAENGYTTIAEIQFGDYIFPAFDQIINDVAKYRYRSGSSFDVGKLTIRCTWGAVGHGGLYHSQSPEAFFAHASGIKIIVPSDAYKAKGLLLSAIKDPNPCLFFEPKILYRASVNEVPIEQYELEIGKADVVKEGSDLTIVTWGSLVHKMKNAADILLKKHNIDCEVIDLQTIVPWDIETVQKSVEKTGRLLITHEAQLTNGFGAEIAAKIQERCFYNLNSPIKRVCGYDTPFPHVYEPFYIPDEHKVIYEVKKMMKE

SEQ ID NO: 17999 - protein, 301 aa, Plasmodium yoelii yoelii
MSGDFKTSFAADFLMGGVSAAISKTVVAPIERVKMLIQTQDSIPEIKSGQVERYSGLINCFKRVSQEQGVTSLWRGNLANVIRYFPTQAFNFAFKDYFKNIFPRYDQNTEFAKFFCVNVLSGATAGAISLLIVYPLDFARTRLASDIGKGKDRQFNGLFDCLKKIYKQTGILSLYSGFGISVTGIIVYRGSYFGLYDSAKAILFNNDKNTNIILKWSVAQSVTILAGLISYPFDTVRRRMMMMSGRKAKEDIQYKNTIDCWIKILKHEGIRGFFKGAWANVIRGAGGALVLVFYDELQRLL

SEQ ID NO: 18000 - protein, 141 aa, Plasmodium yoelii yoelii
MLIIICYNFIFSLAGSGKTKKAPLSRASRAGLQFPVGRVHRMLKTRISSDGRVGSTAAVYAAAILEYLTAEVLELAGNATKDLKVKRITPRHLQLAIRGDEELDTLIKATIAGGGVIPHIHKALMNKVPVPPTQTKKPKKN

SEQ ID NO: 18001 - protein, 1431 aa, Plasmodium yoelii yoelii
MVLELLKSNYERNDEHYYNEKVENNTSKHKKKKKKKHILVEESEKDDRNLDSENNEEAYNTYELIKVRPNNIYEEKYDFSFQNLYKKGFREKNNMRESYRNSKDIIQYGTNENDIFTEDMFENDNFDDDSFVEDDTMDYKTYNSYTKPEFNLFSKYSTESIKKNIMNNKKDSKIEDFYKKYKNNSEYSKQANEHDANIIQFLNNNKKSVDYGKMKDINFKKNDSHNYSESNKYKNEFLKNYNYDNNYTNNYERDNNQDSNSYYYADENETKDNNEEDDDTGDTYDDNEEDEDNRDDNDDYSQYNQCEVESDTNQIRSNEKRYNESIKHINESNLKINKESLLKRETYNKRDNIFYIKKDIIPYKKEHNNNIFSLYDSSKNNNEHNNNYETKFVNYKHDGEKKDEQWLTNVKKERNEEFLKKYMYENALKKTYSSKDLQFNRLGDEKNILHHDINVDNKMFRLDKLERSNTQDIRNKTNKYNMFRHDTTELSKIRYKDEINDYSEYANKCLEGNIYDEDDSYILKRKELGHKELKVIDNPILNINHDDKKKTNIKSFLDKIKYRKNNELFLKNEHEKYADIQETNKKDKIKMKFADILHTKNFSNFFHRGKSSIAKSLSPNNNKKNANFNNEAFNLNILEKKDKNSDYKQYNIKCFPYDHENTSFHPSVREETKYYENKESRKRLDYNCDEDNYIENSIRRYNENNIDYNSINIEKTINLREDIKYNEFLNKPDKINSEKFSNNFSDNKQKSLKNDDSNKIRDTNKLYYHNNSDNALRSNYIKKESTEKIYDILESNSNNMRKFINKMDYYTKKYEQNLYKNDEDIYTKENKFPDSRQAFYNKSNSPMKVKDETKDSQYEDYNRIKYKLKMKQEKQDEEDETDINIDKKLSRKMIENNKLKEQNESNDELIVTPFYIKSKIDKVLKNSEIFERSARATFKQFDVKNKNFLHFSEIESLIQKLCYNLELPPVDKKILSIVYKDYDSSKNNCMNYMDFRQMYWDLLKQIKKKYYPTKNFKIKRNCIISRKKLQGYDYSSIYNYLSFKKILGCGAFGEVHLVEDNICKLYKVVKILKKKKMKNIKVNEEINVLIYLDHPNIIKIFDVYESVNCTYIVMELCEGGELMSKIKKPEIFSEIYIKNIMFQILCAIAYMHSNNIAHKDLKPENILFKTDGYDTLKIIDFGLAELINKSEGISKTAAGTVLYMAPEVFKKKFTIKCDIWSAGVIMYFLFTKSLPFTGNTYEEVKKNIFNNEPDYQSLKLKMSKPALHLLKLMLEKDYSKRPMAAVLLHHPWFQGYFDPIDILPSTLSNIKSYMKNSNIRNVIVNIMAHELCVINNHVKYINDIFLKTDTNHNGSLSHREIYNVLSNAGVKKWDINRMIQALDINDKGCITYTEFIAGCYRWKNIESTFLKAAFNKIDKGERLTCMRFKFM

SEQ ID NO: 18002 - protein, 309 aa, Plasmodium yoelii yoelii
MVIRDSVSRIYVGNLPSHVTSRDVENEFRKFGTILKCDVKKTVSGAAFAFIEFEDARDAADAIKEKDGCDFGGNKLRVEVPFNARDNGKYNSRGRGMMGRGSKSRRGRYVVEVSGLPLSGSWQDLKDHLREAGECGHADVFKNGTGEVSFFHKEDMLEAIEKFNGSTFRSHEGEKAKITIRQKKTSWRRDDGYGRYSDRNRSYSSRSYSRSDKRSYSRSRSYSSRSYSRSRSRSRSRSRSRSRTSSSRSRSMDRRRDAYEKKRSYSRSSSYQDRRRNNRSISKSGSRSVSRSGSRSASRSSSWSHKRRH

SEQ ID NO: 18003 - protein, 467 aa, Plasmodium yoelii yoelii
MNETSKEYDSLYDGIYDYDVNDELINTVNNDNLVNLNPQNKSAYPSSNQNKDPNDDQTKIFPKNEKQDEPNLFTDGLSSPNLNDIDIYKNNKTVENIQKEELDIICKDEAPTDKGSLLISKDSINCNPCNSDNNKNSDNNNNNSDNNNNNSDNNDNEKKLTNNSGHTNDDLNIIKNNHDKIEDIYEKEINNDTKNIEETQDDKLNDLYQSSKELGSSPHELGFIIVEDKCEQIKKNERLLSKESKSGCDTEKKNKNAYEQEQIDKNNINSNKQNECNTNDNKNSSCQNDEKKETTNNNAPQENDCNRSTFECNICFDDVRDPVVTRCGHLFCWFCLSAWIKKNIDCPVCKAEVTKENVIPLYGRGKNSSDHKYSNNEEPRPTPKRKENVRRNNNYSNNLGLRASFGVWANPFSFGMSYTNMSDQSHFYDNRNDNRRPQMDAFHVEAASSCFFFLGFFLSLYILFYSS

SEQ ID NO: 18004 - protein, 856 aa, Plasmodium yoelii yoelii
MREANMEIQEITERIDNIIATANDDLHNKRKDEFVDDEYAYSLCDNYKSKKTRNVVIYLLNKDINILYFEDEYKNIILINFLRWCQLNNLNVKKYHDIFLKHEIFLLIQNNETYLNFFLKPIINNDRLLWDINTDIFKNFNLQFDLVSQGQNETNDSISTIYNNTHLVYDQSLKLKLNEFIVNSSDDDSYFSSDDTNSVYAYSDKCESLDSDVILDDYNKNKNLGLKSISMNDYNNVDTKNEVNITTPLSDKLNTIGNGIANNSEEGNKNISSNFFIDSNNIQNSNFSAMKKNANKIKKGILSSMSNININHLINTIVNKDDDEIFDNIYNETNDTNELVNKFVSTFENKNEQVKSLYKKINSMEKIIKHLINEIIKRDIIISREQSIETKNEHIEDNRISNKNIVDNTEYYGINKIMENNNTKVGQKNNSSRNYNSSDEDYEMCSNVANNPESNDENKNENNNNDKTKNTDDYYFDSYNHTSIHRTMILDKVRTNSYYEFITKNKEIFKDKIVLDIGCGSSIISLFCSDYAKIVVGIDNAEKILNKARKIIKTNNAKNIYLFQGKLEDHDIYIDQEEKNIYYINKSENIENYKKTNNITSELKILKFDIIISEWMGYFLFYECMINTIIYAKYMYLKKDGYIFPNIVHLYLVGYNDSDYINNNFLIWDKPMYNKNFSQLKPNSKQFVQTAKIVNADKNNISTDIVKFATINMYTFDKNDHLYVNSNFKIKINPDKIVTTLCFYFDCEFHLFSYNESMKSSYETNNINKSSNVVTLSTSILSEKTHWKQTLLHIYFPNYNIANIVANNNNDDNYLSGNIYISQTSKKSRNVNILLDIDKNKNINVNESCNCYYSID

SEQ ID NO: 18005 - protein, 291 aa, Plasmodium yoelii yoelii
MKKKGVHILLSNKKLIVWNINPDDESGEIGTAKKSLTGHSQAISDVSISSDGLFALSGSWDNSIRLWDLSLGETIRSFIGHTSDVFSVSFSPDNRQIVSASRDKTIKLWNTLAQCKYTITEQQHTDWITCVRFSPSPKQAIIVSCGWDKLVKVWNLKNCDLNKNLEAHTGVLNTVTISPDGSLCASGGKDGVAKLWDVNEGKHLYSLETGCTINSLCFSPCDYWLCAATDRFIRIWNLESKLIIAEIYPVKQYKVGLPWCTSITWSANGQFLFCGSTDGNVYVYEIKKHAI

SEQ ID NO: 18006 - protein, 1404 aa, Plasmodium yoelii yoelii
MSNVFEGIEKRVVIKLRKNLFMNGNINSLLDISRDLWEEKLNLIGCNIVSEIKEDINAPLNERSRVYLLSESSLYIYNDMIYIKTCGKTKVLFFIPFLVDILIYKWKKYFVLEKSNLYNESFIQNDTKLEEILDFIQKYFEYSFFTHMNYKNVTKDGYYEQEYPHKSVEDEKVFFKFFLKSMEFVNTPLPMNRNHYIFFSQVNKDATIDTSALNVFPNFCSEMHLFGVKKYSMPNQFHSEYLTYDSLNVLSNHSLNIPKSEESEKIEVCSSSVYSFDSVENSSKYTNNTANTNVTVNVSKDIDNNSINTLYNTVDDQTVILTCSDDKNNNLNESDSKLLLAGENSKNMDKDNTQVFNDDNNNNYIFISNPKVQETYSNTNSVRSNEKSTCSSSSTYTSLLQNDLKEFHPKNNAMDTIEDDGRLLVEEEDISYISNEETIDAKVEQIDNLSNKSILDNNLDKNYDQNEPSLSSFTVACSDLINKNANDEKSEDNTSKNIRIKKIEENLYECINTQNNDKFIYNEFYFVPCGFSCNVANKNNYLCVHYSPEDCVSYVSVELSCVLKSENFMNFIKKQLNFYKAQYLYIINYLYDFNENTLAQKSGDNNKDSNNRFLSVLLSSQNNKNIKSINEVVEVNKKLDNNIIINNGQYYSLCAKKEQSVGFLKIQYCVYEQKNFIRNEEKIKSYNSICFEQSNKNAQNVNTLKSTTLSLQDVNSMYEYSYNFCKENNIHIIDIEDDLNSIDNSSNSNHNNYPISNSSDNVDDIHMKKDSNILKESYETEKRTDPISSFLLDEQKAQNEKSRSSSETNSNITDDDNNEFVLEKKYKKEMMNYYRNNRVEISTFNKMLNENIDTSVFCINLQKILLQYIRFKRNLPRVTPFYAVKSNDDEVVLKFLYGLNCSFDCASIGEINKLITLLPDISTDRIIYANTIKSPASLKYAKEKNINLCTFDNIDELKKICKYHPTCSLLLRINIDFKNYKSYMSSKYGANEFEWEKILKFGKENNMNIIGVSFHVGSNTKNIFDFCQAIKLSREVFDISHRLGFKFRILNMGGGYPEELEYDFAKKNEKKHYCTLNEEELKKYIMSFLNEKSVIKKNYNFYNFEKIALAINMSIDHYFKDMKDQLKIISEPGRYMVASSSTLAAKVIGKRCPTFSPIRLSNLKNAEDNNDDNEVKNEQVANNDNDQQNGDGNIQNKDQGNCTGTIPDVELRTEKESKHLPSEVCTNGEIQTSNVCNTNTDNENVSSFGTTTNGKTVIPGSAFNHEDNSKLGNITNIKKKVVNIHDNRYNYYSYYITDSIYGCFSGIIFDEYSRPPIYIINNNKMDSKKMILDSPLYLTNIFGQSCDGLDMITSSTYLPECNINDWIIYEYTGAYTFVSSSNFNGFQPCKKIYIFPRNKFPFSV

SEQ ID NO: 18007 - protein, 846 aa, Plasmodium yoelii yoelii
MKTLDISDNQNEHNLQCNANIELNSFMVSDHSKQYDKDYAMILNILRDKYGVYSTTNYNDKFYMNSHNKSEKKYKREIYTYEENNRKEQTNEISKEDKNKDDFYFIRTNIIYKSLNTIKKYNIPFVIINEGNHYLTQIGLVYFLLSKENSIMCPEYAKVYQNMNLPLCNYWINSSHNSYLGRKQIFSASSIEQYIYILIDGCRCVEFDCYYFNKNIVVYHGLYGYKLTSSILFCDTLIACKMFGFSTSPYPIILSLEIHCKDKHKNLIAKILIYILGNQLYIPKTKDEINNITPNNCRNKFLVKYKHFDNNYTSSFYSIFEGLKNVMYDELGYFSDIINEQEDIDVDEPKEYQIIEKKNEKYNKISIENQNMEPEDRVNNYIEQNNSKNTSYKNNQVQKTNKNSDQNNLCGNENVSQRDRHEVDSNYSSSSSSNCLYENNTIHKTQIDEKYRKNDNCSNNNSGFNNSSVPNNTNTSDSITNCGKNMSETAHMSKEEYKKKQDNEKYKNNILNKCSCLKGYVFRNFQENRTYNEICSISENKFIKLIKKNEDDVIKYNQKTLTRVYPSGTRLASTNFNPLIFWSAGIQFVALNYQYNGLSMLLNKGRFLENGGKHSGYILKPELLRFNKKHDYNVLSLNIQILSLHQINLLFSIKNKYQEKKLKKELFKMDMIQRIQTHKKISNKRKKFKYLQKLEREKKSPLLSDIQSDDSKKKKKISNETLLKKFKDNDNDVNYIHKKFANIEKEYEDMLTEYKSFLLCSTLSHSSSFNSCSSVTTTSNNTTDSNKKVSSKSKKKNFYQAFLELKKANNLFFYLYVTISIHGYNEQKCYFKTEIAKVNFYDINYW

SEQ ID NO: 18008 - protein, 1025 aa, Plasmodium yoelii yoelii
MKESNNEEASALLIENEKIEHNENRVGINNDDVVDNSSSNISDVNIKEFNSKNSNANYKPISNGNTIEYNVNDNNYLNNEDNNNNNQCNNSSLNTMIDEFTINNKELYNSNSDLYLDYKNQKTTNVNLNDESFLKNVNNMRTFERGIVYLSEEEYIYMSNKIKLLGFRFIEIPCAKSKTEKRNTFNAISKRHLNEIKNLHCSLSNNIYDAGKRKSKKSYDKFYSKDEFSSSTATKENVNDIQKYNDNNNSTVSSIDHIVGSKTNNSLGGKRKFPSNSLSNVNVKSNDNINYGQNNRSNSMLKKGETWDGDRNNNKLNNSSNISNSNKGKGKLSKCTSIGSGKRQMSSSFTGGKEALKKKAKNNNNYYEDNNTIDEYEEHRKTYRKRIYKCQNAWKNNCFKIIHKLKKKEMSCWFLKPVNPELDGIPNYFNIIKNPMDFETIENKLLNDKYNSPFQWQQDVRQIFYNAFTYHKVKNCVWNDAYKLAKEFDRLLNEENKMKNIHIEYARSTDSVLFDMKKYNEILINKNNNYDSDSSTYSSDYSSDDGDVSSDYVTSNNNKKGNIHNKMNRNNNSKKRGSAAIGGMNNSSLSINNLSSGSQMFSSQNKKGLSGDLIDHKINKSSKMGSNDIDSMRNIRGDGKFMGNKKDKSFAKYDNNNLNSNNSNTSCYNNSNSIDFEPPSMGTIPEPPGIQKIGINDKGLNNYQVNLLFKNLRRLAPNQRRAALEIIQDDLGILAENHMFDRFFTFDTELLSIEKQKRIFLYINHMGRINLEQYKASRISSENIPNCNNNISRGKMMMPMKNGNNNKNYMNSNNNDNSGGHFDKRRGNRYVSSSSNSSDTSSSNSSDSSTFSTSSDDSESDSESDMDFDSYDNKKKKLKGQFSNDKKKEITNKFFDNKRKSLPQYKPVDEKKKSLEIREDVMGIHADFLGSMDTPKNQKKNQKKNHKNSGTAWPEWKGQVIQQAILTQRQTNVPINKKELIAEVHIYRYIFFLCVYTFLSQKRCFTQFYFFSFFFNVKDIKKNVK

SEQ ID NO: 18009 - protein, 1011 aa, Plasmodium yoelii yoelii
MNSINISNFPGGEGNLCGRFKNILPRFFKTLSYKNLSPYKNLEEFNEPNICYKQIDNFKQCLYKNNGKEQVTKSDEKRKTYKNKSKLLFINSSNSPHFNLKKNWNKNQGLNYLFNRKLMYTQENYKNNVYLKIFNSEKKNYSIHSLGDNSTNDDNTISNKNINNCYENYNGNNLDKYFDKINKYINVDMYKNKYGEEIYNEIVNLYVKRDIPKNYEQKYFFKNVKKSIIFDIDKYNDEEFEKKIQEEFTNNGVLINTINKKYYNKKNIKRMITILNYLPLLKIINTPMDLKNLKKKYLPLLSHELKIFHFFLVNITAGHFSPSLSLLELQLSLLYIFNPPLDEIIYDIGHQTYIHKILTGRKLLFLSLRQKNGISGFLNIFESSYDKFGAGHSSTALSAIQGIYEGDWQLLCSNKKENDILKIENNCDRSYSPNKFYISIIGDGGLTGGMALEALNYISFLNSKVLIIYNDNRQVSLPTNGKCISGNKPIGAISDHLYDFVKKNGQIIGNENLNKVNHYNSKENNINESDKKENNINESDKKENNINESGKKENIFTNLNYNYIGPIDGNNIEQVIKILEDIKNKGIQKSTILHILTNKSSDFINSKSPINIMHSIKKNEIFKFNIEELDSCHDENNNEQSKKEDNEKKDTILNDNEIFSNETYINVYTKEMLKYLEKNKNIIFISPAMLGGSGLLDISQKYPKNVYDVGISEQHAVTFSASMSLNKNLNVHLHIYSTFMQRAYDQIIHDLNLQKIPLNIIINRSGLVGEDGATHQGIYDLSYLGVLNNSTIISPSNDISLKKALKYCSINRKEGSIYIRLPKVNTLSNSYMENYLNINIMKDLEEIEKIGDPEYARNNYFGKSQIIQMSREKKGKKLVCIFNMGSMLYNIVNAIKEIEKDEKFSENFSFSIIDMIFLNPMDKNIIDYVINKNKHNYLITYEDNTLGGFYTHFNNYLIEKNYILKNKLYVKNIYFPNHPIEHATYKEQQEFVKMDQHNLIYRIKNYLTNNF

SEQ ID NO: 18010 - protein, 179 aa, Plasmodium yoelii yoelii
MKLLLGITGSIAAIKTGEIVEKLKKECENKNIPIEIKYVATNVAFEKFLNNFKEKVLLDKDEWLWKDRGDDILHIELRKWADLFVICPLDANTLAYISNGACPNLIVNTSNFFIFTKWNHFTYYSVNISIFSHLFQTSICRCWNFKKKILVFPCMNTYMFNHPITKHQLDIILSWGIKV

SEQ ID NO: 18011 - protein, 335 aa, Plasmodium yoelii yoelii
MTTNQINKRIYIPKFYADANIHKPKEYYDYDNLELQWNKPNRYEILKKVGRGKYSEVFNGYDTEYNRLCAIKVLKPVKKKKIKREIKILQNLHGGPNIIKLLDIVKDPVTKTPSLIFEYINNIDFKTLYPKFTDKDIRYYIYQILKALDYCHSQGIMHRDVKPHNIMIDHENKQIRLIDWGLAEFYHPGQEYNVRVASRYYKGPELLIDLQLYDYSLDIWSLGCMLAGMIFKKEPFFCGHDNYDQLVKIAKVLGTEDLHAYLKKYNIKLKPHYLSILGEYERKPWSHFLNQSNMDIAKDEVIDLIDKMLIYDHAKRIAPKEAMEHPYFKDVREES

SEQ ID NO: 18012 - protein, 133 aa, Plasmodium yoelii yoelii
MSAKGKTGRKKAVKGTSNSAKAGLQFPVGRIGRYLKKGKYAKRVGAGAPVYLAAVLEYLCAEILELAGNAARDNKKSRITPRHIQLAVRNDEELNKFLAGVTFASGGVLPNIHNVLLPKKSQLKSGATANQDY

SEQ ID NO: 18013 - protein, 383 aa, Plasmodium yoelii yoelii
MKNEKNFIKCDEDGTEKDMENGNKEYFNSYAYIHIHEDMIKDEIRTRSYYDAIRKNEHLIKDKIVLDVGCGTGILSFFAAKHGAKHVYSIEKSNIIYTALNIRDANNLTDKITFIKGLAENITLPVEKVDIIISEWMGYCLLYENMLDTVLFCRDKWLKPGGIIFPDKAYMYIAGIEDSLYREEKFDYWKHCYGFNFTPVVPILKEEVVIDYVDKNYVVTNSSCILKLDLNTCTKEDLSFVSPFTITMTRRDYIHALVIWFDISFSACHTDVSFTTGPYGPNTHWKQIVLYTNHIITGEKNETLKGMFALKKNEQNNRYIDMKLHYNFSGAHSKVESTQFFNITAQLGQLMYSIYLLGDKNCELIIEMNNIFFHIIFPIIIPN

SEQ ID NO: 18014 - protein, 105 aa, Plasmodium yoelii yoelii
  unsure (1)..(105): unsure at all Xaa locations
MDGMKKFKDMKMGGKEVKXRRKNXKDPHAPKRSLSAYMFFAKEKRAEIITRDPSLSKDVATVGKMIGEAWNKLDEREKAPYEKKAQEDKIRYEKEKMEYAKNKMK

SEQ ID NO: 18015 - protein, 813 aa, Plasmodium yoelii yoelii
MLNSINSDKPESGDKTDMENNVNDREVNDNNITNNKLNNNENFDNVSKNGFINDKINVEKTNSDSSNNDISIKRISENENDQGGGENDKCGSEHDKCGGENDKCGSENDQGGDYNLRNKDIQHILDNSLECDNIVIKNVEDSNNKDIEKSEILENNQIQKNITHYTNNNNDNNKFCKGEDAIEIENINTSYKNIYSESIDGSHKDEFNYKEISCIKIDNSDFNKREQYDEKNGSISPIKMNNNSDKSDDLNNYNLENNELDKNADNFDEKKEKKNSQNYLNSSNDKNNCNNDNFECNNDNFEYNNGNDLNTVCTNASGILDINNKTNDSDIIMKNNDNAEIGVNKIKEMEEEKNKCSNNENDTMSNKENINEIKNGEDDNIVFNNNNSLQIFKEKENKIKENYEIASEDNAETDAKLYECKEVSEKETNEKNINNDNGDVDKVIDDEGNGNTQKEEKELNNCSFEENKKYEDGCEDGCEDGREDGREDGCEKPNVENDNYDDINKKRKHISSCDESRKDRKLSSQKEHEEIENEDINKYGNDIDSNAINTTFCKNNNTNIIKYVNSVEEIISSNSINGDSKNNSNSSALNLKIENDEANGANDTNGAYFSDMKISNAEENHNYNDLILKQENKDSLNKEEKNDINNIGNNCKDECSNKSQDSNIEKNDGINDGINDSEHNLENLKDCDEKSRDNDDEYEDEQNENMSDNNYSDDEKTNLDNCNTNDKKKNKNDSETLLPIANISRIMKRILPAKAKVAKESKDIIREYVTEFIQFLTSEASDRCLNEKRKTINGEDILFSMEKLGTYFFCGVL

SEQ ID NO: 18016 - protein, 109 aa, Plasmodium yoelii yoelii
  unsure (1)..(109): unsure at all Xaa locations
MGSTYEAIKKFVHKIIDENKIAVFSKTECPYCVKAISILKGYNPNVYVEQIEKXPNMADIQSYFKELTGKSSVPRIFINKEFVGGCDDLVKENETGKLQERLKSIGMIN

SEQ ID NO: 18017 - protein, 493 aa, Plasmodium yoelii yoelii
MRTLINLRTLPLLFFILILFLHNSKGVHKKKAYIINYNRSSNGKIKTIAKNNKKGRVKSRRKWRVKYAIENDLTSVISQNKPINVGIFGSTGSIGTNTLSIIRECNKIEKKFNVEALYVNKNVEGIYEQAKEFLPKYVCIHDPSKYEELKKLLENIKNYNPIILIGNEGMKQICSSNEIDKIVIGIDSFQGLYSTIYAIKNNKTIALANKESIVSAGFFLKKLLTVHKNSTIIPVDSEHNAIFQCLNNNILLKSKCLQENYSKINQINKIFLCSSGGPFQNLSIDELKNVSSEKALKHPKWNMGKKISIDSATMMNKGLEVIEAHFLFDIDYNDIEIIVHKECIMHSCVEFLDKSVISQMYYPDMRVQIIYALTWPNRINTNLKSLNFEEISPLTFYKPSLKHFPCINLAYHAGRKSNFFPTVLNASNEVVNNLFLNNKIKYFDIPAIISQVLESFNPQQISENPEDLMKQILEIHNWSKQKAVDIYNTKITS

SEQ ID NO: 18018 - protein, 315 aa, Plasmodium yoelii yoelii
MAKLSKAQKKQIYMDKLSSLIQQYNKILIVHVDNVGSDQMASVRQSLRGKATILMGKNTRIRTALKKNLQAVPQIEKLLPLVKLNMGFVFCKDDLSEVRSIILQNKSPAPARLGVIAPIDVFIPPGPTGMDPSHTSFFQSLGISTKIVKGQIEIQENVHLIKQGEKVTASSATLLQKFNMKPFSYGVDVRTVYDDGVIYDANVLDITEEDILKKFSKGVANVAALSRSVGIITEASYPHVFVEAFKNIVSLVIDTDYTFPLMKKIKDMVENPQAYAAAPVAASSAQKDEPKKEAAKKEEEEEEEEDGFMGFGMFD

SEQ ID NO: 18019 - protein, 235 aa, Plasmodium yoelii yoelii
MVNSPSKKRALNTLEDKNENKNMVNKKNNTVDTVDDIEEGNDNVVGENKNEVLKKDKRKKKEKKNKDIENEDDDDGNDEDALKKFSVDTSENDDEEGREDDEEDEDDDDDDEDDDEDDDDEDDDDDDDDDDDDDDDDDDDDDDDEEDDDDEDDDDDDDDDDDGDDDDDDDDDDEDFEDMDDDDDDDDDDDDDDEDDDEDEDDEDDEDEDDEEDDDDSKKEGGSNAKKDSEDEGFD

SEQ ID NO: 18020 - protein, 133 aa, Plasmodium yoelii yoelii
MLSKMEDNKIEKLKTEENKKLYILHKNYREGLFENKLRFETELEFVQSLSNIEYIKYLYDNKYFNDKKFLNYLKYLNYWRSKPYIFYIKIPICLYVLEILNDKNVDEYFSASNSFNTFIYYLKLHWLYFNYQT

SEQ ID NO: 18021 - protein, 528 aa, Plasmodium yoelii yoelii
MLKKKKECSGIEREEKNTKKKNNASECLSMQNDDSTYIDSNEEDKNGEYINENTKENIKNNDNINKKSDEKEYNASETKKTNNNEKNKNNSNNKTSKINDEKGKDEKINIKEAIIKNVRVPDNYIIKHLIGRGSYGYVYLAYDKNTEKNVAIKKVNRMFEDLIDCKRILREITILNRLKSDYIIRLYDLIIPEDLLKFDELYIVLEIADSDLKKLFKTPIFLTEEHIKTILYNLLLGEKFIHESGIIHRDLKPANCLLNQDCSVKVCDFGLARTINSEKDVNIVNDLEENEEPGPHNKNLKKQLTSHVVTRWYRAPELILLQENYTKSIDIWSTGCIFAELLNMLQSHINDPTNRFPLFPGSSCFPLSPDRNSKKVHEKSNRDQLNIIFNIIGTPTEDDLKNIKKPEVIKYIKLFPHRKPINLKQKYPSISDDGINLLESMLKFNPNKRITIDQALDHPYLKDVRKKNLENFSTKKIILPFDDWMILSETQLRYIFLKEVQSFHPELVIPSAFTIHESNFYNNEEPSS

SEQ ID NO: 18022 - protein, 117 aa, Plasmodium yoelii yoelii
EFSCDEGKKEASNFAQEAYQKATDIAENELPSTHPIRLGLALNYSVFFYEILNQPHQACEMAKRAFDDAITEFDNVSEDSYKDSTLIMQLLRDNLTLWTSDLQGDQTEEKSKDEGLE

SEQ ID NO: 18023 - protein, 556 aa, Plasmodium yoelii yoelii
MDIEKGEADEVKDEGKDEGKNEVKNEVKDEVKDEVKDETSKSEKKDDQGVSSKGEKVLNYIEKKIDEQLNIVKNNNNVIMALESKIESNIGHSNSISQIEGHAIFDGKNTKSETVEKINKSGNEDNNFVDTWKMMNYFILENETENQEKVIKEKMCDNKQIEKEKDLKKKKKKMVINVIDKYFVQIPLKSIMNVFRNIQKEMEKNFTIITLFIEKKLLNLNEKMQLTKINTIIEKLNALKKKVINSKKMVSQVIKKLHSRLEYIYEEEDIQVESLKRNFNFDSYDKRINWLIDGYFCRYGFFNTSEIFCKRYQLDNYSDAYIYKEYLLILKELRMYNIQPGLEWCQKYKSQLKKMNSNIESELHLQHVIYLIFENKYFEALEYLKRFVIFGNDKFISDDVKFVITYINVNYTDIEKLNQFNKKRWKKILKIFKLAYSDIIGTMNKPLLEFLLKSGISVIKTDQCEKNKKKSTNCPTCIDELKPVISQIPNIPKTKSFLLCPYTNQIMDENNPPFTTPTGHVFSEKAISMFLKPDDLFICPHTHERYRLDDFSRLFI

SEQ ID NO: 18024 - protein, 503 aa, Plasmodium yoelii yoelii
MEKKYHKLFKGKRVEFPLATGAATYVSLTYDEKKNPYLLCWSYMHQEEPEFTVPLKGCRIINNITEIGSCIHIITANEEYQFQCRSKEEFNEMSHFFNMLDFPILGFKNVYVLNKKIGKGSFSNVYIGTNILYGNRVVVKEVDKSKVKESNVYTEIEVLRKIMHKYIIKLISAYEQEGYVYLVLEYLKGGELFEYINNNGPYSEQLAKKAMKRVLIALEALHSNGVVHRDLKMENLMLENVNDPSSLKIIDFGLASFLNSPSMSMRCGSPGYVAPEILRYSSYGTKVDIFSLGVILYNILCGYPPFRGNNVKEIFKKNMRCHISFNTKHWLTKSENVKEIILWMCSKNPDDRCTAIQALGHPWFLPKLTDMHMSSNMNELANKDVIMQKTAEYDMCKKCKHYPIENNEKGNNNNDIIQNNKNCINDYKKYHDTMLKIDEKYSENTAKAKPSIDSISLNKKKYDMHYITNSNEYETVVLHGGYTSQNYGPSSAPHNNLKKKIMN

SEQ ID NO: 18025 - protein, 455 aa, Plasmodium yoelii yoelii
MKHLFLFTNPISGGNQASIFTEFSANEIVYQKPENCHLHIYNLLEGEPGKNQGFLKLKSVIDNIERESKNYVNNDNIKSDIENEQNVNLNNFENKQVPKKASQKKNNICNIENKNNFVKLCHDDIPVYVIIAGGDGTLNWVLKEAELYDIDTSIFAISMIPFGTGNDFANAFGWKKPIGMLKPKDTFGILNNVISQIFKSEILYHDYWNIEVVLNEDGYFDKINSKTKQKETLTKNNDNVKNLKFHMTNYFSIGIDSRIGRGFERHRKNNAILNKMVYAIEGFKKISSKKNVPINLVIDKMTTGDNFEDIIFTTNKKENAPLLNKAMSIVCVNIPSYSSGNDIWKHTDKLGLKLPKDYNAENKKKYNDLRRSQQQVGDGILEFVTYRSGVDLGLEFAFKGRACRIHQGEGPWKIDFKENITGVYFQVDGEFFYMTKPKYLSVKYYKKLNVLKNNS

SEQ ID NO: 18026 - protein, 538 aa, Plasmodium yoelii yoelii
MNQLCVERSPNISTATAYIKGKPKKSIERIKKKKDSNKSIKSQHKFEGSKISNKNNELKDVKSKDPKNYESYLNKNTKHKDILLKSKRSDNFKFSRRGFILSFTGNLEDFYNLSEEPLGKGTYGCVYKATDKLLKIQRAVKVVSKKKLKNIPRFRQEIDIMKNLDHPNVIKLLETFEDEEQIYLIMDLCTGGELFDKIIKKGSFVEMYASFIMKQIFSVLNYLHIRNICHRDIKPENFLFYDKSTESLIKIIDFGLAAYFNDIDYEMKTKAGTPYYVAPQVLTGCYDYKCDLWSAGVLFYIILCGYPPFYGESDHEILSMVKKGKYNFKGKEWNNISDEAKDLIKRCLTIDSGKRINASEALKHPWFKKKKGSFNLDVKMDIHVLENFKNYALLLKLQKLAMTIIAQQSNDYDLQQLKAVFLYLDEDGKGNITKNQLKKGLENSGLKLPQNFDVLLDQIDSDGSGRIDYTEFLAAALDRKHLSKKLIYCAFRVFDVDNDGEITTAELAHVTFFVILFLHHVNDFPRLENCTKYIDLNA

SEQ ID NO: 18027 - protein, 294 aa, Plasmodium yoelii yoelii
MAYVKVVKNKAYFKRYQVKYRRRREGKTDYRARKALILQDKNKYNAQKLRFIVRKTNSQIICQIASAHIEGDKILSEAKSKELVRYGIPVGLKNYAAAYATGLLCARRFLKHLNLDSQFIGVEKVTAESVADDGDKEEEGERKPIKAFLDVGITRTTTGNRVFAALKGACDGGINIPHGNNRFPGSKNEFNPEQLRKNILGIHVAEYMASMKEEDMDKYKAHFNDYLKHKIDENNIENMYLTAHEKIRKNPEKKPKKATKKFIAKHQKPTKLNAKLRKQRVKEKVSEYILSLFM

SEQ ID NO: 18028 - protein, 535 aa, Plasmodium yoelii yoelii
MGCNQSKSANDVRGNKVNNVNSKKKNNKREDINDGEEIAINPGMYVRKKEGKIGESYFKVRKLGSGAYGEVLLCKEKNGHSEKAIKVIKKSQFDKGRYNDDNKNIEKFHEEIYNEISLLKSLDHPNIIKLFDVFEDKKYFYLVTEFYEGGELFEQIINRHKFDECDAANIMKQILSGICYLHKHNIVHRDIKPENILLENKNSLLNIKIVDFGLSSFFSKDYKLRDRLGTAYYIAPEVLKKKYNEKCDVWSCGVIMYILLCGYPPFGGQNDQDIIKKVEKGKYYFDFNDWKNISDEAKELIKLMLTYDYNKRCTAEEALNSRWIKKYANNINKSDQKTLCGALSNMRKFEGSQKLAQAAILFIGSKLTTLEERKELTDIFKKLDKNGDGQLDKKELIEGYNVLRNFKNELGELKNVEEEVDNILKEVDFDKNGYIEYSEFISVCMDKQILFSEERLRRAFNLFDTDKSGKITKEELANVIIRGFYFFTYSLFGLTSVSEKTWNDVLGEADQNKDNMIDFDEFVSMMHKICDNKPF

SEQ ID NO: 18029 - protein, 455 aa, Plasmodium yoelii yoelii
MLVKYWLASYFMIINPKNYEHIFYSRGNPTVEVDLETTLGIFRAAVPSGASTGIYEALELRDNDKSRYLGKGVQQAIKNINEIIAPKLIGLDCREQKKIDNMMVQELDGSKTEWGWSKSKLGANAILAISMAICRAGAAANKTSLYKYVAQLAGKNTEKMILPVPCLNVINGGSHAGNKLSFQEFMIVPVGAPSFKEAMRYGAEVYHTLKSEIKKKYGIDATNVGDEGGFAPNILNAHEALDLLVASIKKAGYENKVKIAMDVAASEFYNSETKTYDLDFKTPNNDKSLVKTGQELVDLYIELVKKYPIISIEDPFDQDDWENYAKLTEAIGKDVQIVGDDLLVTNPTRIEKALEKKACNALLLKVNQIGSITEAIEACLLSQKNNWGVMVSHRSGETEDVFIADLVVALRTGQIKTGAPCRSERNAKYNQLFRIEESLGANGSFAGDKFRLQLN

SEQ ID NO: 18030 - protein, 67 aa, Plasmodium yoelii yoelii
TGLLTIHFWAPTFKWSISLANIVDINRDPKLLSLPQQFAIGLTGLLFSRFAYAIKPRNINLITSKAI

SEQ ID NO: 18031 - protein, 176 aa, Plasmodium yoelii yoelii
MKNDKIKLVSFEGDEFIVDKYTASMSTVIFNILEVMTSEEDTIPLPNIKTQILKKIIEYMEYHIHNPPDEIPKPLITSNLQDVIISLKKIKIITSIVVSVWDYDFVNTDKETLYELIEASNYLDIKPLLDLTCGKIASMMKDKTTEEIRAEFDIVNDFTREEEMQIREENKWCGDI

SEQ ID NO: 18032 - protein, 434 aa, Plasmodium yoelii yoelii
MSSRNKNNSLIIPFLIGTLASFGVNYYIYNRETVDEFIKQHADKILSKFKKYYKRKQSEDDNIPNDCPGIDSENAGKSKACDGCPNRKICNDPELKKQKENEKNQIFNEIQENLKNVKYKILILSGKGGVGKSTIASQLAFALSHLNYDVGLLDIDICGPSIPVLTKTIDNDVNYSINGWIPIYKNNLSIMSVGYLLPNFDDPVIWRGPKKNGLIKQFLCDVYWKNLDFLIIDTPPGTSDEHLTICSYLKDNLDGCLIVTTPHILSIYDVKKEIEFCKKTNIPILGVIENMFQSIFVSNYTVQNMCSDMNVDYAGKVTFDQNLIDACQQGVGCCDINKNSTSSKEIFSICKFLAQKLYTKYSNQIDHIEDQQLITDQTVINNIDQNDKNNLAHEKSENNQLDEIQNIMTENENLSKVQVLEKIISDIVSIVDEK

SEQ ID NO: 18033 - protein, 716 aa, Plasmodium yoelii yoelii
MKELYCIIFGPPVLGLLFSVIECISISRIHIGASDDKLDKVENGQAKIEKMKEIASYISEGANSFLSKEYQYLIVFMILFSGLLSWFINYYTAISFAIGCITSIICGYIGMKIAVYANVRTTSETWKSLDKGFKVTLNAGTVMGFSLVSLSIISLGALIFAYKAQFQFSDDPALYKAIAGFGLGGSSIALFSRVGGGIYTKAADVGADLSGKNEYGIPEDDIRNPACIADNVGDNVGDMAGMGADLFGSLAESLCASLVIGSSVLSLPENMKSFDINYCFMFPLFFSSASIISSMLTFFLVTKIVRVTGKEGVERTLKYLLFISTIFQSLTIFVVGQYCLPPVLVYDVLKQIPNWKIIVPALVGLWSGLIIGFTTEFYTSYSFRPVQEIANTQKISAATGIIYGLSLGYKSTFIPIICLSGALGISYVFCEVYGVALAAVGMLSTLCICLTIDAYGPISDNAGGIAEMAGLPSEVREKTDILDAAGNTTAAIGKGFAIGSAALVAFALFGAYASSAKVRHVNILNPWVIIGLLIGSMLPYLFSALTMKSVAIAANSVLNECLEQFPLILANKQKPDYDKCIKISTDASLRQMILPGLISVTFPLIIGMLMGKYATAGLLIGIILSGIQLAFSSTNSGGAWDNAKKYIESGALGTDHCKGSNAHKNSVIGDTVGDPLKDTSGPSINILIKLSAITSLVFAGLISNHFTSKTGGPIWL

SEQ ID NO: 18034 - protein, 505 aa, Plasmodium yoelii yoelii
MNILRMDILSRGGTQEIEHRDGFFNTSFQYVLSACLASFIFGYQVSVLNTIKSYIVVEFEWCSTKTDTSCEDSILKSSFLLASVFIGAVLGSGFSGYLVKFGRRFSLMVIYIFFIFVSILTAISHHFHTILYARLLSGFGIGLITVSVPMYISEMTHKDKKGAYGVLHQLFITFGIFVAVLLGLFLGDGPKINGKSIELSNFEMFWWRFMFFLPTIISLLGIILLIAFYKEETPYFLYENGNIEGSKNILKKIYGPSDVDDALRAIKDAIDQNKAAKESSLSLLSALKIPAYRNVIILGCILSGFQQFTGINVLVANSNELYKEFLDKNLITILSVIMTAVNFLMTFPAIYIIEKIGRKTLLLGGCIGVICAFLPTVIARQVWGPTKIVNGLSIAGTFLMIISFAVSYGPVLWIYLHEMYPSEIKDSAASLASLINWVCAIIVVFPSDIIIKKSPSILFMFFSVMCIIAFLFIMFFIKETKGGEIGTSPYISLEERQKHIGKSKV

SEQ ID NO: 18035 - protein, 996 aa, Plasmodium yoelii yoelii
MINIGNTIKKTHLPKKEKKRVSEILINKNKIENNIFCRNNKLEKDHLEIKNKNKNIEYHFQPVKTNKTYSINKNVISNKINNEDLYIKKEPHATFHMNTDIREKDINNILMHSNVTTTNFNNDPITSTSQKCASKKRICKHIPINKKLNSNKEKFKSYPNNEQDDLGNFPQLLRKFEKIKRKSQIEHSNVHKNVGKSKKNEIYKTNNNYESLQNNPNRKIFQNCRNHYIGGIFNKIEKLKRDNYPIMAPSNFKNNKLAQNMRSNSNKYFKHELNNKNKLTKNHSLKYEYTKKWNNEENKNNDNVQGDEFEKEENNCSNKDGYSRYKKKKKKKNEKYDQKLTLSNIILKKKWINSDTIERIISKNSQPDELVKKNSNENIPKNDTPIVEVSQWKVFPDVISQLDAPIIEPSNFEVPLHRPTKCATSSNFSYKLSEKFSETLSTRLEWDENEILKNGETKKTKSELDGVEEHDYTIRNTSITSAYKQYKIIIIKSNNIEVGNYIIIKNIGKGTFGKVCLGMHTYTYEIVAIKILNKKKLLRIISYDKILREIKIHKKIDHNHICRFYEVHENKNNIYMILEYLGNGDLLTYICKNSNINENIGKRILYQLISAIEYLHKINIVHRDLKPENILLDHNNNIKLIDFGLSTIYSKNNFLQTSCGSPFYTPPEILLGKKYNPELTDVWSLGIILFLLLNKKLPFNHNDINKLFQQIIKGLMQFEPHVSINAKNLIQNMLNVNCKNRYNLNQIKNHIWFSNYNAKKDVYLNCHQVCNLMDCNTCIYIHIIKSSKYYNNFLINRVNKIYNLDKTMILKELKNKEQNCIKTTYYLLLNKMVKILSKTNYLYSHYIFIKKETDSEILISNDDARSITLKDNHEPSNFKPFNNFDNLGTFNFLDLSKIQNHALKEYHTNLMKNRNNGISGDIEQINTHNLLLLQPKEKYNIFQINKTQVPTNCYHYKQTKCRLIKNQRKDLLFSDKRVSINNPKKCIINPDKVIKE

SEQ ID NO: 18036 - protein, 126 aa, Plasmodium yoelii yoelii
MYIYYILSSVLYMSSYIFYEFVSKQIDKMATKTQKKVIKKQNKKKKKDPLAPKRALSAYMFYVKDKRLEIIQERPELAKEVAQVGKLIGEAWGQLTPAQKAPYEKKAELDKVRYSKEIEEYRKTKE

SEQ ID NO: 18037 - protein, 186 aa, Plasmodium yoelii yoelii
MHALIPIFIIVLLVCIIKSNLGQMPQPALKMDIEKMRQNNFLSRFTQLKTNSGFISPLAFLNRRYFYNKPQIGFFNEVPEQINPLDSFLKQDTSDLFGMMKNQIPFLILQLGLGFLINMFFSGYLVAKIPFPLTYKFKSTLQMGMDIELLDMKFVSSLSWYFLVMFCSSGLISIVDYFFLQGNYIK

SEQ ID NO: 18038 - protein, 107 aa, Plasmodium yoelii yoelii
MINNIRSEDKEIFKIHKWSAVAAWSWDISVDNCAICRNHIMDLCIECQAKLNDHINDKDKKIDKENCTVAWGVCNHAFHLHCISRWIKARQVCPLDNTTWEFQKATT

SEQ ID NO: 18039 - protein, 613 aa, Plasmodium yoelii yoelii
  unsure (1)..(613): unsure at all Xaa locations
MHIHKLKAKIKKKHQEKYLTKKKIQKKLFLNESEFRRLCIFKGIYPKDYKDIPLKFRNKFYKNKVYYTRNDYKKLSNEKIIQDFRKIKTSLKRYKKYKITLEDNERCKNIIKNFPKYKLDHIIKERFPILVYAVEQLNDALTAIIAYSFLPSNENIGIKNNLINQSIILRNHVKGYYLQAEILQKKITWLIPHIFTPYFDKSIDFKIITNFIEYYVTLLRFILYKLYRLDGMSYPPKEYKDLKNEKLNHLSFDKNYITKELSNELETKESTEDNIIEENEKKTKNGKTENCEKNDQENEKKTKNDKTKNCEKNDQKNDQKNDQKNDQKNDQKNEMKQIEHDIIXNDNTKSVKNLFKNHIFYIHSNMPFDVLSIIILSCGGTICWNSLYSPYKYDDKSITHEILEVSEENKNTQDSNKINNINEYTYKRSFIQPQYIFDCLNSNMILSCEDYNINKTLPVHLSPFIDDDNYKDLVKKDEYTINKMLSEDPQYNKSIQKNKTNSENKXNNYNDNENDMSEDEYNNAIRQKLRNDALNNQMEAENENNYNPQNDLKQENDLLNVQKINNQENIKRNKLALSKKKRKLYNKIEQAENRQKLTIEKFIKKSKNKKKQK

SEQ ID NO: 18040 - protein, 279 aa, Plasmodium yoelii yoelii
  unsure (1)..(279): unsure at all Xaa locations
MESKHYQRCWGLSWRQSATTGALAVRLNPALGIRNFFGGNYMNPWVALKADTYRQYGRFSYGLLLRGIFTKRTFRVASYGFFKLFLPIFQLLHRFATHSAAMDLSWRTDIGAGIALTHGWGLVVTXKAKIGNNVTLFHGVTLGSRDRISRNGERLSEYPILEDEVWVGPHAIIIGGVTIGRGSRIAGGAFVMESVPPYSVVAGNPCHESRSGLKRRFKPARDTLTKKAHDHQSGEHMPAARGLIAMGMAASPGFFWAGGGGSNMSWKGRRWFGRFSRQT

SEQ ID NO: 18041 - protein, 343 aa, Plasmodium yoelii yoelii
  unsure (1)..(343): unsure at all Xaa locations
MRLLVPSSRTPQHIPTGDPMSKIVDILAREILDSRGNPTVQAEVILDSGAEGSAMVPSGASTGAREAIELRDGDASRYGGKGVLKAVENVRGPIKAALTGMDAADQAAIDRRLIELDGSDNKGVLGANAILAVSLATAHAAAADAKKPLYAYLNRSGEFLLPVPMMNIINGGAHADNSIDMQEFMILPVGAPSFREALRYGAEVFHALKKVLSDRGLATGVGDEXGFAPNLPSNEAAIGIILEAIEKAGYRPGEDICLGLDVASSEFYSDGIYTLASEGRRFTSEEFSDHLAAWVDKYPIVSIEDGMAENXWHGWGIHTDRLGRRIQLVGDDLASKPGSPIRS

SEQ ID NO: 18042 - protein, 786 aa, Plasmodium yoelii yoelii
MCAKKTPFCYSKEVYRKYGESLSMYAVNKIKPQLKEEDNLKKTKALIDAWYKYSFYTNWMNKFLHYLDRYYVEYNSSLCLKAYTKNIFKLTLFDETRECIKSIIYNIYDSMRNSDDKDNEKLFRDIVFLYNELDKESAEKMYESDIEKKILENVEIYYNKEGNNWIQKMSFHDYIILIENSIEKEYEKNKSLEINDETCEKVTNIIVRILIYEKLNLLLDNKENIYNLLKNNDLNSLRRTYILFSYFSEAIDGLKKIIGEYIKTEGNKLKEKYISLSISINNNMDTPTYESNKNSNIAEQKNEYILCEYIHDLIKLHDYYHSMFNFSFVNISNNEIDTHFKECLKDYFESFVEHEDEYFSTVKLLVLYADNILTIKNDKTDLQMPYVKNNEEGEHIKHEMKTVINTDELKNDYRKVGNKEGYIGNLNDVRKTRKENDDADSTCDTNIIETDYLIKKMSDIVAIFNYISNKESFFEYYRIYLANRLINNMYISINVEKKFIESLYFLCGSQYTSKLGGMIQNIINNKILNEKFYNYISRNNSNGGISLPNLTNFDENYENNFFSVKILNKGYWPALEKTSMKLSENFNKYILSYTEYYKTENKNKKLEWIYELSEVVFKYFINNRSYYLYCNLISAEIFLLFNKYKYINYDIIKEELQIDLKTFKDNMHSSLYYHKIIYSDDDNINWDTSNFYVNENFSYTNQNVYIKKTTTLLSKEHEKTKDDKTMAIEAAIVRIMKTHKRLFYDQIFDNVKKVLSTFAPSNQVIIRMLINICIYINGKEYFLIFF

SEQ ID NO: 18043 - protein, 637 aa, Plasmodium yoelii yoelii
MGIMKRLPLQILLLIFFWCHINGKNGGDIWALNALSIDDKQNRDDKPNGDTKSSGNETERGEVKEHTVVSGNKKEQTNTVTSKPVEIEVEKNGKINDNKNGTPGNSNTVNSNTANSNTANSNTANSNSANSNSANSNSANSNSANSNSANSNPVNSNNSVSANNPNDKSTPSPSKHAFIQNIAEVPSNKEIEKKEGVTSNNEQGNTPKPEEKEKTDKAEEKGKETKVEEKGKESKVEEKGKESKVEEKGKETKVEEKGNEPSKDTEESVVKEITPKSEEKKNDNNISGSTSSNTVSSNSNDKKVENMINVSNNNSLNNEDVINISKEENNSDLYFLKTLSIGSSIFMQLVLLPSVFKILKKKSTGESDGLTYVVLFFSSFLWLVYGILLNNSAIIFPNSVGLLLGLFYSIIYHVNCKNMWLKHKLYSYYKTCGSICFMLYIFLYILSYEQYELFVGFIAFVSSIVNFGAPLSYIQTVIKKRNSSLIPLEISIGSLVCSFLWLTYGFILKDVFLITPNLCGFVLSILQIALILLYSNKEVLSNMDTEIAYNESNNNNNNSNTIIQDNNVFFNEFNLDDDFKITEVPTNLNNSIFDTPYDETSPLTGHFDIQFKHNHLDRQNYLNNSENKKNNNHSVPF

SEQ ID NO: 18044 - protein, 366 aa, Plasmodium yoelii yoelii
MTETDNITKIKNVQERLKEHESKLECDNEGVKEIDDATIEVIKNDLILLKDVEINKDILKQTKIGVTVNKFTKINNESIKNISKELVDKWKNIAIKEKNSNRNSENIKKRKHSETENSNNNVNEKEPELKKKSTSCSLNNNNSTHINEDKENNGKNNTKSYAYNSNENRKINIVDIEEIQKWNYSGKYHHDVLRDKAKQFLFKAFIAGSHDNLLHIIDQNKLDNIIYNIENELFKIFIERKNSQKEYNMQLKSIKFNLSDKKNPNFNEKIYAEYISARTLATMNSQDMASDEKKNERQKCLQESLLACQSDWDVKNILLKKERKGEFQCFKCKGYDTVYQQLQTRSSDEPMTTFVTCLKCNNRWKF

SEQ ID NO: 18045 - protein, 919 aa, Plasmodium yoelii yoelii
MDNNREVKKKSFLKNWNINYLSNNFNKFIKSNSNNKNENNSAIKTGISSGTVDNTSKNDYNLMNNNIHITNIREMSNININNIKNIRPDYYGKGYSTAENGNNNTCIKNHKYNNYNSNSNDTSINFIHTNDRGKTHMNFSDTYNKINFQNFHQNNISSNVETNVEDNKNSFSKSSFNDMNSIKENSNSYNKRVYKNLHNCNNNNNSDTMNTQYNINYNKCTIDGKNNIKIESTKYHNNSNTESTNNNVQSRNKYDINNEYCMNKNRLINNSECKNNTINLNDQGNKNNDTSNNNDQISFKNNRSYSVSSMVSSNSSIPSSAYSGQPFNYSQIDRINQKKHKISRIIGSNDNNVNKRNSSVSHNINNNSNDLTYNGHENSHFDWNKNEKNNTLSEEQASKNAQTENYNIYRSELNKNISTYTSNDRNATTGFTQNCINTNSSTNTSSETRQNYYESTLNNNRNSGYGGHDDYRRNCKDARYSINYSSVNTNTENKRTSIFSNNNNNSNNNNKGDSENFTDSRRGLNQYSQEIDTKYSRFSNNNAYSENNNNYMRMSTDRQGNSGREEGGDDRYDRRDRYEKRGERSNGNNGQGNEGGDSDGGSGDNNGQGNREGDSDGDSDEDTNRKNNKNRRKESSMDDEVEKKNNNSLNLDMLNPEERKREAEKYKVLGNQSYKLGYFESAIDYYTKAIQYDNTNHVYFTNRALCYKKQKLWKLANIDARQALNLEEESVKAHFILGLTLLHLNSLEEGLKKLTKAKTLSSYLKDSNESEINRYILQAKKLIYLRDEQTKQLKYAELQSFFIEKINLLNQMGYITNEEKFLRTEQTEDLFKEILGTFQKKQIPDYLCCKISMCLMNEPVITPSGMTYDKIFLYEHVKHNGSFDPVSREQFSIREVIPNYAIKEATDNFLKTNPWAFEE

SEQ ID NO: 18046 - protein, 352 aa, Plasmodium yoelii yoelii
MDHISDDSLNNTFQEEDNQEEDVELSGEYFDNQIRSDYKEEEYDHDEIEEHIPGLEVKDGGNEQGEEEEEEEEEDEEEEEEDEEDEEEEEDDDDDDDDDDDDDDDDDYDDDDEYDEDDFNEATVSWIEWFCQLKQNIFLVEVDEDFIRDEFNLIGLQNKVPHFKKLLKIILDEDDDDDDDDDDDDDYDEDDDEINRRSEELYKNKDIYEQNAACLYGLIHSRFILTSKGLALMREKYKSGIYGTCPSIYCDNAKLLPTAISEVPKFLSPLLYCPRCCETYYPHKNSLINQLDGSYFGTSFASFFALSFNILSDKKKNYYTPQICGFTINRDIRENMYIEMNKDNSESSEEFS

SEQ ID NO: 18047 - protein, 262 aa, Plasmodium yoelii yoelii
MRKFEQCWICLRNSETPVSTPYGHIFCKICIINNFLAQKKEYSKKKKEYENYIKDMDRKKKEEALHIREKEKIKFLDDLENVHEHVKKTDEKKTGVDISNNFWIAGNAKIKKDIDKKLKPPSNKLICPISGKPIKMSELITINPEVIDKNDTINGNWVCSFSKKNIDHNKAVLIKKTGQIILKPFACTIMFKIVCTVKFFFDQRKCKKEKSTIKTVLFIFSPFIFSPFIFSPFIFSPFILLLFFCLIFDKIPLLEILQFKSF

SEQ ID NO: 18048 - protein, 417 aa, Plasmodium yoelii yoelii
MEQSENILLSGERGIFEFFVCDVGVGLSLSVNENEINSYDRDILPIEYDSIFIKKNVKNNNNYYENSGQNGGTNLVDSLTIHYKNKENNNNNEKEINLALGGDIMPSYGVLPYYTFNHEYIIYDSSQLLPRYLIQFECDPSAEELFSIPLCDYCGNAPSLYYCESDEVKLCEKCDNIIHSQNKLVKKHIRKTLNEAQSNFGNCKIHLQNEVNMFCTVCHIPICNLCMCSHAHKDLSNVNFFNFNNNNSDTIISLKMAYNAIMQHSSKPSNFIKERKKNLNNLLEKIDKLHEQVRLNMNETEKNVYNVLEDLVKQLHTTTDKKMSSILSEEYELKRQFNEIMWNENFLYYLQTILPPADFMNAWLKHCQYREEIEKNSEHSEKINSLIFPDIRIKGNINVITEGSINHENIFHSSANL

SEQ ID NO: 18049 - protein, 676 aa, Plasmodium yoelii yoelii
MDNNVERREGEDGDDSNDVFLYNNETHHGSEFCNILCIFIFFMALFIIMIAIVDNKAPNNNDRNYNSENENISNNLTNDDVINNFLENAVIQSFDFKGNYKIKKKNKIKHEQDRIFSPKNEQGGNIFEGKIVTLKLALQNITKSFLFLHFYPTNVNIKEIKNEKNNPEIRNEWNNKVGSNYYLIYEQRNKKDDKKFEYIGMTGININTSQNYIFNGNGYNISTFCNDVLKENCICNYTAHIKLNTKINQLTSIREIEETYFYSLKKYIIDEQNYFNNTINEKYRKYYKQTMEAVSSHLPGGDIEKGANNIGINNIGSGSGSGSGIDNNGSSGSDGGGGHYQGVLMSNDCDFEVSLEGYDEDNVYFSKKVRNFILMYNLKSLIELGLFYKQIKNSENVRNASKISIITICLNSYIEIFEALILLYQVLFSKLLLTSYMAMIMFKFVLYTLMEIRYILLIWKANNSNNSGNNNWEYMQKQLSILYKYYYGFVLLLIAIFYYIFPYFPYLILFIYLCWVPQICLDIWKGQHKSISLSFVFLLSACRLFLPIYIFMYPYNIFQLDIFSKVGELSNITFSFIIIFCILLQLIFMYIQRIYGPRYLFNINLLPHVHNYYQNLDPNFEAGIQECVICMYNIILNNKKYCITPCYHIFHEKCLQQWMTIKMECPTCRGSLPNFP

SEQ ID NO: 18050 - protein, 300 aa, Plasmodium yoelii yoelii
  unsure (1)..(300): unsure at all Xaa locations
ELAKSINFLKELICNYHNISEEELNKKANDDIITLLKYTEDIEPRGGNILKYKELLKKLKHVLIHLPSTDPLVPICKKNINELYLAREILEKGVIISIMDNDIKSFTIYMAQLFIYYFDFKNILQKSAKQNAILGVYLLHLLSSNSIGDFHMLLEIISIEDQNDPYIKYVLELEQHIMDGYFHYILKKKDDIPLYLYSIFMDRLYNTIKYKLADCIFSSSNSISLLYTCELLKLKDENELYQFIXEYNEIKTAHGEDNLIWEIKDNKIYFKNQIESTQELPSIEILNNIIGYATELEKIV

SEQ ID NO: 18051 - protein, 550 aa, Plasmodium yoelii yoelii
MNMLIKSVLIAFVINIQIHIAKCLKHEKNTYFSNSPINFQFNNINEFSKNKKFIKTNAQKIHNLNKIPLFINNYKTTYEKINRSNENSSNIRNIHKYSVEKKKIVLNAKNNQQNEGKFVLFNNSGKNSTGNYGNKNYEKNKNGNDISNNGGNVGNAENAGNALANNTNINKETIGTTKAGVLNNIIEGGKTISLLSLWYVCNIFYNIENKKALNIINLPITLSVLQIYIGLPLFLIPWLLKLKNKPELFYDENAMKQISQSDRNFIIKGFQRYILFLKKYSSIMKQSIYHGYTHLLSVIAMGAGAISFVHIVKALGPLFAAFFAFALTNTRMSIYTYASLVPIVLGVSLASIKELSFTYKALYSTLVANVFTTLRTIEAKDLMSKNLEKIGKNLTPENIFSLLTIFSAIFLTPALYMDAHKWKDTYYYLMNNKQVLKVFGKHVLMSGVWFYLYNQLSFISLNRLNHITHAVASTVKRVFLILTSYFIFGTKFSFLGGVGSAMAHTHFLKQSNINILLNTKKRTSICECSIYTLDNNILLLQHIHRKIHTL

SEQ ID NO: 18052 - protein, 262 aa, Plasmodium yoelii yoelii
MATPEELKQLRSDCTYRSKLAEQAERYDEMADAMRTLVEQCVNNDKDELTVEERNLLSVAYKNAVGARRASWRIISSVEQKEMSKANVHNKNVAATYRKKVEEELNSICQDILNLLTKKLIPNTSESESKVFYYKMKGDYYRYISEFSCDEGKKEASNFAQEAYQKATDIAENELPSTHPIRLGLALNYSVFFYEILNQPHQACEMAKRAFDDAITEFDNVSEDSYKDSTLIMQLLRDNLTLWTSDLQGDQTEEKSKDEGLE

SEQ ID NO: 18053 - protein, 751 aa, Plasmodium yoelii yoelii
MAASKVALKKSGNNTSKIMLNKERDETKSDFINNSSDTKKSISLLENDEIYSLIEDKHNMSNECDDKDDDNNVLLNNGTNIYSDLYKNYDDNSFINRGTKTEIDSNASLSNESISHMSPFPNSDSMCNSFRKNVNKKKYINLLENVNIYKDKKEKDDMYIDQTLNDSHINKSVVENCNNNDNGNNNYCGYISGYSNNFIDINKPWNNNQSYIYSCSLKHNKTDSNIIYHDYKENEIEYMPTETKLHNNNSSYYKENDIINSSIKYGNNSSDQVHSNYYRDDESSDTSESLYEEEKIQKKNNETKTKTKTKKWLRYISKESEKIHNKFIKKNINKIQERFNLNKSQPIESDNSLYKFHKNGKNKYKIINKKKHKQIDSINDNNSKTSNNKYTVKSYIENTPIGIMPLGTGNDLCISLGWGGSYINNISLYLNKIKHSKNKLVDVWNIKAYDLSNNIVLNNTFINYFDIGLISRLALHFDNIRKQFPHFFNSRLGNKILYGEIGFRDFCFNTYKYKLNKHIKLYCDGKRVKINHDLESICFINIPYILGGHNIWKDDNLQYCYYSDIEKGYYDENEKDKIKDNKKLTKKVTKLKKKNIHNKSTNAQIHTHDESCENCENLHTQSLENINNQRGISKSCLYKCCDKMKENIKHIDDENNTTDYSNIYKPHKLYLYKRKKNSQMYKKQQIDDKLIEVFGIKNIFHLVQVQLGLSGPVKLCQGHELFIKINANVCFCLQTHPFCNLKTALFFSFFC

SEQ ID NO: 18054 - protein, 243 aa, Plasmodium yoelii yoelii
MNISDSNKDGKDSKSDKSTSWVKWFNSRVISNFLVVVDNEYIEDSFNLYGLKNEIPNFNHLLSIITGDAPDDEHAKNSLEKDAICLYSLIHARFITTPKGLSLMKDKYIKGDFGHCSRVSCAQHNVLPIGLFDQVKIAKVHVYCPLCQEIYKIHDDKIYLDGAFFGTSFPHIFLQTYPYYSTLKTPSYCTSKIFGFSVYHNYTRTEYKIAKGEFGKISKDNFLKKNPKYLKKLKKEELQIKDA

SEQ ID NO: 18055 - protein, 362 aa, Plasmodium yoelii yoelii
MSKKYIHTENKYEEKGKHFNAQNGSQNFSQDALKQFYNSWDKLYKEEIKNEERKNFIKCDEDGTEKDMENGNKEYFNSYAYIHIHEDMIKDEIRTRSYYDAIRKNEHLIKDKIVLDVGCGTGILSFFAAKHGAKHVYSIEKSNIIYTALNIRDANNLTDKITFIKGLAENITLPVEKVDIIISEWMGYCLLYENMLDTVLFCRDKWLKPGGIIFPDKAYMYIAEEVVIDYVDKNYVVTNSSCILKLDLNTCTKEDLSFVSPFTITMTRRDYIHALVIWFDISFSACHTDVSFTTGPYGPNTHWKQIVLYTNHIITGEKNETLKGMFALKKNEQNNRYIDMKLHYNFSGAHSKVESTQFFNIS

SEQ ID NO: 18056 - protein, 565 aa, Plasmodium yoelii yoelii
MCEHKVNNKHDGEFVNLKEKNEHNHCGITKSTIADCDEDYSIITLCTKCLSTKTDVNKNKIILDSKALKDSRTKRRSSVNIDIDILNNNLNLSPYFDRSQIIQETVLMNNDDLAELYELDKYKLGKGSYGNVVKAINKKTGQAKAIKIIDKKRINNIERLKREILIMKQMDHPNIIKLYEVYEDSEKLYLVLELCTGGELFDKIVKHGSFSEYETYKIMKQIFSALAYCHSKNIIHRDLKPENILYVDSSDDSPIQIIDWGFASKCMNNHNLKSVVGTPYYIAPEILKGKYDKKCDIWSSGVIMYILLCGYPPFNGKNNDDILKKVKKGEFVFDSNYWSKISLDAKEFICECLNYNYKERIDVHKIVNHKWFVKFKTYNHITINKHLSKELIEKFKKFHKLCKIKKLAITCIAYQLNKKKFGKMKKTFEAFDHNGDGVLTISEIFQCLKVGDNEIDRDLYYLLKQLDTDGNGLIDYTEFLAACLDHSILEQDAICRNAFKVFDANGDGIITKDELLNVLSFSNDQMPFSKEIIENVIKEVDANNDGYIDYDEFYKMMSGRSSKME

SEQ ID NO: 18057 - protein, 570 aa, Plasmodium yoelii yoelii
MEREKQKKAQKNVSKLFHTKSNKNETDNIDEHVLKKYDIIKKIGKGAYGIVFKARCRKYKKIVAVKKIFGAFQNSTDAQRTFREIMFLHQLNGHDNIIKLLDVMRAKNDQDIYLVFEYMETDLHEVIRADILEEVHKKYIIYQLLRALKYMHSGLLLHRDIKPSNILLNSECHLKICDFGLARSISTEVNENKIPVLTDYVATRWYRAPDILLGSTNYTEGVDMWSLGCIMAELLLGKPLFRGNSTMNQLEKIIEIVGKPNKKDIEDIKSPYAETIISSFADTGKKKKKFSEIFHKASQDSIDLLEKLLQFNPTKRITAENALKHKYVENFHLLIEEPICKHIITIPVNESTKYKVDFYRNIIYYNILKRKKNLIHREDYTNVQINNDVKTDVPIDGEKENNYDIHQMDSTKKRGKKKRHFISNSPNANLETYQKYETNCRENNSQYLVEKKTDMNTTQGNKEKGSNAKKKLKNKIKPKQKTLTIKNSEKKNTLNYYDKSEILHDKNEKYYYEHTGENNNNNNANEQNDYYKNIANQDIESQYRNTMAVHNYNPGQDFSKHYFYKQKKKY

SEQ ID NO: 18058 - protein, 2167 aa, Plasmodium yoelii yoelii
  unsure (1)..(2167): unsure at all Xaa locations
MSYISDIFNPSHINIFIKKIMIFLKNDLTSRYSQKYLNVIIDNMISTKIINIINDKDSTLNILKTLDILLYSKTKINDGDIIKCLQICFDKYPDLDTELESFLYNFNSYLLNQKNIKQFLQLCVTDNEQRRFIIIKSLHKFVIDNFCSNNEGDIYNDKSKESIVEMFNDEFIHLYINIFKNDYNKDTQKMCQEILSKLNIAPVSDQNMVCKTIAFSIDKKNTKDLILQLTSKYIIFKXYGKXGILKTIDQLAKCYYINVIDNVEFILNFLLGLCLEEKADIGKIKDYVILCGTSVINKYNEYLLKCMKRYQQNGKGNKSGFNRRTRDAMSISDDYNDEENSCGSDFLSSDDDMEILSNCRNNNGSSKKKNNKNVSKELFEESFKKIYNVLNKYRDNKKSKNKTTVDLIVVMFYGCLGSNLKKESLELLNKLIEQILHRDTDNFTQIEISNIIPKFIENLMQGNNDDEEDENGDIEYNINGENNKAKGVSIDDKTGKNNKKNSNNNVDGKDNKKKAKNAKKSSITGVSIDSLIYLEKYDVSLLIENIFKLLISNKELKVRKGCCLLLGSVIKAHGMGILKSYNILDKINSNINSEDIIKRQSFYLTYGCLFKVLKHKFEPYILKNFNLLLECYKDNVNNIRVLGINVVEEILNDIGIYGLKKIMPFIIFNLKNQSIKSKDIIAYLDILHLIISKFDIINNLDNETLVSLINTLCELVSDTNAKVKEICIKIFNKLEKNITNMEIKNISRQLLLCIYSPNDNHLCDFLDMFASISFEYKINNISLCLLFPIIKKGINNIRLDIKKKSLQIFYFLIHLVNDQSLFIIYFDSIFKTLAILLNDAIPEIRYLTAKSVGNISQFLDINKKLYYIQYIFNILLTTSSLVEKSGASLCLCSILSKCSESIAYKFISKMVRMIDVKKYIEAKNIQLKKSLKENNEKNSKGKKGAENKELKGKKKKKNATNKIKMGSDYSEDDEDYSEEIEDDENSSEESYESISEEDEEDDVEDEDGDEENEEEDMSDNSYEESDFEDDYENEFSEESEKEEGSDYDEEYDDDDAAFTDEMSENNDELLNKGDKDYYLNGYYLIEKNEDNSYCLEFDDDLINWKLIYDKKVINSENSKEGLIGFFIYMPECEPYYTEKFLKKIFQKLMLCLNDNNEKIRDITLRACKVLINAYSKNNTSLILKFIENKIYNRYWRIRKDSVLLLNILIEKNLEINKEEKDIGRLHVLHERFYFMLSLICIMKNDKNINVRQTSYNIYKNFVNKRILQEMWPILLKKITQNLSSKNNSKQYISALALGDLVFKTDSNSLNTIIENMIKDFKTTKNLSIKKGVSLGFYEIFSKGKFNNLIVNYIHDIIYMIKELACNKNASDIIKLLSLLLVNIDKHVLKDIINELVNTIVNNKKDDKNSTNSSISDELISFKSIKFFLNIHTDLVIDYLVSSALTPPYNFGKLKLLSYVSYAKLDSYSHLFIKIIHIFIGLIFFNLKDENNYPYDTKNYSNVELSYNSKDSDIRRKINNSGSLSESEKEINKFDPNSSSNNDRHANSEIYDNAEKDPKFKELYKYKQENSLNFEEIIICLKLFLKNINERNIDSITEILFSELKKYDCKIDLSYSNIEKYKCEETCEDKKSEGIYTLEEYSKVIYGEKLNELKDKCEYANFYGKVREIILSILKYLLDIINEGDICSNSNEHQTQVENVNHGNTIKNVINKKKHIRKKINILNEYRIETYLTALSKYAFVDINKNVLEIACVIYMYLIELVKKIDSSYSYIDTFYSIINKYSTDSNFNEIXDDKYELVGLNLNKPLFSTFINLFTNVILLSPNSDIKIKAIDTLRKLFLYTNKEISSGFILKTSGALIRILTNKYIEQAKIYIFSTFEVLIKKGSNYIKPLIPQLQTCIIKSLNNEKLKKPIIHILNIISEKKLTRGDLLVNDLLNNINVQISLHQSMTILMVLSNILNNSDLNIKNILNKIITCIKPLFNHANNEISFYSCKIYVLLCLFHAPNKKQYLEGILPLSSKDNIEATTHYFMLHLSEVNNFYDILKKDNLLDNFKTLYINMLKDGNTNLQNIIFQIFYNLSKCDDDCLIFIFNNLNLLKLPPFVMISIEIHRYYFKAIKNIFKKKPDIYMTNIPNFLIVIENLLMCTSTTIHAFKLLVRYFIISFIYTI

SEQ ID NO: 18059 - protein, 1137 aa, Plasmodium yoelii yoelii
  unsure (1)..(1137): unsure at all Xaa locations
MKDKNNSKNLTSNKKTKKKSTSNYVDNCKNDAENSNVNKNNKNTNVLVNNENPSFIKNEKLSHDTRFNLMNCGDTNSTIETNNASQREQNAEENLETNIKKRIKNIKLMERLEYIENKHSFNNYQNIIEVDEDDIKEIIYDSVNSTCFLCGYKNASIYCSNENCSVKFHLNCAFYSTIIKNCNDNIFFNYKKLFNLIKFNNDTIFCNLNNLPHKKEEENYIFENNYNDIFPIHIIFKTKKIWCNHXWNDKSVYESFYLKKENVSYCTPSNCVNDQMTYEQNQIIADNTPSKHVEINNLNHIPNLENTLGKKEMLQENSITCVKSENDMENKKLISYTNDKRATSTKFLEMLKQYFNSFLEFYFENGSYYVMDTILHNINESIKIRYKSKPLTVLQEILNKKSKIEKKMKELENVINKYVNKKNDEKYIDDKYNLIIQENTKNISNNNNDIPNERHETKITKKIKRNEEPINNTIVDIQKIIDNKNVSNILKSYFILKNFFYIGNFTTLKNENYFFSKKNENSFVKYLVENEQTLNICLSDVLTTNQIKMSSFACKKKWNENDMANSSTNEYNKMNEMNSPQNYCIKYVEYDNESDDNTSDTNINCSSETEESSQYINDIDNNIEENMKYKKKSINIYFKNLTDMKEKKKVNITKLQQVSSNFIRNRENVHINKIVEEIDEGKNKNLVGKEKLNIFKKRGKPQEYINDRKWSNTSSNASIANMMLKKECFLNLVTNNNDIYIKQINDKYFLNYKYNTATNNNNNLPFNHSKCNVIKIGCHNILNIGEVVKYEGEEMIYPCGFLNMRIFFNLPSSVLFHIYKNANINNLCLKNNVLEKICLQLRATYIFSITLKNNNIFFSIILFPLININYFSEADAQKFVLAESHNINELYKQFLSYFNYQNEIYITEQYKKFTKKYSKLYEYMAKFFFKSAEHNKSLDAHSFFGLTLPCVIYHIKYKLFKFIWANLSSKINTHAKRECERDEIKKKIKNCKREVKYNDNILCKYSNLETSIFKDSEKEMPVIEYIGEYIRNIISDKREKYYEKIESSCYMFRLNENIIIDATKWGNVSRFINHSCEPNCFCKIVSCDQNLKHIVIFAKKDILPHEEITYDYQFGVESEGEKLICLCGSSTCLGRMN

SEQ ID NO: 18060 - protein, 289 aa, Plasmodium yoelii yoelii
MEKYHGLEKIGEGTYGVVYKAQNSDGESFALKKIRLEKEDEGIPSTVSIREISILKELRHSNIVKLYDVIHAKKRLILVFEHLDQDLKKLIDVCDGGLESVTAKSFLLQLLNGIAYCHEHRVLHRDLKPQNLLINREGELKIADFGLARAFGIPARRYTHEVVTLWYRAPDILMGSKKYSTPIDIWSVGCIFAEMVNGRPLFPGVSETDQLMRIFKILGTPNSQNWPDVFKLPKYDPNFPVYEPLPWETFIKGLDDTGIDLLSKMLKLDPNQRITAKQAIEHPYFKETN

SEQ ID NO: 18061 - protein, 499 aa, Plasmodium yoelii yoelii
MSILCTISGQTPEEPVVSKTGYIFEKRLIEKHIKNYGICPISGEILTLEDLYPIKNEKYVKPRPITATSIPGLLSIFQTEWDSMISEMFNLRTHVNDVRNQLSHSLYQYDAATRVIAKLLKEKNNYQEEINNLRNQILQLKNGNDILNDLEIGINEDLLNEMQNIAKELLMNRKKRKVENVNSPNEWKKITATNEFNIHSSIIPGVTCLTIDVNKLKYNYDDDHKNHNFFSGGKDGNIYYVSLNNNKIISKLQGHLKKVNSIISHPSNSICISGSNDKTIRIWKGDPDTNEYVTSHIITKHKDKINSLSLHPLENYFISSSNDSIWILHDMETGKTIKTCKSSPSPFKNLSIHPDGMMFGIGSEDSNIYIYDIKSQEYKASLTGHTKSIESISFSENGYYLASISKDNTLKLWDLRKATTFQTIELENTPKHITFDYSGKYLSLSVGNDIQIFNFETKNQASLITTLSSHTDIVTQTCFGSRTSYLLSSSMDKTVKLWS

SEQ ID NO: 18062 - protein, 311 aa, Plasmodium yoelii yoelii
  unsure (1)..(311): unsure at all Xaa locations
MNMLYKLLLFFFFMRALECYRIPNIQNLNKVNTNKYLRSNRDLNLSGHNKENNYYCGENKVALVTGAGRGIGRSIAKTLAKSVSHVLCISKTQFFFFFFFFFXQKSCDSVSDEINSLGYKATGYAADVSNKEEITELINKLLTDHKSIDILVNNAGITRDNVFLRMKNEEWEDVIKTNLNSLFYVTHPITKKMISNKYGRIINMSSIVGITGNFGQTNYSASKAGVIGFTKSLAKELASRNITVNAIAPGFISSDMTDKISDDIKQNIISNIPAGRMGTPEEIANMVGYLSSEIAGYINGKVFIIDGGLSS

SEQ ID NO: 18063 - protein, 331 aa, Plasmodium yoelii yoelii
MGRKKRKINIELKPFCYYCDREFDDEKVLIQHQKAKHFKCSQCNRKLDVATGLVVHMMQVHKTNLKTVPNSLPKRNDPEIVIRGMNGVPTEIIEENLNKLKQKLGDKNIKRQQRVNWAQVTMAPTMEQFLQQAQMGNFYFPGFNSPHIQPTNNMILNNNIDLKKNMPYIPLYPPGSNSNAPIIQPPPIGANIYQNMLTQIPSQHSIGYPGNLSSQNINTSQKYPPNINFPTLPFLPKLPHNTFPSMDSNFMPQNICPPPVPPSAPPSGPPLLPPSAPLIPSAPPNLAQNKANNSTENIPDQTNEDKAEDMNPSKESPNSTSNNDNSKKDDK

SEQ ID NO: 18064 - protein, 199 aa, Plasmodium yoelii yoelii
MSHLYEEHMNKAGEVENIIMGLHRTEKSPCGFCFVVYKKKEGATQSVNFLNNSILDGRIIRVDEDLGIIGKRKYGRGKTGVQKRDERNKHFDEDRPIVLDNLAQQHLITKKRKINNNHHYPNMYNIYHPYERNVKPRILTNNNFHPNNYQNSKSVNSKSVNLKPVVTLYPNVQHLMAYNRNKNTKPYNYNYKKDRNSNM

SEQ ID NO: 18065 - protein, 479 aa, Plasmodium yoelii yoelii
MYDSSSKIKDLSLAPFGKLQMEISETEMPGIMTIREEYEKLKPFKGAKITGCLHMTIETALLIETLQKLGARIRWCSCNIFSTLDYAAAAVSTLENVSVFAWRGETLEEYWWCVEKALTWGENGEGPDLIVDDGADASYLVHKGAEYEKLYEEKKILPDPESGKNEEERCFLSLIKSSILKNPKKWTNMAKKIIGMSEETTTGVLRVKKIEKNNGLLFTAINVNDSVTKQKYDNIYGCRHSLPDGLMRATDFLISGKIVVICGYGDVGKGCASAMKGLGARVYVTEIDPICAIQAVMEGFNVVTLEEIVEKGDFFITCTGNVDIIKLEHLLKMKNNAVVGNIGHFDDEIQVSDLFNHEGIEIENVKPQVDRVTLPNGNKIIVLAQGRLLNLSCATGHPAFVMSFSFCNQIFAQLELWENRNTGKYEKNKSYILPKELDEKVAFYHLKKLNATLTELDDNQCEFLGVSKTGPFKSEAYRY

SEQ ID NO: 18066 - protein, 260 aa, Plasmodium yoelii yoelii
MQPNSLGSVKSESNANVSSNVDPTSSGDTQRKKYKLQYQPLEEDPELWLDAPLIKIKEFERKFPDLALWPKNGDVIKNENSNLNDPFNKQWYSLANQIIQSLSKYEGGHIFERLVDTKKQNCPDYYDVIKNPMSFSCIKAKLKKGQYSSPQEFINDVQLVFYNCSVYNTPGTIVAITGKNIEAYFNNQLIVTGFNNFVQKEKNINEHLQKVEEENERWAEEHPNVVKEENSENNNELNQLNNEMNNEMNNEQNSEINNEE

SEQ ID NO: 18067 - protein, 2497 aa, Plasmodium yoelii yoelii
MNTNNTEGRYLLIIYEKVFKIIYIKHLKDNKDDVSKTPCLFIYRETGKCSEKLIYKDNIRKKSKKFGMLLNELIIDSIIGTVEAHDELFLFVCEKWKLLCKFFYLNKYRNIYKIERVQYIPYNRNLFPINTTINNFLNIDDNSTSFFINNSKNNEDINKKFEVVNSDQAKDIYANIKDLDKNQKLLQNKREDTNTDEKYENGSLNTSNRINNNEIKIGKFENSGIIIANEEPSNPYRFSNDIYKIDDQNICNKYFINKINKCDYDDPNNKNKKECIENLEIVENITERKFYGNNNEDNQNNFNKKEEKNKKLLNFNTAKKWLTNQFNNKNILNIISDITNYDSKNMNGTEKPSLKVQGGNNEKYPNTKEINSQKMSTNTHILDDNAMLLDLMNDKNEYNLVNANTGNNNMGIESNNSHFKCFDMNDYEYVYNSNNKNEIKKTDLIPNINSGNPNENIELQERKDNYISETKNENNNINIPTNFDFFNEENKNEIIPDYLIDEKKKCLGYEIKNAKKKNDESNILIDLDDDKTNETCFNENKCDEQDHKNFIPSFNDGEKKENVIDKPYDNNNNNNIEDSQKGSDKQNKCKDVESVKTINGDIKDLINNYYFNGSNYEDTEKRDSYFMGIKNENTEHIKNEDKLILKMDIQKILKMIQKILCTHMYYSYDFDLTQCIQKKRRKNIEEKEKAPLLHHYSSLNKRKSFLKMCEKKFMWNYQMIKKMKNRCKIDDNWFCPIIQGYISYTSIEMNKKRIELFLVSRRSSILGGTRFNKRGINDDGYVANFVESEQIIRIDNRDNIFYKSRFDKVDVDSYVKKIDVSKDKENGEIKMKKSLYGMEGKVMKNKVPSTKEIDENKYEGKEIEMKCFNKLLVDNNSNQEIISKSDASEKEMKPTKMNIYRNIINKHIYKRTNELNRNKCLNNLLNFENRIISLVQIRGSVPLFWKQHSMSSHVNIQRSSLLSIKAFKEHNKKLIHNYGNNIYYINLLSQNKNNEKKLTKKLIELINCVKKDDTYKEKDFLNYIEYDFHISVKNKSFDDAMDSFINNVLLKQIKNVSFFVEPINNENNRHRKRPHIRSKHNESYIFQDGVFRTNCLDCLDRTNVFQYYYSLFFILYILNVSKNDNFLNPVKKSNINFPKNASNIFSNNELVTILSSMEMDNYLLEPTDRVQSDKLYEYNNNVYSSGHGSNQLSTNNNLNLSNNSGNGINKKKKSNESSSHSAVSFLLEGFNYISTGGLNNENSNKKNEENKNSKNSNLNVANMNDGYNVTNIIDKGYRPEHNDEYVYVLKHLFKKMWVENGDIISTHYTGTGSVFSSQINVGRSSISTNIDHAIKSIERFYQNNFEDNFRQECIDIILCAGKYSNKNKRRNYLIGGDFNYLLNYNNLINMDNFIKLCNKNPYFSIPHFYQNMNNSKDKTQINGITENSNKSINSDAYLTLNTKKEDLLKNKLDKSKKKRRFRIRLSERLRRKYYSPTVKSIQNMNQDEIDSNSKNNENYLIKNNIPHANELGKINEFNEKTDDNVLITCGKKKGHKKSTSSSGTNIIKKENEEYDYEKLTHIVAKKSNGSIDNVKKSEKRKKHLNYSNNNIGGNNNNNKKTGKERKKYKSNLIYVKNLYKKRNYIYGLRSKNKFGDLLSYDLINQYYMNNEDFKFTQNYIKSKSKNYNYEEKIIKLWTGTWNLCGSDIYELNDISSWLNENNEYVDIYVFCFQEVVELTGFRILMNMKDKFKEKKIEQKITQTLAEISQRQKEMYLKSQNNNNESYFIDKNISRNEDNTESNKEYFYDSYIKDDKKNDDNLDILDISKSAFLNNCFNNLNKEYNEGNDNDNTSYPYNMKNNNNYEFQHDYNYVDNDLISKENKSDHIDSLIDSNNIRKECVDSGNYIFSEDGNNLKENSNNFLKNDENNKFLTTPKLKRNGTRFSCSVTEIFEDNSSVSLGKDINILNSGKNDSKFVNNNENIENYKGSKNSNIYTNVQDGFGTHNNRLDKEMDVFKSCNQNDETKQNENIIKPSANSSFVNTNHNFGDNKRMYINRNINTYDNFTNIKSTCSEKNSNRMGKKNDMKKDSSTSNNSRKRNDMKYDKFLKNDQNYNSNNNNKYFLNLKKFKYVKLKSVSMIGLFIIIFIDEGLVDHIRELDVCKVKVGLKGNTGNKGSVSVKFRLGFNSFCFNNIHLASGQTNIFERNSQMQSILNNSFQSQELNNLFNFDYFFACGDFNFRINKNHEEVFKLISNKNITQLLNYDQFIYNKLYNILPFCLFYENPITFNPTYKYKKNSNIYDVRRTPAWCDRILLSGKLIQLSELEKKRKEFMDREMKSEKDKPDNSICNGICNNVENIISENVTNKETNNDNEDNDFYYNDRIYFKHMNYKTHNNFFSSDHKPVSAIIELKVFFDKKDIEYKSNNSYSIIENDEFNNFTKNSSNTSNSSNNKNNNLLDYFFPNNYGISKYTTYPISQILNYSQNINNKLKNGVNENNFQQTPISKTDQIDEYRIFK

SEQ ID NO: 18068 - protein, 528 aa, Plasmodium yoelii yoelii
MGQEMSTQSDIQNEDQKGNKRNLKGTQGKNGLKERSTSISKEIVKNSFNNSKLRPGMFIQNSNVVFNEQYKGIKILGKGSFGEVILSKDKHTGHEYAIKVISKKHVKRKTDKQSLLREVELLKMLDHINIMKLYEFFEDNNYYYLVSDVYSGGELFDEIISRKRFYEVDAARIIKQVLSGITYMHKNNVVHRDLKPENILLETKNKEDMIIKIIDFGLSTHFEYSKKMKDKIGTAYYIAPDVLHGTYDEKCDIWSCGVILYILLSGCPPFNGSNEYDILKKVETGKYTFDLPQFKKISDKAKDLIKKMLMYTSAVRISARDALEHEWIRLMTSKDNVNIDIPSLELSITNIKQFQSTQKLAQAALLYMGSKLTTIDETKELTKIFKKMDKNGDGQLDRNELIIGYKELLKLKGDDTTDLDNAAIEVEVDQILSSIDLDQNGYIEYSEFLTVAIDRKLLLSTERLEKAFKLFDKDGSGKISANELAQLFGLGDVSSDCWKTVLKEVDQNNDGEIDFKEFRDMLIKLCNY

SEQ ID NO: 18069 - protein, 393 aa, Burkholderia sp. TH2
MLSAEHRAIVKATVPLLESGGEALTTHFYKTMLAEYPSVRPLFNQAHQQSGDQPRALANAVLMYARHIDQLEQLGGLVSQIVNKHVALNILPEHYPIVGACLLRAIREVLGAEIATDAVIEAWGAAYQQLADLLIGLEENVYVEKETATGGWRGTRAFVVARKVKESDEITSFYLRPADGGELLEFHPGQYIGLKLIVDGEEIRRNYSLSAAANGREYRISVKREPNGKASNYLHDSVNEGATLDLLTPSGDFTLEHNDKPLVLISGGVGITPTLAMLNAALQTSRPIHFIHATRHGGVHAFRDHIDELAARHPQLKRFYVYEKPRHDDEAHHAEGYIDEARLIEWLPATRDVDVYFLGPKSFMQAVKRHLKTIGVPEKQSRYEFFGPASALD

SEQ ID NO: 18070 - protein, 340 aa, Burkholderia sp. TH2
MSSYNIALNFEDGVTRFVTCKAGEKVLDAAFRARINLPMDCSDGVCGTCKCRAESGRYDLGDDYIEDALTEDEKETGLVLTCQMVPQSDCVIAVPASSTVCKTEQSRFAATVAKIDQHNDAAVVLELDVDAAAPVFLAGQYINIDVPGSGQYRSYSFSSAPGESKISFLIKKIPGGVMSTWLESAQQGNKVELVGPLGSFYLRTVERPLLFLAGGTGLAPFLSMLEVLARADSQQTVHLIYGVTRDLDLVQVDAIEAYKAKLPNFSYDTVVADADSNHPRKGWVTQHMPAEILNEGDVDVYLCGPPPMVDAVRKYFDDNGMKPNSFHYEKFTPNAAPRTV

SEQ ID NO: 18071 - protein, 395 aa, Xenopus laevis
MARENGENSGTCWKKQVEDIKRMFQFKEVLGTGAFSEVVLAEEKATGKLFAVKCIPKKALKGKESSIENEIAVLRKIKHENIVALEDIYESPSHLYLVMQLVSGGELFDRIVEKGFYTEKDASTLIRQVLDAVSYLHRLGIVHRDLKPENLLYFSQVEESKIMISDFGLSKMEGKGDVMSTACGTPGYVAPEVLAQKPYSKAVDCWSIGVIAYILLCGYPPFYDENDSKLFEQILKADYEFDSPYWDDISDSAKDFIQNLMEKDPNKRYACEQALRHPWIAGDTALCKNIHESVSAQIRKNFAKSKWRQAFNATAVVRHMRRLHLGSSQDSSSVSGGNSPASPLPDGTSRKDCKSPSNPYSFLSGVSSSSSAISAVGGDRRPRPSSVTTVHAGSK

SEQ ID NO: 18072 - protein, 382 aa, Xenopus laevis
MPLDEDGPSWKKRAEDIRDIYEFREVLGTGAFSEVVLAEMKKTQKLVAIKCIPKKALEGKETSIENEIAVLRKIKHTNIVSLEDIYESRSHLYLIMQLVSGGELFDRIVEKGFYTEKDASQLIKQILDAVKYLHDMGIVHRDLKPENLLYYSMDEDSKIMISDFGLSKIEGSGSVMSTACGTPGYVAPEVLAQKPYSKAVDCWSIGVIAYILLCGYPPFYDENDAKLFEQILKAEYEFDSPYWDDISDSAKDFIQHLMEKDPNKRNTCDQALQHPWIAGDTALDKNIHESVSEQIRKNFAKSRWKQAFNATAVIRHMRKLQLGTSQEGPGQTTPTSPCHGNLLMPGDNNGSHSESCQDCCAPKSSENNSLAYSTHCAQSNRV

SEQ ID NO: 18073 - protein, 240 aa, Prunus avium
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 18074 - protein, 353 aa, Helicobasidium mompa
MGACFSSEGGGQHDISYAIDRQIEEDARKFKKECKILLLGSGESGKSTIVKQMKIIHQNGYTRDELVLFKATVFKNVVDSAQAIVLALRKFRMDPVEPVNRMYADRIMEYRVDLDMGIGLSQDVVRSIESLWHDPIIPSVLDRGSEFYLMDSAPYFFDDVQRIGSPDYIPNETDVLMARTKTTGISETKFRSGQLSIHMFDVGGQRSERKKWIHCFEAVTSIIFCVALSEYDQVLLEESNQNRMAESLVLFESVINSRWFLRTSIILFLNKIDLFKAKLPKVPLERYFAEYTGGDDVNKAAKYILWRFTQLNRARLSIYPHLTQATDTSNIRLVFAAVKETILQNALRDSGIL

SEQ ID NO: 18075 - protein, 376 aa, Oryza sativa (japonica cultivar-group)
MAGTLQVAGGCLAPLLPSRRAAAAVRPPRASGASASAAAAAAAVEEDGKVRLGGSDVAVTKLGIGAWSWGDTTYWNEFQWDDRKLKAAKGAFDASVDCGITFFDTAEVYGAGISGAINSESLLGRFIKERQQKEQVEVAIATKFAALPWRLGRGSVISALKDSLSRLGVSSVELYQLHWPGIWGNEGYLDGLGDAYEQGLVKAVGVSNYSEKRLRDAYERLKKRGVPLASNQVNYSLIYRNPEENGVKAACDELGITLIAYSPIAQGVLTGKYTPNNPPTGPRGRIYTPEFLTKLQPLINRIKEIGGSYEKTPTQVVLNWLICQGNVVPIPGAKNAEQAREFAGALGWSLTDQEVEELRSMAREIKPVIGFPVEKL

SEQ ID NO: 18076 - protein, 157 aa, Oryza sativa (japonica cultivar-group)
MAADKKEVADDTILLISSDGEHFNVPSAAASLSQLVSNMIENDCTTNGVPLPNVASKVLAKVIEYCVKHAAAAEDEEKELKSFDAEFMIDVDKNMLYGLLLASNFLNIKSLLDLCCQHTANLIKGKSPEQIRKEFGIKNDFTPEEEEIRKENTWAFE

SEQ ID NO: 18077 - protein, 172 aa, Oryza sativa (japonica cultivar-group)
MAAAAAEATTDGGGKMIILISADGKRFEVTEAVASQSQLISNMIEDDCTENGVRLPNVDGDILTMVVDYCNMHAGDAAAAGDTMKASSTEEELKKFDAELVQALENPVLFKLILAANFLNIKSLLDMTCQRVADMMSGKTPEQMRETFSIENDFTPEEEAAIRQENAWAFDD

SEQ ID NO: 18078 - protein, 164 aa, Oryza sativa (japonica cultivar-group)
MAAEKKEVADAAAGSGSDTILLISSDGEHFNVPSAAASLSQLVSNMIEDDCTTNGVPLPNVASKVLAKVIEYCIKHAAAGEEEEKDLKSFDAEFIDVDKNMLYDLLLASNFMNIKSLLDLCCQHTANLIKGKSPEQIRKEFGIKNDFTPEEEEEIRKENTWAFE

SEQ ID NO: 18079 - protein, 406 aa, Oryza sativa (japonica cultivar-group); identical to SEQ ID NO: 720

SEQ ID NO: 18080 - protein, 321 aa, Lotus japonicus
MDQHGGVATGSHERNELVRVRHGSDHGSKPVKNLNGQICQICGETVGLTANGDIFVACHECAFQLCHPCYEYERNNVSPYCPQCKTRYESHKESSQMEGDDDDDDDEDDVDDLENEVKYGQGNRMKARLQWEEDADLSSSSGHDSQMQNPHLTNGQLMSGENLCATTSGPMGQSKKVQSLPYVDPKQPGLESDEEIRRVPEFGGESAATSASRPDTGSNPGPERVQGAGEGQKKRGRSSADKESKRLKRLLRNRVSAQQARERKKAYLTDLETKVKDLETNNSELKERLSTLQNENQMLRQILKNTTASRRGSNGGTNNAE

SEQ ID NO: 18081 - protein, 432 aa, Sus scrofa
MSEKLPYKVADISLAAWGRKALDLAENEMPGLMRMREMYSASKPLKGARIAGCLHMTVETAVLIETLVALGAEVRWSSCNIFSTQDHAAAAIAKAGIPVYAWKGETDEEYLWCIEQTLYFKDGPLNMILDDGGDLTNLVHTKYPELLSGIRGISEETTTGVHNLYKMKANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYLLKNGHRIILLAEGRLVNLGCAMGHPSFVMSNSFTNQVLAQIELWTHPDKYPVGVHFLPKKLDEAVAEAHLGKLNVKLTKLTEKQAQYLGMSREGPFKPDHYRY

SEQ ID NO: 18082 - protein, 245 aa, Brucella suis 1330
MKFEFENRTLVLTGANGGIGRAIAELFHASGANLVLTDLDREGLDAFAASLGSPERIATIKADASSADDAEKTVALAMERFGGIDFLVPSAGIYQAKPFAEMSDADWYRTISINLDGVFYLCKRALPALKEDSSIVTLASLAAYRGAYVNAHYGATKGAMVSMTRALSRELAPKTRVNGVAPGIIETPMTSELLKTRMDETMTQTPLKRLGKPSEIASVIAFLCSPAASFVTGETIQVNGGIYMA

SEQ ID NO: 18083 - protein, 250 aa, Brucella suis 1330
MELLKEKLVLVTGAGRGLGAAISSGAAEQGARVILVDIDGTAAKAQADALTAKGFVAEGHALDVTDRDAVAALADDILSRFGGLDVLVNNAGVAGRAAFDQPEAVEVWDRVIGVNLEGAFNVSHALVPALKAAKGNVVHLCSVAGFVSGGSTAGYVVSKGAIRSLTQVMARDLAPHGIRVNAVAPGIMMSEMAVAQLNRPGGTDWFMNRVMMKRIGETSEVVDPVVFLASPMASYITGTILPVDGGFLAA

SEQ ID NO: 18084 - protein, 377 aa, Brucella suis 1330
MATQRIIDFLNTRRPEGPCLVVDTDVVRENYQGFEKALPYSRIFYAVKANPAPEILRLLASLGSSFDTASVAEIEMALEAGATPDRISYGNTIKKERDIARAFDLGIRLYAVDCVEEVEKIARVAPGSRVFCRVLTDGEGAEWPLSRKFGCVPAMAKDVLRRAKALGLDAYGVSFHVGSQQTDLTAWDRALADAAAVFRTLADEGIILRMVNMGGGFPTRYLKDVPTAQAYGMAIFDALSRHFGNRIPETIIEPGRGMVGNAGVIKTEVVLVSRKADNDNVRWVYLDIGKFGGLAETMDEAIRYQIVTPHDGSETEPCVLAGPTCDSADVLYEKTPYPLPVSLTIGDEILIEGTGAYTTTYSAVAFNGFEPLRSYVI

SEQ ID NO: 18085 - protein, 275 aa, Brucella suis 1330
MTVPTVKLNDGNHIPQLGYGVWQISNDEAVSAVSEALKAGYRHIDTATIYGNEKGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 18086 - protein, 157 aa, Brucella suis 1330
MRKAASITKANSATPMDIALEEAHAAGERGEVPIGAVIVRDGEIIARAGNRTREFNDVTAHAEILIIRQAGEMLGSERLIDCDLYVTLEPCAMCAAAISFARIRRLYYGASDPKGGGIEHGGRFYTQPTCHHAPEIYPGFCEADARKILKDFFREKR

SEQ ID NO: 18087 - protein, 895 aa, Brucella suis 1330
MSTTAFTVCFAVWTIFAIIGIEIRSELGLTETQFGLLVGTPILTGSLIRVILGIWADRYGGRAIFTLTMLVSAVATYLLTYATTYPQMLLAALGVGVAGGSFSVGVAYVSRWYPPEKQGVALGIFGAGNVGAAVTKFFAPMVMVAFGWHTVAEVWAAAMVVMALVYYFTTNDDPVLVERRRKGEKPTSTLMELEPLKNIQVWRFSLYYFFVFGAFVALSLWLPQYLIHVYGVDIRFAGIIAAFFSIPASLFRAYGGHLSDVYGARRVMYWTFAVSLVATFILSYPPTDYVIQSDNGPLAFHAEMGVIGFTVTVFILGFFMALGKAAVFKHIPVYYPGNVGAVGGLVGMIGGLGGFILPILFGVLLDQTGLWTSCFMLLFVIVVVSFVWMHVSIRQMEHAAEGKATEELPAFAELQGLKKAEVKPATGESVLTDWRPDDPAFWEQKGRRIAKRNLWLSIPALLLSFAIWQVWSVVVAKLPLVGYQFTTDQLFWLAALPGISGATLRIFYSFMVPIFGGRLWTTLTTWSLVIPAIGIGYAVQNPDTPYFIFLLLALFCGFGGGNFASSMSNISFFFPKTEKGNAAALNAGLGNLGVSVVQFVVPLVITAGIFGKLGGNPAMVATAAGEAPLWLQNAGFIFVPFIIVTAFANWFGMNDIASAKASFADQAVIFRRRHNWIMCWLYIGTFGSFIGYSAGFPLLTNILFPEVNALQFAFLGPLVGALSRSGSGWLADKYGGGRVTIWAFILMMVGVAGVLYFVGIKDEPNAFWGFFAAFILLFFATGIGNASTFQMIPAIMAKDMERLMPMASAEERRRQADKESAAITGFTSAIAAFGAFFIPKGYGTSISLTGGPEMALWAFLIFYVTCLIITWGVYTRKGGLLYDVERRLKPAAAAA

SEQ ID NO: 18088 - protein, 497 aa, Brucella suis 1330
MAKIVESPTGALALTFDDVLLQPGHSEVMPGQVDLRTRIAKDIELNLPLLSAAMDTVTESRLAIAMAQAGGIGVIHRNLSPERQAEEVRQVKKFESGMVVNPVTIGPDATLADAQALMKAHGISGIPVVENATKGPGRLVGILTNRDVRFASDPKQKIYELMTRENLITVHENVNQDEAKRLLHSHRIEKLLVVDDKGRCVGLVTVKDIEKSQLNPNAAKDAQGRLRAAAATSVGADGFERAERLIDAGVDLLVVDTAHGHSQRVLDAVARIKKAYPNVAVLAGNVATTAGTQALIDVGADAVKVGIGPGSICTTRIVAGVGVPQLSAIMSAVEAAQKQNIPVIADGGIKFSGDFAKALAAGAVAAMAGSLLAGTEESPGEVYLHQGRSFKAYRGMGSVGAMARGSADRYFQAEVRDELKLVPEGIEGQVAYKGPISAVLHQLAGGLRASMGYVGAKTLEEFRETATFVRISNAGLRESHSHGVAITRESPNYPGGM

SEQ ID NO: 18089 - protein, 265 aa, Brucella suis 1330
MELTEITPESLRLRPSHKERNVLITGAARGIGRAIAQAFVERSATVGICDLNLADVARTCEELNGLGLGRAVPIACDVSDYDALVAAIDDTGLVFDTVVNNAGISPKHNGVAHKVWEMAPDEWRRLVDVNLTGTFNTIRALTPGMVEARRGWIVNTSSVAGKTYSPIVACHYAATKSAIIGFTKHLAAELGPYSIRVNAMAPGRIATPMVAGVAPEVNAEQVKLTPMARLGQPAEVADVALWLTSTESSFVTGQTVDVAGGLYMA

SEQ ID NO: 18090 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 18091 - protein, 375 aa, Brucella suis 1330
MKFKAAVLDRHGVERPYNQTKPLVIREIELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 18092 - protein, 463 aa, Brucella suis 1330
MEFTLMPMLITNPHLPDNPIVFANPAFLKLTGYEADEVMGRNCRFLQGHGTDPAHVRAIKSAIAAEKPIDIDIINYKKSGEAFWNRLHISPVHNANGRLQHFVSSQLDVTLELSRLVELEKERKTLSIETARSKDQLDYIVEVANIGFWTREFYSGKMTCSAECRRIYGFTPDEPVHFDTILDLVVLEDRMTVVQKAHQAVTGEPYSIEYRIVTRLGETRWLETRAKALTGENPLVLGIVQDVTERKKAEANKALVSREIAHRFKNSMAMVQSIANQTLRNTYDPEQANRLFSERLRALSQAHDMLLKENWAGATIQQICATALAPFNSTFANRIHMSGPHLLVSDRVTVALSLAFYELATNAVKYGALSNEKGVINITWAIMEDKGEKKFHMRWAESRGPEVMQPARRGFGQRLLHSVLAEELKAKCDVEFAASGLLIDVLAPITPEVFPGMGHNVPEQRIA

SEQ ID NO: 18093 - protein, 452 aa, Brucella suis 1330
MNPADEKPYAVISAGSAADIDLAVAAARRAFPAWSETPAEERIAYIRRIAEIYESRLDEMAKTISMEMGAPIKLARESQAAAGLSHTKAFIAACENFEVEEVLSPKYPNQTAVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTSQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 18094 - protein, 340 aa, Brucella suis 1330
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 18095 - protein, 497 aa, Brucella suis 1330
MTQENKMGKHENKAGGASLLHYGNFIAGQWQDAVGGEHITLKNPSDGSDLAPIARGAKADIDLAVVAARSALSGDWGKLTATERGRILHRISEEVLKNIDLLTDLESKDVGKPVTQARADVVALARYLEFYGASADKVHGDTLPYQNGFTVLSIYEPHGVTGHIIPWNYPMQILGRSLGAALAMGNAAVVKPAEEACLTILEFARIAEKAGLPKGALNVVTGFGAEAGAALCEHPDVNHISFTGSVRTGEVVQAAAAKNTVPVTLELGGKSPQIVFADADLDRALPFLVNAGIQNAGQTCSASSRILVERSIYEEVIARMSERYRALKVGPASADLSVGPVVSQRQKAIVDGYLDLAKESGLAIAAQGVLAEGAPEGGAYVLPTLIRDVPADHRLAQEEIFGPVQVILPFDTEEEAIAIANGTHYGLVCGIWTNDGGRQFRLAHAIHSGQVFINNYGAGGGIELPFGGVKKSGHGREKGFEALYGFASLKTISVYHG

SEQ ID NO: 18096 - protein, 406 aa, Brucella suis 1330
MALLDGKRILLIIGGGIAAYKTPDLIRRLRERGAHVRPLMTAAAQQFVTPLTIGAVSADHVFTDLFSREDEQDVGHIRLAREADLIVVAPATADLMAKMANGLADDLASAVLLARKVPLLIAPAMNPAMWDNPATRRNRLTLEKDGVRFIGPEKGEMAESGEAGTGRMSEPLAIVAAIENLLSPQAKPLAGKTIVMTSGPTYEPIDPVRYIANRSSGKQGHAIAAALARLGATVHLVSGPVNIPDPEGVDVIHVETAREMQAAVERHLPADAAVMVAAVADWRSANEAGQKIKKKPGKGAPVLAMVENPDILAGIGHSKKRPGLVVGFAAETQDVAENARAKLEKKGADWIVANDVSHGPGKDGVMGGDRNRVRILSHSGIEEWPEMSKEDVAERLAEKIAASLLG

SEQ ID NO: 18097 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 18098 - protein, 468 aa, Brucella suis 1330
MKQYTLLIGGEHVATPNHAEVRNPSTGEVVGLMPLASEADLDRAVAAAANAFQTWSRTGDAERAAACRAIANKLSEDAEELARLLTLEQGKTFNGLGSRFELGGAMAWTRHTAELGLPVEVVQDDNEGRVEIHRKPIGVTGSITPWNWPVMIACWHIIPAVRTGNTVVIKPSPLTPLSTIRLVEIINEVLPAGVVNVVTGENSIGAALSAHPGIAKMTFTGSTETGRKIMASAAATLKRLTLELGGNDAGIVLPDADPARIAEGLFWGAFINSGQTCAALKRLYVHDHIYDDVCRHLTEYAANIIIGDGLDEKSVLGPVQNAMQFNKVRELVDDARAKGARIPIGGEAAEGPGYFYPITLVADIDNGTRLVDEEQFGPVLPIIRYSDIDEVIRRANDNPSGLGGSVWSSDVEKARAVALQLECGSVWINKHGAIQPNAPFGGVKQSGIGVEFGTDGLKEFTTIQTVLS

SEQ ID NO: 18099 - protein, 504 aa, Brucella suis 1330
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVECMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 18100 - protein, 492 aa, Brucella suis 1330
MQDKIDRLRQQAVPPQSLFINGRWQPAADGNVMAVISPIDGTQLTTIAAATAIDVDRAAAAARHSFEKGTWAKAAPAERRKVLLKIAELIERNALELAVLGVRDNGTEISMALKAEPGSAANSFRYYAEAIDKVYGEIAPTAENILGLVHRAPVGVVGAIVPWNFPMMIGAWKIAPALAAGNSIVLKPAEGASLSLLRLAELCAEAGLPEGVLNVVTGAGPVTGEALGLHPDIDVLAFTGSGFVGRKLLEYSARSNLKRVHLELGGKSPNIVFADAPDLAQAAKVSAYGIFRNSGQVCVAGSRLLVERSIAGEVAEKVSTIAAAIKGGDPLGLTTEAGAISSEAQLRKNLDFAEQALSEGAGLRTGGKRILEETGGFYMQPTVFNVEPGMTLAREEVFGPILSIIPFDNEEDALKIANDSDYGFASAVWTSNLSRAHRMVRGIRAGVVHVNTYGGADNTVPLGGVKQSGNGHDKSLHALDKYIDLKTAWIQL

SEQ ID NO: 18101 - protein, 387 aa, Brucella suis 1330
MAGVTREQVLERLKTVTGPDFKSDVVSLGLVSDIFIADGKVFFSITVPAERAEALEPMRLAAEKVVKDIPGITGALVTLTAEKKGGRTSDDAPPPPRPQARPAAASQHRHPPQPRPAAKPGVPGVGAIIAVASGKGGVGKSTTAVNLALGLAANGLKVGILDADIYGPSMPRLLGLSGRPETVEGRILKPMENYGIKVMSMGFMVDEETPMIWRGPMVMSALTQMLREVAWGELDVLVVDMPPGTGDAQLTMAQQVPLAGAVVVSTPQDLALIDARKGLNMFRKVDVPLLGIVENMSYFIAPDTGTRYDIFGHGGARREAERLNVPFLGEVPLHMDVRAYSDNGTPITVKEPDSEHAKIYRDIARKVWENMKSGKGAGKPAPEIVFD

SEQ ID NO: 18102 - protein, 268 aa, Brucella suis 1330
MSPDSNTDNSRPGVSSSEIPRTDTERKTLVLTGASRGIGHATVKRFSLAGWRVITCSRQDFSENCPWPAGPEDHIKVDLSDPEDIGKAIAEIRRRLEANGSKLHALVNNAGISPKAEGGRRMNSIETPMAVWRDVFQVNFMAPIMLARGLFKELEAAQGSVVNVTSIAGSRVHPFAGTAYATSKAALAALTREMASDFGPYGIRVNAIAPGEIDTAILSPGTDKLVEQLPMRRLGKTSEVAETIYFLCTEASSYVTGSEIHINGGQHV

SEQ ID NO: 18103 - protein, 1261 aa, Brucella suis 1330
MASSLDDLFGATAAKPDGSEVLAALTQAARERILILDGAMGTQIQGLGFHEEHFRGDRFATCDCQLQGNNDLLTLTQPKAIEEIHYAYAMAGADILETNTFSSTSIAQADYGMEAMVYDLNRDGARLARRAALRAEQKDGRRRFVAGALGPTNRTASLSPDVNNPGFRAVTFDDLRIAYSEQIRGLIDGGSDIILIETIFDTLNAKAAVFATEEVFAEKGVRLPVMISGTITDLSGRTLSGQTPTAFWYSLRHARPFTIGLNCALGANAMRAHLNELSGIADTFICAYPNAGLPNEFGQYDETPEAMAAQIEGFARDGLVNVVGGCCGSTPDHIRAIAQAVAKYEPRKPAKVPPLMRLSGLEPFTLTKDIPFVNIGERTNVTGSARFRKLVKAGDFAAALDVARDQVANGAQIIDINMDEGLIDSEKAMVEFLNLIAAEPDIARVPIMLDSSKWEVIEAGLKCVQGKAVVNSISLKEGEEAFLHHARLVRAYGAAVVIMAFDETGQADTQARKIEICTRAYKILTEQVGFPPEDIIFDPNIFAVATGIEEHNNYGVDFIEATREIVRTLPHVHISGGVSNLSFSFRGNEPVREAMHAVFLYHAIQAGMDMGIVNAGQLAVYDTIDAELREACEDVVLNRPTKTGESATERLLEIAERFRDSGSREARTQDLSWREWPVEKRLEHALVNGITEYIEADTEEARLAAERPLHVIEGPLMAGMNVVGDLFGSGKMFLPQVVKSARVMKQAVAVLLPFMEEEKRLNGGEGRQSAGKVLMATVKGDVHDIGKNIVGVVLACNNYEIIDLGVMVPSQKILQVARDEKVDIIGLSGLITPSLDEMAHVAAEMEREGFDIPLLIGGATTSRVHTAVKIHSRYERGQAVYVVDASRAVGVVSNLLSPEGKQAYIDGLRNEYAKVAAAHARNEAEKQRLPIARARANPHQLDWENYEPVKPAFTGTKVFETYDLAEIARYIDWTPFFQTWELRGRYPAILEDEKQGEAARQLWADAQAMLRKIIDEKWFTPRAVVGFWPANAVGDDIRLFTDESRKEELATLFTLRQQLTKRDGRPNVAMADFVAPVESGKQDYVGGFVVTAGIGEIAITERFERANDDYSAILVKALADRFAEAFAELMHERVRKEFWAYAPDEAFTPEELISEPYKGIRPAPGYPAQPDHTEKTTLFRLLDATANTGVELTESYAMWPGSSVSGLYIGHPESYYFGVAKVERDQVEDYARRKDMDVEAVERWLTPILNYVPGASKDEAA

SEQ ID NO: 18104 - protein, 505 aa, Brucella suis 1330
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMKKALKRVEAIVQGDPLDPATMIGAQASSEQLEKILSYLDIGRQEGAEVLAGGERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENYLKMLDHYQNTKNMLVSYSPKKLGFF

SEQ ID NO: 18105 - protein, 477 aa, Brucella suis 1330
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAVTFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 18106 - protein, 481 aa, Brucella suis 1330
MPAIGFIIDGKESGGASGKTFERKDPITGKVATVAAAASLADVDTVAEAAAKAFESWSETGPNARRALLNKAADLMDSRTAEFTRLMLEETGATAPWAGFNVHLGANILREAAALTTQITGEIIPSDKPGIMSMAVRQPVGVVLGMAPWNAPVILGVRAVAAALACGNTVILRSSETCPGVHHLIIKILNDAGFPAGVANVISNAPDDAPEIVAALIAHPAIRRINFTGSTQVGRIIARRAAGHLKPVLLELGGKAPFIVLEDADLDQAVDAAAFGAFMNQGQICMSTERFIVHEKVADAFAEKLAAKARSLPAGDPRGNVVLGSLVDLKSAQRMDALIADAVAKGGRVLAGGKRDGAVVEATIIDGVTPQMDIYTQESFGPVKPIIRVKSAEEAIRVANDTEYGLSSAIFSQNVKRALALSRKLETGICHINGPTVADEAQVPFGGVKSSDYGRFGGKAAINEFTELRWITIEGPQHYPF

SEQ ID NO: 18107 - protein, 290 aa, Brucella suis 1330
MDSIETLVIPRTSDIGGLEVRRALPTARRRLVGPFIFFDRMGPAILRDGEALDVRPHPHIGLSTVTYLFDGHIRHRDSLGTEMVIRPGDVNLMTAGRGIVHSERSPEEERAGPMPISGVQTWLALPDAMEEIDPAFHHINASDLPLMDDAAFSGRLIIGSLHGLSSPVIQHAETLYADIRIHQGGRFQIPPTTEERAIYTLEGNVGIGGEVFPPDRLLAFRPGDDIVVQAGPEGAHIMLFGGAPLGSRRYIWWNFVASSKERIEQAKEEWRTGRFDIVPGDEQDFIPLPE

SEQ ID NO: 18108 - protein, 643 aa, Brucella suis 1330
MSRPSTPLLDKAPTPDRLRALPEQDLPQLAEELRTELIDAVSTTGGHLGAGLGVVELTVALHHVFNTPYDRIIWDVGHQAYPHKILTGRRDRIRTLRQAGGLSGFTKRAESEYDPFGAAHSSTSISAGLGMAVASELSGEKRNVIAVIGDGSMSAGMAYEAMNNAGALDARLIVILNDNDMSIAPPTGAMSAYLARLVSGRTYRSVREAAKQVAQKLPKFLQDKARKSEEYARAFFTGGTLFEELGFYYVGPIDGHNLDHLLPVLKNVRDTQKGPVLIHVVTQKGKGYAPAEAAADKYHGVNKFDVITGKQAKPPANVPSYTKIFGTSLIEEARHDDKIVAVTAAMPTGTGLDLFGEAFPKRVFDVGIAEQHAVTFAAGLASEGYKPFCAIYSTFLQRGYDQVVHDVSIQNLPVRFPIDRAGLVGADGPTHAGSFDTGFLAALPGFVVMAASDEAELRHMVRTAAEYDEGPISFRYPRGDGVGVDLPERGSVLEIGKGRIVREGTKVALLSFGTRLQECLAAAEELGAAGLSTTVADARFAKPLDHDLIRRLAREHEVLVMVEEGAVGGFGSHVLQFLATDGLLDRGLKVRALTLPDIYQDHGKPDAMYAEAGLDRTGIVRTVFAALHRDELGHEALPTPFRA

SEQ ID NO: 18109 - protein, 887 aa, Brucella suis 1330
MAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEACIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALAKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVGLKAELDFVKARIDAVAKEVMSEAGIKIDYMVGTMIELPRAALRAAEIAESAEFFSFGTNDLTQTTFGISRDDAAGFLTTYQNRGVIEQDPFVSLDVDGVGELVQIAAERGRKTREKIKLGICGEHGGDPASIAFCEKTGLDYVSCSPFRVPIARLAAAQAAVRKV

SEQ ID NO: 18110 - protein, 369 aa, Brucella suis 1330
MRVLHFFKTYWPDTFGGIERTIHAIAKGVAEHGIASDVLSLSAKPEENTRNFDGHMAYKAKLDLEFASTGLSRDVFSRFRELSSQADVIHYHFPWPMSDIVQIGVRPDKPTIVTYHSDIVKQKLLLQFYRPLMNRFLGSVDRIVATSPNYLATSDVLQRFSDKTTVIPLGLDESDYSAADATTKARWRERFPRPFFLFVGVLRYYKGLRTLLAAARTSDIDIVIVGDGPMKPQLIAYANEHNLSHVHFAGALPDTDKTALLELSAGLIFPSHLRSEAFGLSLVEASMFGKPMISCEIGTGTSYVNLNGQTGIVVPPQNPEALSAAMRSIAHDTEQAKVFGMNARARYIEHFTADKMALEYAKNYTSLMQ

SEQ ID NO: 18111 - protein, 487 aa, Brucella suis 1330
MKAQPKASHFIGGAFVEDKAGKPLPVIYPATDEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 18112 - protein, 609 aa, Brucella suis 1330
MNVIHLKAAQIVRNSLHGLACFHDRFCRRWVATPDAASIRVIGAVFTLPFLLCAAVAASGVAAGLTDFAILAGSFTGVAMIFCALSLMGLRAGILGALNFAAYGAGLATIGAFSNGNAALWLMAAGLPLEIWFASRKPGSTIAGSLAAMAILAFLAVKTGGTISGGSLISGAILLLYAASLVLRGVAVARKPVQISVAAPQVAVAAGDMQFGLDIEGIVSSVDGETAKLLGVQPKMLEGTALIDRVHVADRVQYLSLLADLRAGMATRKVDVRLRSIENGNPVFRAYRFEGAGSDRAITLIGRSLEGEQKLLDEIAMLKAELESERIGKGRLLATVSHELRTPLNSIIGFSDMLTHEIGGKLASDRQREYAGLIHQSGHYLLELVNAVLDNSRLETGTYSIAPQSFVFRDAVEMCTAVMLPQAEKKGVAFCHRVGNGVGELVADRRAVQQILLNLATNAVKFTQSGGCVTIDAARVMADGCPMLEFSVSDTGIGIEPEDLQRIGTPFVRAGNSYTQAQEGSGLGLSVVKGLVELHQGSMQLKSRPGEGTVVMIRLPLAGPQYRAGEEQQELGTVIDMYRHQGERRNDWQKDEIRDQSPEQPHAQTRKTA

SEQ ID NO: 18113 - protein, 206 aa, Brucella suis 1330
MLKIWGRTNSTNVKKALWAAQELNLEYEQIDLGGQFGGLNDPVYLARNPNGLVPLLEDGETILWESNVIVRYLAAAYGKDSLWIENPAKRAQAEKWMDWVSTTIAGDFRDVMMHLIRLPAKQRDPAKLKHGIEGLECSMRIADAGLADQPWFSGADFGIGDIPLGCYAYGWLQFPIERPSLPRLEDWYHRLQQRTAYRAAVMTPLT

SEQ ID NO: 18114 - protein, 461 aa, Brucella suis 1330
MPIEILMPALSPTMEEGKLSKWLKKEGDKVTSGDVIAEIETDKATMEVEAVDEGTIGKLLVDEGTEGVKVNTPIAVLLGDGESAADIGSAPAAKAEAAKEEPKAEENKADAVPAAPKAPAVEVASDPDIPAGTEMVSMTVREALRDAMAEEMRRDPDVFIMGEEVAQYQGAYKITQGLLDEFGPKRVVDTPITEHGFAGVGVGAAFAGLKPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGNDATIVSFGIGMTYAVKAAEELAGQGIDVEIIDLRTIRPMDIPTVVESVKKTGRLVTVEEGFPQSSVGTEIATRVMQQAFDYLDAPILTIAGKDVPMPYAANLEKLALPSVAEVVEAVKAVTYTA

SEQ ID NO: 18115 - protein, 425 aa, Brucella suis 1330 [sequence omitted]

SEQ ID NO: 18116 - protein, 266 aa, Brucella suis 1330
MNAGLDQVDPIWHSIRAEAEEATRNDPVLGAFLYATILNQPSLEEAVMHRIAERLGHPDVSADILRQTFDTMLEANPEWSHVLRVDIQAVYDRDPAYSRFMDPVLYLKGFHAIQAHRLAHWLYKQGRKDFAYYLQSRSSSIFQTDIHPAARLGSGLFLDHATGLVVGETAVVEDNVSILHGVTLGGTGKSSGDRHPKIRQGVLIGAGAKILGNIQVGQCSKIAAGSVVLKSVPHNVTVAGVPARIIGETGCTEPSRVMDQMLGDGI

SEQ ID NO: 18117 - protein, 328 aa, Brucella suis 1330
MAKTAEQHPHGLDRILTLELVRVAERAAVAAARLRGRGDEMAADQAAVDAMRQELNRLPITGTVVIGEGERDEAPMLYIGEEVGTKQGPAVDIALDPLEGTTICAKNLPNSLAVIAIAEKGNLLYAPDVYMEKIAVGPGYPKGVVDLDATPTDNIMSIAKAKGVKPNEITACIMDRPRHARLIEEVRATGAAIRLIGDGDVAGVMHTTDPDETGIDIYIGIGGAPEGVLAAAALRCIGGQMQGRLQLNTEEKVARAAKMGISDPKKIYTLEEMAKGDVLFAATGVTDGNMLSGVKFARDYIQTHTIVMRSSSQTVREIKARHQDLSKF

SEQ ID NO: 18118 - protein, 1035 aa, Brucella suis 1330
MSGSYPFIDIAALDSVREGFARGDAQLVLAHDLSTVLWVNGPGAKLFGYNRVEDLIEGQLDLPVATRRQIAAFSSENTSAPSAVAVRLGGGLRSELTHLHVSNIKLPDGVAALLVATQMPDNSAEAAISGLGDDSTHIALVDAVGKVVAASPRFALLDISASTLEDLIVEAGDATDRIVKRRIRTGSHSVPGAIARLTDTPALHLLCIVGDAPAQFQTAAEAVPLPDNAEAVLEEILPEQGDAPAQQAQKTHAEQPRPKTFAFDHDAPPARFIWKVGPDGTFSEISPDLAAVVGPNSADIVGRRFSDVANVFGFYTDGSIAALLLERDTWSGKRLLWPVEGTRLRVPVELAALPVYSRDREFLGFRGFGIVRPAEAEADPEEIGLALAGGIPQNRKPRKEPAETARMVGEDDVLALSEEVANDDQPAAVLPKPPLDITPTPGRRDSDKVISLLNSCAQEKVAADQAKFLKEKERATRPEGGLTKTERNAFREIAERLRKQGLANTRAESETPVSETSSIEPVEPTPPVKTRSEPIQPDETALLANLPVPVIIHSGDAIHYVNQALLDITGYESLDDIRSAGGVDVLFNSESDDGETRQSMVLRHADGSEEPVDAHLNAIAWRGGRALMLSLMPVTAADLPAPAELPAANDEEKQALEAHVEELKTILDTATDGVVLIDPEGRIRSMNHSASALFGYERDEAEGKFFSMLFAIESQRAAMDYLHGLSGNGVLSVLNDGREVIGREAKGGFIPLFMTIGKLPHTRGFCAVLRDITQWKRTEEELTNARKEAERASNQKTEFLARISHEIRTPLNAIIGFSELMADEKFGPIGNDRYRDYLRDINRSGNHVLALVNDLLDISKIEAGALDMQFEAVSLNDAIGEAIALMQPQANRERVIIRSSFQSNLPDIVADSRSIKQVALNLLSNAVRFTAPGGQVIVSTSYELNGDVVMRVRDTGIGMSKSEVEQALKPFRQINALEGRKAESAKDWRNEGTGLGLPLTKAMVEANRAQFAIDSNPGQGTVVEIVFPPTRVLAD

SEQ ID NO: 18119 - protein, 255 aa, Brucella suis 1330
MSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 18120 - protein, 483 aa, Brucella suis 1330
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGVLAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKR

SEQ ID NO: 18121 - protein, 303 aa, Brucella suis 1330
MAQMKLPSITSGDGGLTRYLEEIRRFPMLEPQEEYMLAKRYHEHADPKAAHKLVTSHLRLVAKIAMGYRGYGLPIGEVISEGNVGLMQAVKRFEPERGFRLATYAMWWIKASIQEYILRSWSLVKMGTTANQKRLFFNLRKMKSKIQALDDGDLNPDQVKQIATKLNVSEDEVVSMNRRLSGDASLNAPLRASEGESGEWQDWLVDDSNSQEQVLIEQDELESRRSMLEQAMETLNDRERRIFEARRLAEEPMTLEDLSGEFGISRERVRQIEVRAFEKVQAAVKAAAHKQQKALNHIEEAHV

SEQ ID NO: 18122 - protein, 311 aa, Brucella suis 1330
MKPSSMSSSSTVPANRMPMAVRSFPAAAASSQSMIRSAMSAPYLEREEERALAIRWKETKDQDALHRITSAHMRLVISMAGRFRKFKLPMSDLIQEGYVGLLEAAARFDPDRDVRFSTYASWWIRASMQDYILRNWSIVRGGTSSAQKALFFNLRRLRSKLAQTDDNMTKAEIYREISDQLGVSTSDVEFMDSRLSGPDSSLSAPMNGEETGASRRMDFLVDDHPLQDEIAESSIDMERRNCWLTRALDTLNERELHIIRERRLDDDGVTLEALGEKLGISKERVRQIESRAMEKLKIALLSQHELAAYQA

SEQ ID NO: 18123 - protein, 421 aa, Brucella suis 1330
MNHFEYRNGVLHAENVSLPEIAKAVGTPFYVYSRATIERHFRVFHDAFADMDTLVTYALKANSNQAVLTALAKLGAGADTVSQGEIRRALAAGIPANRIVFSGVGKTPREMDFALEAGIYCFNVESEPELEILSARAVAAGKVAPVSLRINPDVDAKTHAKISTGKSENKFGIPRDKARAAYARAASLPGLNVVGIDMHIGSQIIDLEPFDNAFALMAELVKELQADGHNIRHVDVGGGLGIPYRTDNTPPPPPVAYAQIVAKHIKPLGLKTVFEPGRLIVGNAGLLVTEVIFVKEGDAKNFVIVDAAMNDLIRPTLYDAFHDIRPVIMPNDNAPRIRADFVGPVCETGDYLGLDREVAKPAPGDLIAICTTGAYGAVLSSTYNSRLLIPEVLVDGERYHVVRPRRTYEELLALDSVPDWL

SEQ ID NO: 18124 - protein, 254 aa, Brucella suis 1330
MGEFAVVTGGSTGIGRHLVSAFADAGYAVAFSYRHDDDAAQSLVEAIEEAGGQALGLGCDVGRRAEVEAFFDEACDWFGDAPDVLVNNAGIQTWAPLLELSEEGWDDVIRTNLKGCFLNTQAAAKRMVEADKGGAIVNIGSGCNKLAFPKLVSYTASKGGIEQLTKASAVELGPHGIRVNCVAPGAILNERTAQEQPDYAQSWAPITPLRRVGVPEDISGPVLFLVSDEARFVTGQTLWIDGGLFSQANWPYDG

SEQ ID NO: 18125 - protein, 506 aa, Brucella suis 1330
MVMSTIVKPQPLTGLEVREFSMLIDGKWVGSDSGKSIERVAPGHGVTVSRYPAGNKADVERAVSAARKAFDDGRWSSTTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 18126 - protein, 466 aa, Brucella suis 1330
MTASQDFVVKDISLADWGRKELDIAETEMPGLMAAREEFGKSQPLKGARISGSLHMTIQTAVLIETLKVLGAEVRWASCNIFSTQDHAAAAIAATGTPVFAVKGETLEEYWTYTDQIFQWPDGEPSNMILDDGGDATMYILIGARAEAGEDVLSNPQSEEEEVLFAQIKKRMAATPGFFTKQRAAIKGVTEETTTGVNRLYQLQKKGLLPFPAINVNDSVTKSKFDNKYGCKESLVDGIRRGTDVMMAGKVAVVCGYGDVGKGSAQSLAGAGARVKVTEVDPICALQAAMDGFEVVTLDDAASTADIVVTTTGNKDVITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTVLSEEQAAYIGVTPQGPFKSEHYRY

SEQ ID NO: 18127 - protein, 859 aa, Brucella suis 1330
MPELGLLGSVRKTSATVKGRPAMKGKHRLAAFTLAAKSLWQTALKASVSVSALFAASPAFAQGMDGARISMPFGGSVGAFEVIQFSIFLGAMGAALLSAGWLIRDRSKIANENNELRSKFADLNLIAQRNEALLNMKDQRIVVWDGHNVRADVVGQLPDACGAPQDRPAFLAFGRWLRPQSVTALERAISTLREQARAFDLTVETVNGSLLDVHGRTSGGFAVACFQSLQGVQAERASLEAQNRELADRIELMRRLLDRIEQPAWLRDGNGRIEWVNLAYAQAVDMANASQVISEGRELFGAQARQRLERDRFAEPVVQEQLTAVVHGDRRVFDVIDVSAESGSVGLGFDLTEVQAVRDELSRTLKSHAETLDQLSTAVAIFDPEMKLQFFNQAFVKLWGLDVAWLETRPSNTLIFDRLRAEGKLPEQPEWRKWKDSLLSAYRAVEPEEHMWHLPDTRTMRVVANPHPQGGVTWFFENMTEKFELEGRYNTLIKVQGETLDHLAEAVAVFGSDGRLRLSNPSFAALWSLPSEMVREGTHISIIAKLCNQRGGDGLWEDFVSTVTGFLDQRDGRMGQVELSDGAILSFAVVPLPKGQTMLTFIDVTDTVRVERALKEKNEALELADQIKNDFVQHVSYELRSPLTNIIGFTELLQTPAFGSLNERQLEYLDHISTSSSVLLTIVNDILDLATVDAGIMELEIGDVSVVEAISAAASRVSERLRDHNIGLDVDIADDVDVFKADANRVRQVLFNLLSNAVNYAPEGSNIVLQVARDGADVVFAVHDDGHGMPSEVLDTVFKRFQSYPNGGRRRGAGLGLAIVKSFVELHGGRVEIDTGEERGTTVICRFPSEARSFRAAAE

SEQ ID NO: 18128 - protein, 532 aa, Aspergillus oryzae
MVAGGGVVSSSGMDAYRALPNNTNSNWFKDKGLRRLNFGLMLMFASAAANGYDGALMNGLLTLPMCKFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLGTFYVEGSTWSWRIPCLLQCFFPAVQLVGLLIVPESPRWLVSKDRRDEALQILARYHGNCDTSDPLVQFEFSEICSAIELENSVAHKSGWSAFIATKGARHRLAICLLVGVMIQWAGNGTYRAIHLLLSILLIILSLGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIIYFVFPETKGHTLEEIAVIFDGPGAETEVQRDLAAIIAVEREVKAPMKEELEHAP

SEQ ID NO: 18129 - protein, 530 aa, Rhus vernicifera
VDVHNYTFVLQEKNFTKWCSTKSMLVVNGSFPGPTITARKGDTIFVNVINQGKYGITIHWHGVKQPRNPWSDGPEYITQCPIKPGTNFIYEVILSTEEGTIWWHAHSDWTRATVHGALVILPANGTTYPFPPPYQEQTIVLASWFKGDVMEVIISSEETGVFPAAADGFTINGELGDLYNCSKETTYRLSVQPNKTYLLRIVNAVLNEEKFFGIAKHTLTVVAQDASYIKPINTSYIMITPGQTMDVLFTTDQTPSHYYMVASPFHDALDTFANFSTNAIIQYNGSYKAPKSPFVKPLPVYNDIKAADKFTGKLRSLANEKFPVNVPKVNVRRIFMAVSLNIVKCANKSCNNNIGHSTSASLNNISFALPQTDVLQAYYRGVFGRDFPTVQKKANFSLNTAQGTQVLMIEYGEAVEIVYQGTNLGAATSHPMHLHGFNFYLVGTGAGTFNNVTDPPKYNLVDPPELNTINLPRIGWAAIRFVADNPGVWFLHCHFERHTTEGMATVVIVKDGGTTNTSMLPSPAYMPPCS

SEQ ID NO: 18130 - protein, 277 aa, Lotus japonicus
MCEALKSQYQLCEEIGRGRFGTIFRCFHPISTDTFAVKLIDKSLLADSTDRHCLENEPKYMSLLSPHPNILQIFDVFEDDDVLSMVIELCQPLTLLDRIVAANGTSIPEVEAAGLMKQLLEAVAHCHRLGVAHRDVKPDNVLFGGGGDLKLADFGSAEWFGDGRRMSGVVGTPYYVAPEVLMGREYGEKVDVWSCGVILYIMLSGTPPFYGDSAAEIFEAVIRGNLRFPSRIFRNVSPAAKDLLRKMICRDPSNRISAEQALRHPWFLSAGDTVNVT

SEQ ID NO: 18131 - protein, 236 aa, Morganella morganii
SINNCGDWGEYCNYLLNSFDFEKEVMEYFADLFKIPFEQSWGYVTNGGTEGNMFGCYLGREIFPDGTLYYSKDTHYSVAKIVKLLRIKSQVVESLPNGEIDYDDLMKKIADDKEAHPIIFANIGTTVRGAIDDIAEIQKRLKAAGIKREDYYLHADAALSGMILPFVDDAQPFTFADGIDSIGVSGHKMIGSPIPCGIVVAKKENVDRISVEIDYISAHDKTITGSRNGHTPLMMW

SEQ ID NO: 18132 - protein, 236 aa, Morganella morganii
SINNWGDWGEYCNYLLNSFDFEKEVMEYFADLFKIPFEQSWGYVTNGGTEGNMFGCYLGREIFPDGTLYYSKDTHYSVAKIVKLLRIKSQVVESLPNGEIDYDDLMKKIADDKEAHPIIFANIGTTVRGAIDDIAEIQKRLKAAGIKREDYYLHADAALSGMILPFVDDAQPFTFADGIDSIGVSGHKMIGSPIPCGIVVAKKENVDRISVEIDYISAHDKTITGSRNGHTPFMLW

SEQ ID NO: 18133 - protein, 236 aa, Morganella morganii
SINNCGDWGEYCNYLLNSFDFEKEVMEYFADLFKIPFEQSWGYVTNGGTEVIMFGCYLGREIFPDGTLYYSKDTHYSVAKIVKLLRIKSQVVESQPNGEIDYDDLMKKIADDKEVHPIIFANIGTTVRGAIDDIAEIQKRLKAAGIKREDYYLHADAALSGMILPFVDDAQPFTFADGIDSIGVSGHKMIGSPIPCGIVVAKKENVDRISVEIDYISAHDKTITGSRNGHTPLMMW

SEQ ID NO: 18134 - protein, 236 aa, Morganella morganii
SISNCGDWGEYCNYLLNSFDFEKEVMEYFADLFKIPFEKSWGYVTNGGTEGNMFGCYLGREIFPDGTLYYSKDTHYSVAKIVKLLRIKSQVVEAQPNGEIDYDDLMKKIAADKEAHPIIFANIGTTVRGAIDDITEIQKRMKAAGIKREDYYLHADAALSGMILPFVDEPQAFTFADGIDSIGVSGHKMIGSPIPCGIVVAKKENVDRISVEIDYISAHDKTITGSRNGHTPLMMW

SEQ ID NO: 18135 - protein, 236 aa, Proteus vulgaris
SINNCGDWGEYCNYLLNSFDFEKEVMAYFAQLFKIPFEKSWGYVTNGGTEGNMFGCYLGREIFPDGTLYYSKDTHYSVAKIVKLLRIKSRLVESLPNGEVDYDDLIKKITMDKEQHPIIFANIGTTVRGAIDDIALIQQRLKDAGFKREDYYLHADAALSGMILPFVDDPQGFTFADGIDSIGVSGHKMIGSPIPCGIVVAKKANVDRISVEIDYISGHDKTITGSRNGHTPLMMW

SEQ ID NO: 18136 - protein, 236 aa, Raoultella planticola
SISNCGDWGEYCNYLLNSFDFEKEVMEYFAQLFKIPFEESWGYVTNGGTEGNMFGCYLGREIFPNGTLYYSKDTHYSVAKIVKLLRIKSTLVESQPNGEMDYADLIKKIKRDNEKHPIIFANIGTTVRGAIDNIAIIQQSISELGIERKDYYLHADAALSGMILPFVDNPQPFNFADGIDSIGVSGHKMIGSPIPCGIVVAKKKNVDRISVEIDYISAHDKTISGSRNGHTPLMMW

SEQ ID NO: 18137 - protein, 236 aa, Escherichia coli
SISNCGDWGEYCNYLLNSFDFEKEVMEYFAQLFKIPFEESWGYVTNGGTEGNMFGCYLGREIFPNGTLYYSKDTHYSVAKIVKLLRIKSTLVESQPNGEMDYADLIKKIKRDNEKHPIIFANIGTTVRGAIDNIAIIQQSISELGIERKDYYLHADAALSGMILPFVDNPQSFNFADGIDSIGVSGHKMIGSPIPCGIVVAKKKNVDRISVEIDYISAHDKTISGSRNGHTPLMMW

SEQ ID NO: 18138 - protein, 236 aa, Erwinia sp. MB31
SISNCGDWGEYCNYLLNSFDFEKEVMEYFASIFKIPFEESWGYVTNGGTEGNMFGCYLGRELFPEGTLYYSKDTHYSVAKIVKLLRIKSSLVESQPNGEMDYDDLIRKIQRDNEEHPIIFANIGTTVRGAIDNIAEIQQRIGQLGIKRDDYYLHADAALSGMILPFVNDPQPFNFADGIDSIGVSGHKMIGSPIPCGIVVAKRKNVDRISVEIDYISAHDKTISGSRNGHTPLMMW

SEQ ID NO: 18139 - protein, 222 aa, Triticum aestivum; identical to SEQ ID NO: 4761

SEQ ID NO: 18140 - protein, 175 aa, Capsicum annuum
MDLIDKAKNFVSEKVANMEKPEATITDVDLKRIGFDGVSFHAKVSVKNPYSVPIPIMEIDYVLKSASRVIASGRIPDPGNLKANDSTMLDVPVKVPHSVLISLARDIGGDWDVDYTLELGLIIDLPVIGNITIPLSYSGEYKLPTLSDLWKGGKEEEKKKEEEEEKEDPSKVVEI

SEQ ID NO: 18141 - protein, 362 aa, Plasmodium falciparum 3D7
MGRKKRKLNIDLKPFCYYCDREFDDEKILIQHQKAKHFKCLHCNRKLDMANGLVVHMMQVHKTNLKSVPNALPKRNDPELVIRGMNGVPTDIIEENLIKLKQKLGDKNIKRQQRVNWAQVTMAPTMEQFLKQAQMGNFSFPGFNSPVLPTNNNILTNTLDINNKSTLPNIPLYIPNTTSNINNINNINNLLQQPIGNNIIYPPKNSTLLNMPIPPINKNNINNHVVTNPNTFTPSNIPPNIAHKYSANINLLPTNINQHNPMYMPPGLYPPPIPPLNHPSIPPTHIPSSTYPTKMTPIQQKRPSTKWDVPEPSEGDPSILKHNKEDSTENKNEEPHKVSQDDDLKQNEQKDNQEKNHTQNCE

SEQ ID NO: 18142 - protein, 1357 aa, Plasmodium falciparum 3D7
MNLSAKIDSNGYNNNIVEKNDDKRIGRIMSDDENERKDIIYNNEKNKRTSEIKVLKNDMDNNKNDNSIQSKLSFDIKNVLTHAYLPICLEKMKEGEYVYKWNNNIFQKKTLKFFYLDVNNYCIRWNSKKKKLSEKKNPSLYICDIIKILDGSESLFFKKKEDDKNLSIEIISTQRNLRLTFLDIQRWKMWLFGLMYYQYKLVNKGNGKKKMKSFLYESNKLYDNYIISGLKDINALTLSQLYIILRSLNIYLNMQILYHYFSIYKNKAVINYIGFTKILEHIFSNTHISIYFNEYKDKKFNYIDKKKFIEFLIDIQCEGKCEEFIFNNYYQNDTNPNLTREKNTEKLEREKKNDEDDTHYNLDMMQSSAHNNKIYNVNNQMDDISIKYKNEDDVKPKHIFNNDNKENCNKEENNYSKSENNTYFNNDNNNNNKVRNEAIINNYDCNIIKKISNQYINQDDIKYNMDISNTLIFSDNSIIHDEDYFLILDILKSKYFYHDQNKVGNKKNTHDNNYNNYNNNSANASCHHNLKDEKESKLNSNNNNNNNNNNNVDTCINVINKNIPNIYPIKVNVIYKLLNIIKKYNIPFVINNDDNQYLTEIGLVYFLLSKENSIMCPEYAKVYQNMNLPLCNYWINSSHNSYLARKQIFSTSNIEQYIYILLDGCRCVEFDCYYFNKNIVVYHGFYGYKLTSSILFCDTLIACKMFGFTTSPYPIILSLEIHCKNKHKNLIAKILISILGNQLYIPKTTDEINNITPNNCKNKFLVKYKHFENNDSSGFYYLFEGLQSVMYDELNYMSDILDENDELDYDNEDMDVLQQNCQGELLHNDDVDVENFDADEDEYEMEKTFGEYIEKSIEKKYNQDSINHKQLYMKNSDSNNNVSIEKENYEEKHNKFVEDTKKPRNILNIIKKNDNNMDNDSSDNNNNNNVKIPKNSITSCIEKKDKSKDLEEQKKKHILKKTDNFNLKNNNLLNEYSCLKGYVFRNFYETRNYNEICSISENKFIKLIKKNENEIIKYNQKTLTRVYPSGTRLASTNFNPLIFWNAGIQVVALNYQYNGLSMLLNKGRFLENGGKHSGYILKPELLRFNEKQDYNTLLLDLQILSLHQINLLFSIKNKYHEKKLKKKLFQMDMIQRIQTHKKIKKKIKNWKDLQKLEKEKKNILFSDVQSDDNKNKHISYELLLNKINDNDDVNYIHNKCLNVEKKYEDMLTEYKSFLLCSSSLSHSSSFNSCSSNTTTSNDGNKTHSNKNNSSKYKNKNFYQTFEELKKANNLFFYLYLTISIHGYNENKYYFKTEIAKVNFYDINYCWSKPSTFQMKISYPSLALIVFELKAYDTVKSEIIACACFPITICTIVR

SEQ ID NO: 18143 - protein, 446 aa, Plasmodium falciparum 3D7
MAHVITRINAREILDSRGNPTVEVDLETNLGIFRAAVPSGASTGIYEALELRDNDKSRYLGKGVQKAIKNINEIIAPKLIGMNCTEQKKIDNLMVEELDGSKNEWGWSKSKLGANAILAISMAVCRAGAAANKVSLYKYLAQLAGKKSDQMVLPVPCLNVINGGSHAGNKLSFQEFMIVPVGAPSFKEALRYGAEVYHTLKSEIKKKYGIDATNVGDEGGFAPNILNANEALDLLVTAIKSAGYEGKVKIAMDVAASEFYNSENKTYDLDFKTPNNDKSLVKTGAQLVDLYIDLVKKYPIVSIEDPFDQDDWENYAKLTAAIGKDVQIVGDDLLVTNPTRITKALEKNACNALLLKVNQIGSITEAIEACLLSQKNNWGVMVSHRSGETEDVFIADLVVALRTGQIKTGAPCRSERNAKYNQLLRIEESLGNNAVFAGEKFRLQLN

SEQ ID NO: 18144 - protein, 274 aa, Plasmodium falciparum 3D7
MDEENERERLRIRMSLNDLILILSVCYSVGDIFVQWNEFSKCYKPIQLWLVVSFISIVLYRLSHFLAQYLSNDNDDFIIYRRNNPPYYISFLVLFILFPFFFIWNIIGTIWIYQIIKYTPNCLPRNNHPWFIVLWIVLCYIWILLYLFFIILSIYLEYQSRIYERTITNIQTDDIFSRWTDNIDLMRDYGIFIYRNGLRLKQIENLPFYYIKNISNESKCSICLNDFQIDECVRTLLLCNHTFHKSCIDLWLIRSATCPNCKSPIASQGIFMNI

SEQ ID NO: 18145 - protein, 1434 aa, Plasmodium falciparum 3D7
MNGIFEGIEKRVVIKLKESFFKGNRNVNSFLDIPKELWEEKLKYIGCSIVSEISEDKNERRGERCRVYLLSESSLYIFDDSLFIKTCGKTRVLFFIPFVVDLLIYHMDNVGIIEKNCVYDETFIENEKFHNIAEFIKEHFLYCFFTHMNYRNKTKDGYFEQEYPHKSLEDEKKFFEFFFKNVQMYNTHLPMEKMHYIFFYSSDDVHMTDIASTFKFCSEIHLFGINKYNEKNQFHDAYLNNKSLNLFTRVHEDNLKLYDSSDADKEVTTHIYSTRGTYEDTGMVNCVDVIYKNESTLLNRNNIENIPSIENKESNNNSRCCHNNNYSGSCHNIVSVVPSERNNDHVHHRHYEDTLNRSNISAEDNNRNAQLEKEKDEDVRRDDEENKVLIKMIDTNLYECINYNKESFLYNEFYFTPCGYSCNVSEKNNYFCVHYSPEDSVSYVSVEVSSNLSCDRFLDFMHKQLNFYNGKYMFMINYVFCEESNNMSKMVPDDDNNNYSSGKSCVYYQDLNKKEKEEYYRLNKKLRNDLFINSKQFYELHTFTERTVGFMRVQYFVYKLRDVVKCVEKETLLARSSSCLFMFNNIKRNDVHDDYVTKSSNGGVIKQLTERDVDDMYEYALNFCKQNKIVVVDTNTFFDASKRKENLIKLEKVQTNEKDEYEEKDEVYRRGNNELSSLDHLDSKNNLIHMYYEKNKCDIINKDDENSTIATNNNDNNNDNNNDSSSYDKSITISRSSSCNNSHLSYSSFDNNHGNEKMKDYISVDENNNNNNNNNNNNNNNNNKNNNVLLTLQRNSDDENGKDKDNEKNDVSLENNMEKNYKEEIWNYYTKNKVEVKTLEKVLNENIDTSVVCINLQKILAQYVRFKKNLPHVTPFYSVKSNNDEVVIKFLYGLNCNFDCASIGEISKVIKLLPNLSRDRIIFANTIKSINSLIYARKENINLCTFDNLDELKKIYKYHPKCSLILRINVDFKNYKSYMSSKYGANEYEWEEMLLYAKKHNLNIVGVSFHVGSNTKNLFDFCLAIKLCRDVFDMSSNMGFNFYIINLGGGYPEELEYDNAKKHDKIHYCTLSLQEIKKDIQKFLNEETFLKTKYGYYSFEKISLAINMSIDHYFSHMKDNLRVICEPGRYMVAASSTLAVKIIGKRRPTFQGIMLKDLKDHYDPLNFAQQENKKQDETKINHNNDNNDNNDNNDNNDNNINNNNNNQKGGQGNIMNDLIITSTNDSTNKKNDHSSSQVIQNVSCTIRDKEGDNIKINTHTINNPNINGKENTVDGDNINIAHKNIGNNFSSSNSKLGNITNIKKKVVNINDNRYNYFSYYVSDSIYGCFSGIIFDEYNRCPIYVIKNKNNPNQNFMNFNLYLANVFGQSCDGLDMINSITYLPECYINDWLLYEYAGAYTFVSSSNFNGFKKCKKVYIFPESKPSLKGQPNKHW

SEQ ID NO: 18146 - protein, 301 aa, Plasmodium falciparum 3D7
MSSDIKTNFAADFLMGGISAAISKTVVAPIERVKMLIQTQDSIPEIKSGQVERYSGLINCFKRVSKEQGVLSLWRGNVANVIRYFPTQAFNFAFKDYFKNIFPRYDQNTDFSKFFCVNILSGATAGAISLLIVYPLDFARTRLASDIGKGKDRQFTGLFDCLAKIYKQTGLLSLYSGFGVSVTGIIVYRGSYFGLYDSAKALLFTNDKNTNIVLKWAVAQSVTILAGLISYPFDTVRRRMMMMSGRKGKEEIQYKNTIDCWIKILRNEGFKGFFKGAWANVIRGAGGALVLVFYDELQKLI

SEQ ID NO: 18147 - protein, 245 aa, Plasmodium falciparum 3D7
MENSDSNKDLQDSKSDKSTSWVKWFNNRALSNFLVEVDNEYITDSFNLYGLKTEIPNFNHLLSIIAGDAPEDDDDSKNSFSKDCICLYSLIHARFITTPKGLSLMKDKYIKGDFGTCPRVSCAQHNVLPIGLFDQMKIAKVHVYCPLCQEIYKIHEDEKVYLDGSFFGTSFPHILLQTYPYYATLKTPPYCSSKIFGFNVYHNFTRTEYKLAKGEFGIITRENFLKKNPKYFKKLRKEELQISET

SEQ ID NO: 18148 - protein, 103 aa, Plasmodium falciparum 3D7
MSGRGKGGKGLGKGGAKRHRKILRDNIQGITKPAIRRLARRGGVKRISGLIYEEIRGVLKVFLENVIKDSIMYTEHAKRKTVTAMDIVYSLKRQGRTLYGFGG

SEQ ID NO: 18149 - protein, 643 aa, Plasmodium falciparum 3D7
MHIHKLKKKIKKKKEGKYLTKKHILRKLFLNEEEFRKLCIFKGIYPKDFKEIPLKYRKKFYKHKVFYTRNDFLKLSHEKIINDFRKIKIYLKKYKKCKLTLEDFTRSKNIVANFPVYKLEHIIKERYPILSYAVDHLDDALSCIIAYSQLPSNHKYGIKNNMVKTCEMLKDHFHYYVYKTNRIKKAFISVKGYYLQAEILKKKVTWIIPHIFTPYLDTSIDFKLISDFIEYYIALLKFVLFKLYKLDNMLYPPKQDNDLKNEKLAHLSYDKDYSTNENNIDINMNQELQSKCNVNTNEDLNTCQEKTKEKNHKSDNNPHEHTTNIDNNNFNNIHLQDNCDLNKNEGKNLTNNIIHKNSEADNGHVHPDDHIDIDEHNKLKELFKNHIFYIHNDMPFDVLSIIILSCGGKISWNSRISPIHYDDNNITHEIYEKDKNTIHLNNPENEYKRIHIQPQYIFDCLNEKNILPCSDYLTEKENLPVHLSPFIEDENFKNLVKKEEYTINKMLNQKIKEEQYKDFSKENNNIFKSPNYKEEEEEENDDRETANLILNNKRQAALNNQLERENEDINQLKENDTILNKQTDQTQILKTQNLKSQEQEIQRHKIVLSKKKRKLFARIDMAQKRQKATIDKFMKKINKNKSK

SEQ ID NO: 18150 - protein, 335 aa, Plasmodium falciparum 3D7
MSVSSINKKIYIPKFYADVNIHKPKEYYDYDNLELQWNKPNRYEIMKKIGRGKYSEVFNGYDTECNRPCAIKVLKPVKKKKIKREIKILQNLNGGPNIIKLLDIVKDPVTKTPSLIFEYINNIDFKTLYPKFTDKDIRYYIYQILKALDYCHSQGIMHRDVKPHNIMIDHENRQIRLIDWGLAEFYHPGQEYNVRVASRYYKGPELLIDLQLYDYSLDIWSLGCMLAGMIFKKEPFFCGHDNYDQLVKIAKVLGTEDLHAYLKKYNIKLKPHYLNILGEYERKPWSHFLTQSNIDIAKDEVIDLIDKMLIYDHAKRIAPKEAMEHPYFREVREES

SEQ ID NO: 18151 - protein, 508 aa, Plasmodium falciparum 3D7
MLKKKKDYENADLEDCNTKEIKGYSKVGSEKNIKKKMTSIKESSSRDEEEEDANVNKNIKKFKEGNKKDNISKNCNIVEKKNNKSKEEKINIKEAIIKNVKVPDNYEIKHLIGRGSYGYVYLAYDKNANKNVAIKKVNRMFEDLIDCKRILREITILNRLKSDYIIRLHDLIIPEDLLKFDELYIVLEIADSDLKKLFKTPIFLTEQHVKTILYNLLLGEKFIHESGIIHRDLKPANCLLNQDCSVKICDFGLARTINSDKDIHIVNDLEEKEENEEPGPHNKNLKKQLTSHVVTRWYRAPELILLQENYTNSIDIWSTGCIFAELLNMMKSHINNPTNRFPLFPGSSCFPLSPDHNSKKVHEKSNRDQLNIIFNVIGTPPEEDLKCITKQEVIKYIKLFPTRDGIDLSKKYSSISKEGIDLLESMLRFNAQKRITIDKALSHPYLKDVRKENLENFSTEKIILPFDDWMVLSETQLRYIFLKEIQSFHADLIIPAKLNIHQKSFYNM

SEQ ID NO: 18152 - protein, 1617 aa, Plasmodium falciparum 3D7
MVLEILKNNYKGNGENYYNKNKKHQKKNKGKINVLDDDEYDNENDDKNVDSANNSELCYLYEIYKNGFNKEENNGIILSHKNNKKGLIYKNKINALYDNSKEMLHYRNQENEENDIFEEDIYENDNFDDNNFVEEENVEYKTYNSFTNEEANMLNNYSRVNIKNILDSHNINKRELYNKHNNNNGDNNNANKKKNDQKNFNKDDSNIREYSKNNNITRNLYKKNLLYFHEKYNEKDKSTYEYHIDACDNFYEYGDEYNSNHKSKGKNIFEIKDVNIDRKGTKKFQKLDKNKETTKDMDYDYYDEDNVDYEDDNVEGEDDNIEDEDDNIEDEDDNIEDEDDNIEVEDDNVDDEDDNVDDEDDNIDDEDDNVDDEDDNVDDEDDNVDDEDDNVDDEDDHISDEDYKDDKEDNYIKYNENDNVNDDEDNYYDEEENNYNNDDNYDEEIKDFNKYLKNNDKEESIKNDVNKELSHFNFNNDLKQKYIDVKGFKNENIFNFKNIIKEDNNTLKREELFSFGNGKKLYNREENKIEVATFGMCNKNEWFEKYDVKIENCKKYNNYKNENNDNKNKNPFGFKGLDKHIEEKEEYDKMYMDGNNYMKGKLIGNISPKIQRSHTDNNIENYISDSENMNTYNIMNEVNRVLPYNNINNNINNNNNNNKLIYNQGDTLNSIEHTNNISKYTTVDYSNDILKTGKETYKELTKRKNEEICELLNSEDKKKHNIKHFLDKMKSKKHIEDFFKKEDKICERSEKKEKLKIKFTDILHAGAFGHFFHRNKNGLSRSFVSSDVKRNNSFNSINKINKKDQLKYNTLEKYETKIGAFDESKLGNVRNDKTVSYNQIECKNSINYNSKTELNIDKNKDFNFDKNKWYKMNDNEEKIHFLKFPNGLLDNDKKKELKSNDNGIDDKLLSYVEDVKYKKYNDMSKQKNGIPKQIVNNRRNMINKDYYEKKYNIKVNRNNEENGVDEKMLSVHGGVFNKNDFEYGGKIKGIPNFPLNIEFIKQNGRYKEKGNEKYENDLEVNIDQTLSRKMLENNKLKKQNNIDEDIMVTPFYIKSKIDKVLKNNEIFEKSARATFQQFDVKNKNFLHFSEIESLIQKLCHNLELPPVDKNILSIVYKDYDSSKNNRMNYTDFRQMYWDLLKQIKKKYYPTKNFKIKRNCIISRKKLGGYDYSSIYNYLSFKKILGYGAFGEVHLVEDNICKLYKVVKILKKKSMKHIKINEEINVLIYLDHPNIIKIFDVYENVDCTYIVMELCEGGELMSRIKNSESFNETYIKNIMFQILCAIAYMHSNNIAHKDLKPENILFKEKGDDTLKIIDFGLAELINKSEGISKTAAGTVLYMAPEVFKKKFTIKCDIWSAGVIMFFLFTKSLPFGGNTYDEVKQSIFRDEPDYKSLKSKLSQTALHMLKLMLQKDYNKRPMASVLLHHPWFQGYFDPIQISPNVLNNMKSYMKHSNIRNIIINIMAHELSVINNHIKYINELFYKLDTNHNGSLSHREIYTVLASVGIKKWDINRILQALDINDRGNITYTEFMAGCYRWKNIESTFLKAAFNKIDKDEDGYISKSDIVSLVHDKVLDNNDIDNFFLSVHSIKKGIPREHIINKISFQEFKDYMLSTF

SEQ ID NO: 18153 - protein, 316 aa, Plasmodium falciparum 3D7
MAKLSKQQKKQMYIEKLSSLIQQYSKILIVHVDNVGSNQMASVRKSLRGKATILMGKNTRIRTALKKNLQAVPQIEKLLPLVKLNMGFVFCKDDLSEIRNIILDNKSPAPARLGVIAPIDVFIPPGPTGMDPSHTSFFQSLGISTKIVKGQIEIQEHVHLIKQGEKVTASSATLLQKFNMKPFSYGVDVRTVYDDGVIYDAKVLDITDEDILEKFSKGVSNVAALSRATGVITEASYPHVFVEAFKNIVALIIDSDYTFPLMENIKKMVENPEAFAAVAAPASAAKADEPKKEEAKKVEEEEEEEEDGFMGFGMFD

SEQ ID NO: 18154 - protein, 97 aa, Plasmodium falciparum 3D7
MKNTGKEVRKRRKNKKDPHAPKRSLSAYMFFAKEKRAEIISKQPELSKDVATVGKMIGEAWNKLGEKEKAPFEKKAQEDKLRYEKEKAEYANMKMKA

SEQ ID NO: 18155 - protein, 491 aa, Plasmodium falciparum 3D7
MKSFIINPRQDEEIRNDIATDSSTVNGININDININDIEENIKDINTDKVKKKDENNSIEYYLFDVESYNNNKKNEENFLDLSSIRSSYLCDNKKKKAKKKKSSYLKKQLKIYKKKYKILPEHNIDQDTNYEESVKNENSKDYKIYELRDIKEDKDTNDYITSKTKDIYGMKKDVYVNVIKFIILISSIFSFGSFSTTITKYIIFVKKFNYTQIVTLFEFLIMYIILRIVIFFTKMKCSTNLTRKEYIKYIISISALLGLSVVTGNSAYSYLEIPIISVIKSSSLILIYFLSIRFGKYKYIYIYHIYELATCLKEFKLSLLCSILTILTGVIMSITSLKIDSLFGIFLLIISVISSSFKWVFTNVLLRSTSMKPHIILLHVYQVAMFIPSLFIDLACMVKDYNNNILTMDKILTSLMLVGVGALTSIFLILAEFSLISYTSSVTLSIVFIGREALILLIGSIFFGEKINLSSSIGIAISMFGTILYGYASK

SEQ ID NO: 18156 - protein, 167 aa, Entamoeba histolytica
LKVIKNRAYFKKYQTQFRRRREGKTDYYARRKMIFQDKDKFKTPKYRVVVRITNKTVIAQIAYSEIIGDKILWAAYSHELPRYGVKLGLTNYAADYCTGLLLARRLLQKLGMDKQFGGVSDAAKLGEDYTPEEVDERRPFKCILDVGLGRTTTGSLVFGVPKGMCDG

SEQ ID NO: 18157 - protein, 167 aa, Entamoeba histolytica
LKVIKNRAYFKKYQTQFRRRREGKTDYYARRKMIFQDKDKFKTPKYRVVVRITNKTVIAQIAYSEIIGDKILCAAYSHELPRYGVKLGLTNYAAAYCTGLLLARRLLQKLGMDKQFVGVSDAAKLGEDYTPEEVDERRPFTCILDVGLARTTTGSKVFGGPKGMCDG

SEQ ID NO: 18158 - protein, 509 aa, Plasmodium falciparum 3D7
MEKRYQQLFKGKRIDFPLATGAASHVSLTYDEKKNPYLLCWTYIYQEKPEFTVPLKGCRIINNITEIGPCIHIITSNEEYQFQCRSKEEFDEMSQFFNMLGYPILGFKNVYVLNKKIGKGSFSTAYIGTNILYGNRVVVKEVDKSKVKESNVYTEIEVLRKVMHKYIIKLISAYEQEGFVYLVLEYLKGGELFEYLNNNGPYTEQVAKKAMKRVLIALEALHSNGVVHRDLKMENLMLENPNDPSSLKIIDFGLASFLNSPSMNMRCGSPGYVAPEILKCASYGTKVDIFSLGVILFNILCGYPPFRGNNVKEIFKKNMRCHISFNTKHWINKSESVKEIILWMCCKNPDDRCTALQALGHQWFLPKLTDMHMTANINELKRNEAIVHKSNDQQDMCKKCKHFNNTQNDDIYNNNNNNQLDPNKNHKNNYNDYKNYFHTMLKIDDKYSENLIKDKTSMDSISLNKKDYDAYLVHSNEHDTVVLHGKCETTKNSSSLLSYKCSRRSPPQN

SEQ ID NO: 18159 - protein, 289 aa, Plasmodium falciparum 3D7
MADTNGRNSIVGQNYGAAYNQGGYNYSQNKDKENYDKSNSGQKGYYYDARTNITANGGLYDEFSLNEFSSTKIRHGFIRKVYSILSLQLLLTFGCAALAVLYKPFNAFVLTYYSPLFIVGVLLSLPIMIALACAPHMARKYPSNYFILLSITLGMSLIVTLASARTNSEIFFYAFGTTAVVVIGLTIFAFQTKWDFTGWYVFLFMAFLILIVMGIIGIFVRSKAFNLVFAGISAFILSISIIVDTQLIIGGKHKKYEFSVDDYIFATLALYMDIINLFLSILSIFSNAE

SEQ ID NO: 18160 - protein, 294 aa, Plasmodium falciparum 3D7
MAYVKVVKNKAYFKRYQVKYRRRREGKTDYRARKALILQDKNKYNAQKLRFVVRKTNSQVICQIACAHIEGDKILAEAKSKELIRYGIPVGLKNYAAAYATGLLCARRFLKSLNLDTQFLGVEKVTGEIENNEDKEDEEGRKPIKAFLDVGITRTTTGNRVFAALKGACDGGLNIPHGNNRFPGSKNEFNPEQLRKNILGIHVAEYMKTLQEEDNDKYKTHFNDYLKNNIGADDIEQMYLNAHEKIRQNPEKESKDTKNVKKFVSKHEKPKKLNAKLRKKRVKEKLALYVEKLQ

SEQ ID NO: 18161 - protein, 401 aa, Plasmodium falciparum 3D7
MTNKFNKINKNNYETREAVYYDKGNRINSNKEKEMKEFKEEELKEFFNKWNPFYKEKLNSEIEKKNFINFDGEKKMENGNNEYFNSYNYIHIHEDMIKDEVRTRTYYDSIRKNEHLIKDKIVLDVGCGTGILSFFAATHGAKHVYSIEKSDIIYTAIKIRDENNLTDKVTFLKGLAEEIELPVDKVDIIISEWMGYCLLYENMLDTVLYCRDKWLKEGGLIFPDKAHMYIAGIEDSLYREEKFDFWKNCYDLNFSSVLPIIKEEVVIDYVDRNFVVTDTCCILTLDLNTCTPDQLSFVSPFQLKMIRKDYLHALVIWFDISFSACHTEVNFTTGPYGAHTHWKQIVLYTDHIITAERNETLKGIFALKRNQKNKRHLDMKLHYIFDGVHTKAKSTQLFNIS

SEQ ID NO: 18162 - protein, 914 aa, Plasmodium falciparum 3D7
MPKEDCKTEKSIDSIDENVLKKYDILKKVGKGAYGVVFKGRCKKNKNIVAVKKIFGAFQNCTDAQRTFREIIFLYELNGHDNIIKLMDVIKAKNDNDIYLIFDFMETDLHEVIKADLLEEIHKKYIIYQLLRALKYIHSGGLLHRDIKPSNILVNSECHIKVADFGLARSISTHVNENKVPILTDYVATRWYRAPEILLGSTHYTEDVDMWSLGCIMGELLCGKPLFTGNSTMNQLEKIIQVIGKPNKKDIEDIRSPFAEKIISSFVDLKKKNLKDICYKASNESLDLLEKLLQFNPSKRISAENALKHKYVEEFHSIIDEPTCRHIITIPINDNTKYRVNFYRNVVYFVIMRRNKFHSNVLNQGESKKEEKKDRYYRRDKDKKKCICENNKVHMEDKEYKNKIIFSQGDKPEDIKEDHKKCKICDEIHVDTSKQIDSINLEHVVLNNNDVSYVDKKKKTKYEPVYKERGKMKKDKMGNVYCKDRERRVFYEARKKESITNFTTATTISKSDDTEVEMSQMEINEIESNEMKGKIKEQIKEQIKEQIKEQIKEQIKKTQNNISKISIGSNTMSSTISKTEPNSRNYFINKKSVESFYTKERKNNDILFHANNKKVIFFKDKNKIKNHSSEKKKIKYKVFYGFKKSYENEQNVPHYLETKCSNTPLGKNYYYKKYVDGSNKKYVDGGNKKYVDGGNKKYVDGSNKKYVDGSNRKYVDGGNKKYVDGSSKKYVDGGNKKYVDGSSKKYVDEGNKKYVDGGNKKYVDGGNKKYVDGRDKKYNHNYNHFNNNYYYYSRRGSLKSVNKEEENCSQRTWKNTAKLHLPLVVNKSTKPLNTLSHDYYNKDEENKYMNNSMLKKEVKKKIWRHLIDNENKKNQDMTDYYYNPIINKTEKNNKRINFKCGEKKKTEEKCVSNE

SEQ ID NO: 18163 - protein, 227 aa, Plasmodium falciparum 3D7
MGSKKNSNTVDSSENVEEVVDNLTSEKNKESLKKDKRKKKEKKNNDVDDINEEEDEEGNDEDTMKKFSVDTSENEDDKEDDDDDEDDDDDDDDDDDEDDDDEDDDDDDDDDDDDDDDDDEDDDDDDDDDEDDDDEDDEDDDDDDEDDDDDFDDMDEDDDDDDDDDEDDDDEEDYDDDDDDDDDDDEDDDEDDDEDDDDENDQNEYAGDDKKDEDGDAKKGSDDEGFD

SEQ ID NO: 18164 - protein, 717 aa, Plasmodium falciparum 3D7
MDLFYVFLFLPPTIGLIFSIIECIWVSNINIKGPEDKVEKLEDGDNPVEKMKEIASYIAVGANAFLKKEFQYLAVFIIVFSILLGFFVNSFTAVSFVLGCLTSILCGYIGMKIAVYANVRTTNETWKSLDKGFQVTLNAGTVMGFSLVSFGIIALGLLIFVYKTYVFKNTIPDNQIYKIIAGFGLGGSSIALFSRVGGGIYTKAADVGADLSGKNEYGIPEDDIRNPACIADNVGDNVGDMAGMGADLFGSLAESLCAALVIGSSVISIGEGSPGNAFHCILFPLLFVSFSVICSMITFYIITYSVKINDKKDVEKSLKYLLLLSTVLQSLAILAIGYVCFPSLVKYNYLKDIHRWKIIVPALVGLWSGLIIGFTTEFYTSYSFSPVQEIAHTQKVSAATGIIYGLSLGYKSTFIPIICLSATLGISYGLCDIYGIALAAVGMLSTLCICLTIDAYGPISDNAGGIAEMAGLPSEVRERTDILDAAGNTTAAIGKGFAIGSAALVAFALFGAYASSANLRHVNILNSWVIIGLLIGAMLPYLFSALTMKSVAIAANSVLNECLEQFPLILEGKQKPDYEKCIKISTDASLRQMIVPGLISVFSPLIIGMLMGKYATAGLLIGIILSGIQLAFSSTNSGGAWDNAKKYIESGALGKEHCKGSNAHKNSVIGDTVGDPLKDTSGPSLNILIKLSAITSLVFANVIATKFTSTRGGPIWL

SEQ ID NO: 18165 - protein, 334 aa, Plasmodium falciparum 3D7
MKLYLFLQSQFLKKFENINFIIYFKRNIYHYYIIINYIFKKKKNKRSYTYLKIYNYKIYIYIYIYIYLFIYYFFFFFIFLFTNIFGYNIEKMDFLNQIKKRQRDINLSNIMNFSPLTNEERNHLIKIYGLLAMGTIVSALSCYVDIYYFKVPRFIASIISLVCSFLLASSCNSHYQLVDTSKKRLVYFAGISSSIGVLISDYINYVNYLNPSILPLAFFGSLSIFCCFSLAAIFSKNRISIFLGAVLCAVCSYMALISFMNFFIRSKFIDTTLLYTGFFMYMGFVLFDTQITLFDFRRGNKDYIMHSICLYLDLVGLFTHLLRILGQKEEKKKK

SEQ ID NO: 18166 - protein, 889 aa, Plasmodium falciparum 3D7
MNNGSFKETSVCRKEKQKGDIPAPRFGHTATYLGNNKVAIFGGAIGDAGKYNITDDIYLYDLTQNKWKKLITENTPSARAAHAAACVDEQQLVIYGGATGGGSLSLDDLYILDLRKEQKYTWMTVPTKGVTPGRRYGHVMVYSKPNLIVFGGNDGQNTLNDVWYMHVEMPPFEWVRVIIPNTCKVPPQRVYHSADMCKEGPASGMIVIFGGRSAENKSLDDTWGLRQHRDGRWDWVEAPIKKGSPPEARYQHTSVFIGSKIFILGGRNDNGCAVPLSTALYNTETIEWVTLPSISKFRHTSWVYKYTIYTFGGFSHQTQQYPTNELECLECFNLLSSLNSLDSEKKKSIKQSSLKQKQLTNDNLKHSSSDLRNVNSYNLNSQDVINTQQHNISTNNQFNVSNELYDLKNNASICNTLANVPIVPNVQNVPNVPNVPNTHYRNMFDTSSNSSVFRLSNRPMSNKIRLSAHAHAVQENGSDFAFLVRKISIDKLEEEGRKINNGVLCTPVNYISEFKNTVYDKIITTLLNPNITQFEIQYNHNSESIFIIPWANISVLCSIVIDIFKQEDMVLKLRAPIKIYGDIHGQYYDLMRMFQLYKCPVEEDLGEKLNAIGDIDSNDYLFLGDYVDRGSNSLEVICLLFALKCKYPKQIHLIRGNHEDVAINSLYGFQEECKRRLKEDVTDKDSCWYQINQVFEWLPIGAIVEDKILCVHGGIGKSINQISDISQLKRPLVVSQVPQNLNEQKVTDLLWSDPTDNDSILGTIPNDIRDPDGTGHIVKYGPDRVHKFLEENDLQLIIRAHECVMDGFERFAGGKLITLFSATNYCNSHKNAGALLFIRRDLTVIPKLIYPAKDEVRFFNTWDTKMTELRPPTPPRNQPKMRELNFGAP

SEQ ID NO: 18167 - protein, 488 aa, Plasmodium falciparum 3D7
MKKYIYIYFFFITITINDLVINNTSKCVSIERRKNNAYINYGIGYNGPDNKITKSRRCKRIKLCKKDLIDIGAIKKPINVAIFGSTGSIGTNALNIIRECNKIENVFNVKALYVNKSVNELYEQAREFLPEYLCIHDKSVYEELKELVKNIKDYKPIILCGDEGMKEICSSNSIDKIVIGIDSFQGLYSTMYAIMNNKIVALANKESIVSAGFFLKKLLNIHKNAKIIPVDSEHSAIFQCLDNNKVLKTKCLQDNFSKINNINKIFLCSSGGPFQNLTMDELKNVTSENALKHPKWKMGKKITIDSATMMNKGLEVIETHFLFDVDYNDIEVIVHKECIIHSCVEFIDKSVISQMYYPDMQIPILYSLTWPDRIKTNLKPLDLAQVSTLTFHKPSLEHFPCIKLAYQAGIKGNFYPTVLNASNEIANNLFLNNKIKYFDISSIISQVLESFNSQKVSENSEDLMKQILQIHSWAKDKATDIYNKHNSS

SEQ ID NO: 18168 - protein, 132 aa, Plasmodium falciparum 3D7
MGISQKKYIVNNIIDDNKKSVIIHKYYRESLFENKLRFECELEFLQSLCNIDYIKHLYENKYFNDYNFINYLKYLNYWRNKPYIFYVHFPICLYVLDILNNNNTNIYFNHANSFQNFIYYLKLHWLYFSYQI

SEQ ID NO: 18169 - protein, 172 aa, Entamoeba histolytica
VLSNDGQFAISSSWDHTLRLWDLTKMESVRRFVGHESDVMSDAFSADNTKILSSGRDKTIKLWNTLGKCVASVKTDSHTEWVSCVRFAPHVKGNKFVSAGWDNQIKTWTLDHSCKLESTITHHTGFINTIDFSPDGSTMATAGKDGNIAFRALNYGHWTFEFPHEYWPLNRQ

SEQ ID NO: 18170 - protein, 234 aa, Plasmodium falciparum 3D7
MAHLYEEVYKKRKYFDRALCNDYEEWQDKIRESKTVYIGNLSIYTTQQQIYEHMSKAGDVENIIMGLHRTEKSPCGFCFVVYKKKEGYTQAVNFLNNSILDGRIIRVDEDLGIIGKRKYGRGKTGVQKRDERNKFYDEDRPKVLDNLVDHTINKKRKLNNNHYYERNIKQKILLPSNYTLNTTDMKNSRMVYIKPPVTLYPNAQHMMHINKKKHQNRNLYKFHVKKDRQNNTPT

SEQ ID NO: 18171 - protein, 707 aa, Homo sapiens
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 18172 - protein, 374 aa, Mus musculus
MACNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDSLELRLSDLLKEKQSVERKCTQLNTRVAKLSTELQEEQELNKCLRANQLVLQNQLKEEEKLLKETCAQKDLQITEIQEQLRDVMFYLETQQQISHLPAETRQEIQEGQINIAMASAPNPPSSGAGGKLQSRKGRSKRGK

SEQ ID NO: 18173 - protein, 37 aa, Ambystoma mexicanum
AIRRLARRGGVKRISGLIYEETRGVLKVFLENVIRDA

SEQ ID NO: 18174 - protein, 574 aa, Arabidopsis thaliana
MSSCLLPQFKCPPDSFSIHFRTSFCAPKHNKGSVFFQPQCAVSTSPALLTSMLDVAKLRLPSFDTDSDSLISDRQWTYTRPDGPSTEAKYLEALASETLLTSDEAVVVAAAAEAVALARAAVKVAKDATLFKNSNNTNLLTSSTADKRSKWDQFTEKERAGILGHLAVSDNGIVSDKITASASNKESIGDLESEKQEEVELLEEQPSVSLAVRSTRQTERKARRAKGLEKTASGIPSVKTGSSPKKKRLVAQEVDHNDPLRYLRMTTSSSKLKLLTVREEHELSAGIQDLLKLERLQTELTERSGRQPTFAQWASAAGVDQKSLRQRIHHGTLCKDKMIKSNIRLVISIAKNYQGAGMNLQDLVQEGCRGLVRGAEKFDATKGFKFSTYAHWWIKQAVRKSLSDQSRMIRLPFHMVEATYRVKEARKQLYSETGKHPKNEEIAEATGLSMKRLMAVLLSPKPPRSLDRKIGMNQNLKPSEVIADPEAVTSEDILIKEFMRQDLDKVLDSLGTREKQVIRWRFGMEDGRMKTLQEIGEMMGVSRERVRQIESSAFRKLKNKKRNNHLQQYLVAQS

SEQ ID NO: 18175 - protein, 1032 aa, Populus tremuloides
MEASAGLVAGSHNRNELVVIHGHEEHKPLKNLDGQVCEICGDEIGLTVDGDLFVACNECGFPVCRPCYEYERREGTQNCPQCKTRYKRLKGSPRVEGDDEEDDVDDIEHEFIIEDEQDKNKHLTEAMLHGKMTYGRGHDDEENSQFPPVITGIRSRPVSGEFSIGSHGEQMLSSSLHKRVHPYPVSEPGSARWDEKKEGGWKERMDEWKMQHGNLGPEQDDDAEAAMLEDARQPLSRKVPIASSKINPYRMVIVARLIILAVFLRYRILHPVHDALGLWLTSIVCEIWFAISWILDQFPKWLPIDRETYLDRLSLRYEQEGGPNMLAPVDVFVSTVDPMKEPPLVTGNTLLSILAMDYPVEKISCYLSDDGASMCTFEAMSETAEFARKWVPFCKKFNIEPRAPEFYFTLKVDYLKDKVQPTFVKERRAMKREYEEFKVRINAIVAKAQKVPTEGWIMQDGTPWPGNNTRDHPGMIQVFLGHSGGHDVEGNELPRLVYVSREKRPGFSHHKKAGAMNALIRVLAILTNAPFMLNLDCDHYVNNSKAVREAMCFLMDPQIGKRVCYVQFPQRFDGIDTHDRYANRNTVFFDINMKGLDGIQGPVYVGTGCVFKRQALYGYDPPKDPKRPKMETCDCCPCFGRRKKKNAKTGAVVEGMDNNDKELLMSHMNFEKKFGQSAIFVTSTLMEEGGVPPSSSPAALLKEAIHVISCGYEDKTEWGLELGWIYGSITEDILTGFKMHCRGWRSIYCMPKRAAFKGSAPINLSDRLNQVLRWALGSVEIFFSGHSPNWYGYKKGKLKWLERFAYVNTTIYPFTSLALVAYCCLPAICLLTDKFIMPEISTFASLFFIALFLSIFSTGILELRWSGVSIEEWWRNEQFWVIGGVSAHLFAVVQGLLKVLAGIDLNFTVTSKATDDDDFGELYAFKWTTLLIPPTTILIINLVGVVAGVSDAINNGYQSWGPLFGKLFFAFWVIVHLYPFLKGLMGRQNRTPTIVVIWSVLLASIFSLLWVRIDPFVMKTRGPDTKQCGLNC

SEQ ID NO: 18176 - protein, 356 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 18177 - protein, 815 aa, Rhodobacter sphaeroides
MIAEKSERFFPFAVSAELAPVGVSAAERSALADYLESSETLLTERVVAYASTRSYSHLVSTLPEAWRSSVQGLTDSVILMLDHQSAEAAIDYDADIGTDPSTAYGIEAGLRHRLRGISLETFIGAFKGYRDVYLNVTAEARVPAAMREGWLRLLRGFFDRAEIGICAHWSGELGTLDHDQLLSVNRALVNEKNKYLTIFESMNNPVLLVDDGGRIENMNFAAARLFLQDALPGSVYYGPEANLRFADLAGFDLEAVKLRGEAGDVLTCIGERWYSITAQEMLDVSRKFVGIVVTFHDVTEARRAREQAEALARAKTDFLATMSHEIRTPIHSIGGVTELLKQSELASRDRGYVDAIERSTEVLASIVSDVLDYARIESGLVELEQVDFSIDQILDDVARMMQPLVRRKPQLRIVIERTDLPAGPGKMQASLRQILINLTSNAVKFTPEGTVVIGAERLAGGHRFRFTVSDTGPGIAAEKLEEIFKPYIQSDSSISRRHGGTGLGLAICRRLAGHLGGRLDVRSTPGFGSRFTLEVALAPGGSEPPGDATGDAPPPARALDLLVVEDDEVNALVAQSLLSAAGHGVRVAGTGEAALVRPRRSTAFDLVLTDLNLPDMDGLELARTIRRHADRHTAELPLVALSAHGPGVDPAALTEAGIDAFLGKPFHFARLEEILSRLVGSSSPTPLGKAAPARRALQSVDLCVLRGHAEALGRTSAARIVQTFRQSVLETARALELAMDEADMRSVTSLAHRLKGAARHLGFRGLSDKAEQVETAAAADGCEAALVLELVSDCRAAPALADLAWAEASAGVAES

SEQ ID NO: 18178 - protein, 258 aa, Nicotiana tabacum
MASPREENVYMAKLAEQAERYEEMVEFMEKVVAAADGAEELTVEERNLLSVAYKNVIGARRASWRIISSIEQKEESRGNEDHVASIKEYRSKIETELTSICNGILKLLDSKLIGAAATGDSKVFYLKMKGDYHRYLAEFKTGAERKEAAENTLSAYKSAQDIANTELAPTHPIRLGLALNFSVFYYEILNSSDRACNLAKQAFDEAIAELDTLGEESYKDSTLIMQLLRDNLTLWTSDMQDDGTDEIKEAAKPDNEQQ

SEQ ID NO: 18179 - protein, 498 aa, Mycobacterium abscessus
MDAVEAAQRPGGTMTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDRVIKEALRLLAPVPLVMRKTVRDVAIDGYHIPSNTLCAITPAVNHFDRTIWNDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 18180 - protein, 399 aa, Mycobacterium abscessus
MPGDHPGQFARPPCAVGTTTSEASLDRRDFNMKTRAAVLWGLEQKWEVEEVDLDPPGPGEVLVRLAATGLCHSDEHLVTGDLPIPLPVVGGHEGAGTVVECGEGVEDLSEGDSVILTFLPSCGRCSYCARGMGNLCELGAALMMGPQIDGTYRFHARGEDVGQMCLLGTFSEYTVVPQASVVKIDGGIPLDRAALIGCGVTTGYGSAVRTGEVRAGDTVVVVGAGGIGMNAIQGARIAGALAIVAVDPVNFKREQASGFGATHTAASMDEAWSLVSDMTRGKLADVCILTTDVAEGSYTAEALALVGKRGRVVVTAIGHPDESSISGSLLEMTLYEKQIRGALYGSSNAPHDIPRLVELYSAGLLKLDELVTREYSLDQINEGYQDMRSGRNIRGLVRF

SEQ ID NO: 18181 - protein, 36 aa, Spodoptera frugiperda
SKAKMQPTHPIRLGLALNFSVFYYEILNSPDKACQL

SEQ ID NO: 18182 - protein, 57 aa, Spodoptera frugiperda
AFVRIPKEQGLLSFWRGNFANVIRYFPTQALNFAFKDKYKQVFLGGVDKHTQFWRYF

SEQ ID NO: 18183 - protein, 410 aa, Macaca fascicularis
MVLSQRQRDELNRAIADYLRSNGYEEAYSVFKKEAELDMNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLTSCSADMTIKLWDFQGFECIRTMHGHDHNVSSVAIMPNGDHLVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 18184 - protein, 237 aa, Rachiplusia ou multiple nucleopolyhedrovirus
MWYIIVIIIIIILNLFIIILLTLKILDDIQELYPNPPIVPPPTSPPIVPLPTPPPTPTPSPPPSPTPPPTPIPPTPTPTPPPTPIPPTPTPTPPPTPIPPTPTPTPPPSPIPPTPTPSPPPSPIPPTPTPSPPPSPIPPTPTPSPPPSPSPLGEPMYYPSNIDTNEALINFLRPLCATDRTRATYAVPWNCNGIFHCNYFSIPFYILSCHNNAYSFVNDGCIDFNSSDCPLYPLNVL

SEQ ID NO: 18185 - protein, 1015 aa, Oryza sativa (japonica cultivar-group)
MEPGQLPMVARRCIRHQQSTSRLMSVAWSAMRPALRPMSLVRPTPFTAPSVSTCPVAMACCAASTAVWNPNEPPLLDLTVDCRRAAHHVVPTAVGVGRRRSRGGAGGRGCRRWASEGGAWKLVLSPQPMFCEEGSSESGYVLCVIDSLKKKITSDRFVYIQKRVEENSIKLSPITLHSHNLSKNRQTSTSNSTDLVSNLLTKRKEDALCAVNSRESSPDESEGANCQDECSSTVIVGGNLSARNSVRPIRLPEVATLPPYTTWIFLDRNQRMQEDQSVLGRRRIYYDTNCGEALICSDSEDEAVEDEEEKKEFKDSEDCIIRMTIQECGMSDAVLETLARDIERAPDDIKARYEILQGEKPEGSSKKVSELNVKMEDVYGDKDLDAALDSFDNLFCRRCLVFDCKLHGCSQDLVFPTEKQAPLCSSDEGTPCGIHCYKLVSKPDAIMEIDSHLLVDVEEPTSDNLKDQIGSNKKKLGSSGQKTKSQQSESSSTARVSSESSESEVQLLSNKSPQHSPGLSKNKLGAKGGIKKSTNRRIAERILMSVKKGQQEMSPDSNSIVNGCHWPRDMKLRSDTRSGIKDSVVSSQCNSPSTRSFRKKGTLQMENNSSFVDAQSDSMEDTNNEHSATDGCDSSRKEECVDESICRQEAHGRSWKVIEQGLLLKGLEIFGKNSCLIARNLLGGMKTCTDVFQYMNYIENSSASGALSGVDSLVKGYMKGNELRTRSRFVRRRGRVRRLKYTWKTAGYHFIRKRITERKDQPCRQYTPCGCQSACGKQCPCLTNGTCCEKYCGCPKMCKNRFRGCHCAKSQCRSRQCPCFAADRECDPDVCRNCWVGCGDGTLGVPNQRGDNYECRNMKLLLKQQQRVLLGRSDVSGWGAFLKNSVGKHEYLGEYTGELISHKEADKRGKIYDRENSSFLFNLNNEYVLDAYRMGDKLKFANHSPDPNCYAKVIMVAGDHRVGIFAKERISAGEELFYDYRYEPDRAPAWARKPEGPGAKDDAQPSTGRAKKLAH

SEQ ID NO: 18186 - protein, 987 aa, Mus musculus
MPHQWLEGNLPVSAKCIVCDKTCGSVLRLQDWRCLWCKAMVHTSCKESLVMKCPLGLCKVSVIPPTALNSIDSDGFWKATCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILAKLERASTKMLDRWSVMAYETKLPRQASSSTVTEDFSEDSEVQQILFYEDSVAAHLSKILTSDQHSVVISSAKVLCETVKDFVARVGKAYEKTTESSQESEVMAKKCSVLKEKLDSLLKTLDDESQASSSLSNPPPTIAEEAEDGDGSGNICSSTGDHLVGSACPSRPQIFRPREQLMLRANSLKKAIRQIIEHTEKAVDEQNAQTQEQQGFVLGLSESEKKDLKTDNRVCTSSVHSESCVIAKGRSQRKASRAPCEKLVSKGLSLGSSASLPPGTGSRDSLPALNTKILYPSVRAGMSGSLPGGSVISRLLINADPFNAEPENLEYYTEKCVMNNYFGIGLDAKISLDFNNKRDEHPEKCRSRTKNMMWYGVLGTKELLHRTYRNLEQKVLLECDGRPIPLPSLQGIAVLNIPSYAGGTNFWGGTKEDDTFAAPSFDDKILEVVAVFGSMQMAVSRVIKLQHHRIAQCRTVKISILGDEGVPVQVDGEAWIQPPGYIRIVHKNRAQTLTRDRAFENTLKSWEDKQKCELSRPPSFSLHPEILSEEEATQMDQFGQAAGGLIHSIREIAQSHRAMEQELAHAVNASSKAMERVYGKPRTAEGLNCSFVLEMVNNIRALRSETELLLAGKMALQLDPPQKERLGAALIEMDQQLRKLTDTPWLCQPLEPGEEESLQQNVMLDLTKRSRSGKFRLVTKFKKEKNNKNKEVHSNLGGPVHLWGTEEVAAWLEHLSLCEYKDIFTRHDIRGSELLHLERRDLKDLGVTKVGHMKRILCGIKELSRSSPAAEA

SEQ ID NO: 18187 - protein, 132 aa, Euprymna scolopes
MKGAVDGGMEVPHNIKRFPGYDAENGEFNAEVHRDHIFGKHVSDYMVSLKEENEEAYRRQFSRYIKLGICADVIEKMYKKAHAAIRADPEHKPVPKKTVTKKRHNAKKIGNKQRKIRIAKEKADFMKSLGKQ

SEQ ID NO: 18188 - protein, 322 aa, Rattus sp.
MDSISLRVALNDGNFIPVLGFGTTVPEKVAKDEVIKATKIAIDNGFRHFDSAYLYEVEEEVGQAIRSKIEDGTVKREDIFYTSKLWSTFHRPELVRTCLEKTLKSTQQDYVDLYIIHFPMALQPGDIFFPRDEHGKLLFETVDICDTWEAMEKCKDAGLAKSIGVSNFNCRQLERILNKPGLKYKPVCNQVECHLYLNQSKMLDYCKSKDIILVSYCTLGSSRDKTWVDQKSPVLLDDPVLCAIAKKYKQTPALVALRYQLQRGVVPLIRSFKPKRIKEPTQVFEFQLASEDMKALDGLNRNFRYNNAKYFDDHPNHPFTDE

SEQ ID NO: 18189 - protein, 365 aa, Homo sapiens [sequence omitted]

SEQ ID NO: 18190 - protein, 509 aa, Plasmodium falciparum
MGNHLSVNKLKRKKKKKSFLNIYGKNTNENTSKQSNDYKYDINTSCISREGTTTLERKNLILCHSGKLEDKYIIDEKLGQGTYGCVYKGIDKVTNQLYAIKEEKKDRLKNINRFFQEIEIMKKLDHPNIVKLYETYENDNYIYLIMELCSGRELFDSIIENGSFTEKNAATIMKQIFSAIFYLHSLNIVHRDLKPENFLFQSENKDSLLKIIDFGLSKNLGTGEFTTTKAGTPYYVAPQVLDGKYDKKCDIWSSGVIMYTLLCGYPPFYGDTDNEVLKKVKKGEFCFYENDWGSISSDAKNLITKLLTYNPNERCTIEEALNHPWITQMTKSHEHVELSSTLLKNLKNFKKENELKKIALTIIAKHLCDVEINNLRNIFIALDVDNSGTLSSQEILDGLKKIGYQKIPPDIHQVLRDIDSNASGQIHYTDFLAATIDKQTYLKKEVCLIPFKFFDIDGNGKISVEELKRIFGRDDIENPLIDKAIDSLLQEVDLNGDGEVNKNYNHEKG

SEQ ID NO: 18191 - protein, 132 aa, Plasmodium falciparum
MSAKGKTGRKKASKGTSNSAKAGLQFPVGRIGRYLKKGKYAKRVGAGAPVYLAAVLEYLCAEILELAGNAARDNKKSRITPRHIQLAVRNDEELNKFLAGVTFASGGVLPNIHNVLLPKKSQLKAGTANQDY

SEQ ID NO: 18192 - protein, 449 aa, Plasmodium falciparum
MNGPKKNYDSLYDIMYDYDINDEHFNQHRNLNNININDNVSEKKIHSEQVIPLNNKYEKEKENYNSNIIKKNYEQNEQEHMGNDKNVHSLLSDNLIDQEKKQFNDNKNDLYADKDIINNNIYYMNETNIPKDNIKLEEHNDNSNMEYTINNEQRIHNTYDMTSEKENEKENHDVEDNSKLNTFNKGNNKYSFKYGEIYNDTCTDINISTTYDQGNKEKETDVNGNKNNINITEEKAYEHHDKEEDINANENNNCEQNANVKDNNNNNNNNNNVNKPNTATENESRNTFECNICFDDVRDPVVTKCGHLFCWLCLSAWIKKNNDCPVCKAEVSKENVIPLYGRGKNSSDHKYAQPEEPRPTPKRKEGVRRNNTYSNNLGLRASFGVWVNPFSFGLSYTNMSEEPYFYENRNENRSDNRRLQTETYQAEAASSFFFFLGFFLSLYILFYSS

SEQ ID NO: 18193 - protein, 2814 aa, Plasmodium falciparum
MNAYNTDGRYLLIIYEKVFKVIYIKNLKDKKDENVKVPALFIYRKNGKCLEKRILKEKIRKKSKKYGNILNELIIDNLIGTIEFRNELFLFVVEKWRLLSKFYYMDKYRSIYKIEKVHYIPYNVDIIPINAAINNSLNIDDNSNNYFINNVKNNEDINKNFEIIDNSINFEYNNNNNNNNFGIITASSLKTIDVVNKSDDISYDFFNTNNKNISSCQGNNSNKNVTMKKSGNLENDKKDNILNDFEVVDNINSYNSYKNNNYNKKEEKNKKILTFNSAKKWLTTQFNHKNILNIISDITNYDSKNVNENDRNLGKVQNELEKDNNSFLKNDKASTSSYNTSACNNTNKISTLFSSHTNISTIDENMSINKSDKDSYSPNNNNNNINNINNNNNNNNNNNNNNNNSSSSSKCKSNNKNLNIHKSMSSHTNMSIHKNMNVNTNKMTHNHSNNNNDNMKQSSGEKNTTTTKHTSRNNYNNDTLNKMNFNSVENSLSSIYDEDNLSESKPDTPNYSSKVRTSLIDNTFFNKEGNGKKEELTVLINNKNIVDSENNILIGIKKDEKKNNQSNSMFDQDNENDKNILLDKKNINNNNNNNNNNNNLLYINKNDVHDKNYQKLNIHENDVNKRNSRDSKLSEALSEDKKGSNASNKSSINVVNNNIKDLINHSYFNVKGNPRMQENSEKKNSYSSLFKNEDVRNDEKKNNSKMDIHKYLKTIQKLLSVHMYYSYDYDLTQCIQKKVKNNIEEVEVEPLVYNTRLNNLNNKKKKSFLKMCEKKYVWNYQMIKKTKNKCKIDDNWFCSIIQGYISYTSIEINKKCLELLLISRRSSILGGTRFNKRGINDDGYVANYVESEQIVRINNRNINHVDKVDQLNNKDNTSMSDINYDSYKNKNFTSTKGNLDKNNSNRNNTYNNSNVSNEILASPNLTHDQVNHLKENSVREKDKNNNSFGSSQVVGGNISTETKEQFVNKDKINQGVFGTYKMNDSYDNNNNNNNNNNNNTNTNTNNNNNNNNNNNNNNNSSSSTNKYVGRNFENRIISLVQIRGSIPLFWKQHSMSSHVNIQRSSLLSIKAFKEHNKKLINSYGNNIYYINLLSQNKSNEKKLTKKMIEMINFIKKDKHYKEKDYINYIEYDFHISVKNKSFEDAMNDFINKILLKEIKNVSFFIEPIKVSTSNNENINNNSTTTTTNNNNNNNNKNKNNINDKDYDDDDDDNDDNVDKDKDVNNININNTNNDNIKNKDYGYDNGDGENKKESSGAFQNGVFRTNCLDCLDRTNVFQYYYALFFILYILHLSRNDMFLKAVNKSYLCYYKNVNNMYNDKNVTILTTLPTENYLLDLSDKYAMNRNYDYVNNKNENMGMFDGFSYIINDGRFMNNKKTSDTADELKRLGLDQKKEKYGNSNDKDYNKEDKKKVEQIDEYVYILKHLFKKMWVENGDIISTHYTGTGSVFSSQINVGRSSLSTNIDHAIKSIERFYQNNFEDNFRQECIDIILCSGKYNNNRRSFLGSDFTYLLNCNNTSTVNKDSTNSMNKYDVNNNNNNNNNNNNNNNNNSNNNKILDPSTNSLQQNKLNLKNKKLLKENQEKGNKQESKVLSKRKRALLKLKKISAAYNINTHHNWKNFIHNTNSVKDHIDNSGNKNKNVDGNKELGKKEYEHKTKRILQEMDSSDESDLEIEENNEKFYFKENAKMDMYDEGMIENIDYNNMNYPVLAKPNEYYEVEANGVDEDDEDYDDEDEDDEEEEEEEDAYNYDSKKHLNIPYNDVEGKILKSDVNYLNNKNMNDLWSRTNNSSSINNTIEIDSSTSDSIEKKRRNRRREKMRRRRRRQMKKLKNRSDSMYLDDMHKDNKYVYDVNNEPIYNDYLSHDLINQYCVDCSNSKFVNNYAKKKIINTDYEERIIKLWAGTWNLCGGDLEELHDISSWLNEVDDYIDMYVFCFQEVVELTGFRILMNMKDKFKEKKIEQMITQTLGEVSQRQKELYLRGAKYNNNSNNMKIKKKSAHVVSETPYRNENRKNLYAANEEKEQDVIMNNDDVDDEYYENYLKCFNDDYMKNGNNRNNVYNDNNKKSNNYKYDDMNILAQGEEPRITEDNNSLLDISKNCFLNNYFNSLEGDGLNLDIMGERKMSFSNLMDMDKREYIDDTNKYKEHDEYNNINKEMEYNNDFNLMDALEDYDNIENKANKHNYINEDLLKSNETHISSNVKDIFQNKVPNSLNMNLDDIFNDEFISNPKEDDYYINSNKGNIRGSYVIEELYNRKYNDMNNYNMNDEFEDNVFDRDKDMEMKMARSMDMYDRRGSYLNEIENKSRNINDNININNDNFEINEADVFDNSSNNFRVKNYNFTSVQDVFEDCDIKELGSSNNNLMYERRYDPPKRKGRNFNENVKREIHKIDDYYENVQREKRKDNKGFAAAGTSNYNNKDYDKYFLNLRKFKYVKLKSVSMIGLFIIIFIDEALVDHIREIEVCKVKVGLKGNTGNKGSVSVKFRLGYNSFCFNNIHLASGQTNIFERNTQMQNILSNSFQNQQLNNLFNFDYFFACGDFNFRINKNLEEVLKLISSKNIKHLLNYDQFIYNKMYNILPFCLFHEHPITFNPTYKYKKHSNMYDIRRTPAWCDRVLMSGKLVHLSEIEKKRNEHISREHYRERNISIDQTNKSDMVDYKRNNMSDKDILNDFYNNDKIYFKYLDYKTHNNFFSSDHKPVSALIELKVFFDKKDIEYKLLQSYSMKTVDEYGYLGKGSSNTSNSSSNKNNNNNNNNLFDYFFSNGYGISKYTTNPISQILNYSNPLNAKYKNEPNEHSFHEDAIRNIENFEEYTK

SEQ ID NO: 18194 - protein, 961 aa, Plasmodium falciparum
MENKDNKRRGFLKNWNINYLSTNFNNLIKHNENTHNTKHDQKNEHVDDNKTNKIYDINENIKFIKEKEIMRENNKIDVNNNININLSSSLSNKGYYDSINHNVKDCINVMNDSNTTTTTTTTTTTTNNNNNNNNNNNNNNKPTSYLDFCEAWSKFKFRNLASHANDQINKDKQSYNHGESQGNIQNIGLGNKNSCDNKGLLNCNMAHNNSNINYLNNHNNINNCINRDNNNIDHNKRNNYHNNNNNNKNNCSSNNSSNNNSSSNNNNNNGNNSDNHNNDNGNHFNRHNNFNNNHMNNYNGHNNNNNDDDDNGDHSDNNNEKNNKFYKNNDGSSVSSSSSVSSSSSFISNDSYAAKNPKTNNEQCKRKKKKKKEREKENNNNPPDMDTYNSNISVMNNMNSMNNMNNNMESNMRTDVNVHHNNMNRRNSFNNSSNLQHTYNNNYNQYDHKNSNDSYTRNERRNSLNNYNFRKPSLNPNNEFYNNNDYSSDLINSHPINYSNVPESNYNMNHPIHHMNSASHGMSNNTSHGMSNNTSHGMSNNTSHGMSNNTSHGMSNNTSHGMSNNTSHGMSNNTSHSMNNTSHSMNNTSHSMNNPSHHINHSSHNVMNKNCGNKRNYTSNNSGDYNESVKSNNYYNHAGNNTNYYNSNKNSISSENLNKQIKKGAEGGDADNVRYSIDKTEEVEKKNPNMINIEMLNPEDRKKEAEKYKVLGNQSYKLGYFESAIDYYTKAIQYDNTNHVYYTNRALCYKKQKLWKLANMDARQALNLEEESVKAHFILGLTLLHLNSLEEGLKKLTKAKTLSSYLKDSNESEINRYIMQAKKLIYLRDEQNKQLSYTELQSFFIDKINLLNQIGYITNEEKSLRIQQTEGIFKELLDSFQKKQVPDYLCCKISMCLMNEPVITPSGMTYDKIFLYEHVKHNGSFDPVSREQFSIREVIPNYAIKEATEHFLKANPWAFEE

SEQ ID NO: 18195 - protein, 403 aa, Plasmodium falciparum
MSEIENKNVEKIQNIQELLKDKELLLSSMEEEQNIDEDIIKEVITNLNLLKDVEINKDILRITKIGITVNKLTKINNELVQNLSKDLVEKWKNIAKMEKLSSLKNYEMMKKRKSEKIEMANDKINNDNNNDNNNDNNNDNNNNDNNNNNNNNNNNSDNNFSSNNNNLCEGEVEFKKARLNENGLHKCSSSESSNVPDYNIIKDNFNKIKKNDIKIVNEWNYDGKFHNDMHRDKAKQFLFKAFVVGSSDNLLYFIEKKKLNDIIYNIECELYKVYMEKRSSQKEYNMQLKSIKFNLSDKKNPNFNEKVYSEFISSKALATMNSQDMASDEKKNERKKCLQESLLACQSDWDVKNILLKKSRKGEFQCFKCKGYDTIYHQLQTRSSDEPMTTFVTCLKCNNRWKF

SEQ ID NO: 18196 - protein, 528 aa, Plasmodium falciparum
MGQEVSSVNNTKNEHHKTNKKSLKGGNERHEMKESSVGISKKIVENSFNNSKLRPGMFIQNSNVVFNEQYKGIKILGKGSFGEVILSRDKHTGHEYAIKVISKKHVKRKTDKESLLREVELLKMLDHINIMKLYEFFEDNNYYYLVSDVYTGGELFDEIISRKRFYEIDAARIIKQILSGITYMHKNNVVHRDLKPENILLETKNKEDMIIKIIDFGLSTHFEYSKKMKDKIGTAYYIAPDVLHGTYDEKCDIWSCGVILYILLSGCPPFNGSNEYDILKKVEAGKYTFDLPQFKKISDKAKDLIKKMLMYTSAVRISARDALEHEWIKMMTSKDNLNIDIPSLELSIANIRQFQSTQKLAQAALLYMGSKLTTIDETKELTKIFKKMDKNGDGQLDRNELIIGYKELLKLKGEDTSDLDNAAIEYEVDQILNSIDLDQNGYIEYSEFLTVSIDRKLLLSTERLEKAFKLFDKDGSGKISANELAQLFGLSDVSSECWKTVLKEVDQNNDGEIDFKEFRDMLVKLCNY

SEQ ID NO: 18197 - protein, 793 aa, Plasmodium falciparum
MQVITSDKIGLIQYIKCTGGNSIFEQNLPADLNRKINNMTWSGGYGGYEESEITICRENGLVESFQFYENVENPHVNDTASLSFLSCSNCIYTRMLNHHHNVIYEDILNEHKDKYANYLNFMPVYNNNEKVKNGIYEDYLLNSRLLVTVNSTGHVHVLNWEHDESSKYYLNDTLYKNEIKNEDIQKKMQRYCENYKKDVLNKIQYKKIDDKDNNNNNIITNNEYEHVNLQKICKDYHYNNMIAKENILQSYILSNPINAACVNELLTNRLAIGGYKNCLKVFDLFTGTYLWKSKGLGVSLLHLNCETLIKSLNFLNDINVNILCASTYDHKIILYDMRCQPKPVYIYDHYKTQNVIENKYNYFDHNYSESDLVFTNICNTSHIYSDDMDTNTLDMKDEKIKKENYDKDENISDDENNDDQHNNSDKDDDQHIHNNKDSIYIKFNTNQIQLQNLEIFNKLKEQQKNDIQPIKNKKRKLTHNDHSLKTTEKDIVLYNKKEDTGKTYCIKKFSHNNSQTIYVSDNYGSVYSFEIITGNKLLQYIYRKKCAIEKITYEKKSDKYLLKIKDKLYEFYKDFQNNNKTHMRNDLPTMWAKNDFDQFHINLIKKIKIHNGGISFLFLHKRGKFLCSASYERFIIILNTETRKVIKRIHVGHVLTSCLFHSKILEESAHTKGDNDCVSWADSSEEGEEDDDENDDDDENDDDEEDDDDEEDDDDENDDDENDDDENDDDENDDDENDDDENDDDEEDDDDEEDDDDENDNDENDNDENDDDEEDDDDENDDEEDEGEDDDDE

SEQ ID NO: 18198 - protein, 2162 aa, Plasmodium falciparum
MVDENYLKESDSSKFLDFGQIENEIKEFKSKQKEIFSFYVKNIDELIGKINKAKNLLEEKKKTENEILKDKNYQNNVDINNGDKKSVVTNMDNNESTDKIKRIESINDNKTINKNNVIIKELIKDVKSLNITEKINNENKTFYNTLLLSYRGIISLIKQETPEIFKDIHIKKAIILRLILMHFLQKGDFFMYYVLNKEILKNKKKKKKKTYMEENQMYDRTSNGEIINEHILKSGDVGVSRNLNNCIVNPDMLNDKNNNNNNININNNNNNNININNNNNININNNNNINNNNNNNNYDNNIMDVPHYLDNIPNNKDIVNECDSKQINNTNSYDYNMNSVQKIEMKNEDTANNINVYNKEDTIKCIIPGNNMYEHNNSNSNTFNSVLLNNINPNVGMNDKGLFSRIKKEYLRKIKFSEKNEEIIFEHALLEEELFEGYKELHRIMYNLKNYDVSSCIEWYHRCSESTKKKYTKLIYLLHCISYLIYSKEDKEKALHCLRELMLNYKENKSHISRLSTFICIGVDNAFFKNMFSSVHAKVFNYFKRAFNEEGIVVNMKKNKNMIKKDTRQYGNENMRCNNLVPSKVNIKNEEANKRNVKELHNKKEEDVKEKINSRKRKSSILLYNKDEKNTHKNCTSQKDGIKLCSDKNCKHKMCSSNKYNKEKSNISRCTTDNDKKCSSSICSKKKKNKIKKRKKNNSFPIMYKKINEDISRGQTKSHIKKKNLKNKKGKNEHILKRKIKKKFTNIYNRISKKDPIKVKKNKNKGNHSRNKKKKKNYSYVTFHKEYALNIKMDRSNNIPLIHNNIYKEKYSNLCGTKLYTNHFYETKRNNFLRPLSELYVENNINEIIRNNKMNKDILYDSCCNNYNMNNFNLILPNVSLNEDNYGYKNNSRGGVYKEGYNNKKKDNNKKKDNNNNNDDDDEKLNNGWYSHIHHCTKDVITEMIHSKKDDFDIIKENTINMDKDIDISSYNNLCNIKRADESIYLYELNESELSQYSYNDSNYMTYKILNRTSQFYDHEDTKINNYALHKLYKHYNKNVCTNINYPSSILYNNHPYSYNNYLFCIKNLYHNNNNNNNSFFQNNSNFYMENVVNNFEYYMKQNNDSSSYMNHNTFYSLNNSCFIKKANVLKSKLPKCKFLSASPKDEKDVKTIPMSTEQKKDFSLSSHEKKDVTTLSMEKKCTPVVSIEKKDVLILPQEKKNEERNKCDDKIEHICGKEECNDMCILKKKKNGKDEEEYYECVNFKDNDVYTNDESTTSSCSYYKSFGSCNSYTSSSGGEFSSYSSGEENFKKNMNKVKEQVDIMKEDYLKKNTMNALLNTKNVQANNRAILASKNTRLAKTSIDVSRILLTHALTTRDIYTLQNTLSTNKSNTEFRRICLKWKAKKIKRRSRLKKREKGDEESEDDIKDKGGRNKKGGTRKGKMEVDDDGDDDDDGDDDDDDGDDDDDDGDDDDDDGDDDDDDGDDDDDDDDDDDDDGDDDDDDDDYNDDDNDDDNDDDNDDDNDDDYNDDDNDDDYNDDYNDDYNDDDESDDFYDEHNSYDEEDDYFDEENDYFDEDDDYYDEEDNYYEDDENIHDEQPYNSPNSSSSYDINKKKKHKAVSKLKGKRKKKNKKKKKRNISSTNKVNLSDSLECLGLENFIKLTKKNLFIKKSDEKKKSEKGKKKKKTQKSKKSDDTNEGKNKIDEQKKGKELKENKDNMKLKKKNKIKNMKEVEGSVLNDEKGDMEKTTVEKTQNERSEKSNITEERNDKKVLANNFQNEVQCEKDIKEQKEIHKVENVKVEENNDDETKIIENKGNELDVNQEVKNVNQNDSNMTEKNVSEEIQENKGENIQKNESRTIEKKEKTQKLCDKKDEKKKNKDDFDTLCKKDKKGIHYGSYKKNIKKRRYYSNFLYDEKMQMQMKRNKNEGYYNKGNKTKKENLVSKEKVKSEKAGFNKKNDSSDSDDEYKKSKGRKGTDKKPNNDKKKFDKSNDDKKKKKEKEVHKNNKEFVKEKKNENDQDKSLKKENEKKVYVHLESPLDILVCAGLISSKKLIEAQAILKENNKRLQEVKNSSFANNSNEKSLEKEKNKNPNENGSLLSNSLAVEVDLSGCFFFHSSFTCPISRDKSSRDNPPYLLTCGHAICKNCVDKIHAQRSRQFKCPMCPQYLHLLEIIPLYFS

SEQ ID NO: 18199 - protein, 323 aa, Plasmodium falciparum
MMDNIKEAEISLRGVLEGGHSDWVTSVSTPTDPKLKTIVSASRDKKLIVWNINTDDDSGEIGTAKKSLTGHSQAINDVSISSDGLFALSGSWDHSVRLWDLSLGETIRSFIGHTSDVFSVSFSPDNRQIVSASRDKTIKLWNTLAQCKYTITDQQHTDWITCVRFSPSPNQAIIVSCGWDKLVKVWNLKNCDLNKNLEGHTGVLNTVTISPDGSLCASGGKDGVAKLWDVKEGKHLYSLETGSTINSLCFSPCDYWLCAATDRFIRIWNLESKLIISEIYPVKQSKIGVPWCTSLTWSANGQLLYCGSTDGNIYVYEVKKHSV

SEQ ID NO: 18200 - protein, 256 aa, Plasmodium falciparum
MATSEELKQLRCDCTYRSKLAEQAERYDEMADAMRTLVEQCVNNDKDELTVEERNLLSVAYKNAVGARRASWRIISSVEQKEMSKANVHNKNVAATYRKKVEEELNNICQDILNLLTKKLIPNTSESESKVFYYKMKGDYYRYISEFSCDEGKKEASNCAQEAYQKATDIAENELPSTHPIRLGLALNYSVFFYEILNQPHQACEMAKRAFDDAITEFDNVSEDSYKDSTLIMQLLRDNLTLWTSDLQGDQTEGNK

SEQ ID NO: 18201 - protein, 99 aa, Plasmodium falciparum
MASKSQKKVLKKQNKKKKKDPLAPKRALSAYMFYVKDKRLEIIKEKPELAKDVAQVGKLIGEAWGQLSPAQKAPYEKKAQLDKVRYSKEIEEYRKKNQE

SEQ ID NO: 18202 - protein, 185 aa, Plasmodium falciparum
MNILFGISGSIAAIKTNEIVEKLKDECKLNNIVIDIRFVATNIAYEKFLKDFNDKVYLDKDEWLWEKRGDDILHIELRKWADIFILCPLDANTLASISNGLCPNLLTCICRCWDFNKICLVFPCMNTYMYNHPITKQQLDIISLWGMKVVNPIEKILACGEYGMGALPHVENVVFEIMKYIQDMK

SEQ ID NO: 18203 - protein, 912 aa, Plasmodium falciparum
MIVEKEELNDLNRTIEIIINNYDNDVINKRKEDFSNDDYAYSLCEDNYKSRKTRNVVINMLNKNINIIYYNDEYKNIIFINFLRLCQLNNMNVKKYHDLFIKYDAFNTIANSEKNVGFFLKPVIKNDKLLWDINTDDFHIFNLQCDTHKNTENILYESNNIKNDNEYNHLNDKNNSTGTNQENNDKNGGNYYYILQTDIKVKLNDLLENSSNAESSCYSDEESEYSLSSCSEKEDNISKYDEEKLPSIHNNIKYENNNIIEKHFPNDLLSKCPYYINNKYITNESINYEKYSIDDEGEKNKINNQVYNHCPILNKKTRINGLPNKFEHHFDHFSNLNNININQLVDVIVNQNNEHKSCGDISKNYTGNKIEESILIEKFVQSSQSDHEEINNLHKKINSMEQIIKHLMNEIIKRDMTKKKKNESIHVMKNDSSHNTNKHEYNNVLCCKQNSIHDTYEKEIQTDNIEQINRNDRTKMNEINYDVMKNVEHKIKTYTKEDIHEIDKKYFDSYNYSDIHRTMILDKCRTQCYYDFINKNKEIFENKIVLDIGCGSSIISLFCSDYAKVVVGIDNAEKILEKAKKITEINKAKNIYLFKGKLEDHNIYVDEKNEIYYLNKDLDIETFEKSNNVKLKILKFDIIISEWMGYFLFYECMINTILYARDKYLKENGYIFPNKIYLYMSGYNDMEYIKDNLLIWDKPMYNKNLYELKPNNQEFMETAKIMYVDKNNVSSEIINYGIIDMYTYNKEYFYINVDFKIPLKENKIVTSLCFYFDCLFDKSTYYIKNNTHNNNNNNNNINSIEANNLSRPVNLNEQFSNLNTVPNVSNNTGTILTTSMFKEKTHWKQTLLHLYSNNYNISQIFNTDNKEPNYLCGNIHISSPTNYTRHVHVVLQIKKNKSININEEFICRYYLD

SEQ ID NO: 18204 - protein, 804 aa, Plasmodium falciparum
MDIVNINFESGWKIIREEAIEKIEKYLENEHIEKNKNLFSATEYTRLYTVVYNMCAKKNPFCYSKEVYRKYGESLSMYTIDKIKPLLKNSDELNKTKILIDAWFKYSFYTKWMNKFLRYLDRYYVEYNSSLCLSAYTKNIFKITLFNELREDIKNIIYEIYNNLRLQEEIDQKELFCNIVELYKELDNESNEKMYEHDIEKKIVENVNNFYKKKAEEWINDYPFDDYIISIENAIEKEYEKNKSLNLNDDTCEKVTNIIVKILIYEKLNTLIDNKNNIFHLLKNNNLSSLRRTYILFSYFPEALTGLKKIIGEYIKMEGNELKDKYVQLSRKMHMSKNVNNMQNVDDNTMEDNDNYIDISNDDNNNNDNSNNNNIMNTEQNDDIILCDYIEQLIKLHNHYDNIFKLSFFNISNKNIDPNFNECLKDYFESFVEHEDEYFSTVKLLVIYTDNILKRDLNNENSVDEKQKIHMNKEEKNDEQTKFLMKKMSEIVEIFNYTSNKETFFEYYRVYLANRLINNIYISLHIEKKFIEQLYYLCGSQYTSKLGGMIQDLINNTNMNNKFYDHMKNVFNNNEIVNNNNNNSIYNDHFSNYHNVKDFFSVKILNKGYWPTLEKIHIQLNEPFNKYIQVFEEYYKSENKNRKLEWIYELSEVILHYEFNNILYNLYCNVVNAQILLLFNKYKYINYDIVKNELQIDLKSFTDHMYTSFYHFKLITSNDQIPDWTNSNFYINNNFSYPNKNVYIKKTTALLSKEHEKTKEDRTMAIEAAIVRVMKMHKKLFYDQIFDYVKKSLSSFSPTNQVNI

SEQ ID NO: 18205 - protein, 342 aa, Plasmodium falciparum 3D7
MKDNEKKNEYGTFPITINEGYSDNVGDNKLKSKGIYHKLFEKLKLALLFLTWYTLNVLYNVDNKKALNMVKLPWFISSMQLYVGWIFIFIYWISGMKKIPKIYSYDIFIRNILIQSVCHIFVHFGAVMAMSATSVSFTHVVKACEPVFTAIFSILLLKQYLKINKYIALLIIVGGVVCASMKELHFTWIAFWCATLSNFGSSIRSIYAKKMMTQKSLIGENLNASNIYAFITIISALISLPLVLAFEGKETYNFLVNYQGTNYTFKDVIFKIILSGMWYYFNNEVAFMCLERVNQITHALANSIKRVVIIVSSIIIFKTQITLLGAIGSAVAIFGAFLYSIF

SEQ ID NO: 18206 - protein, 513 aa, Plasmodium falciparum 3D7
MALSFIYNFMVEHEFIETLEVFEKEYVKKFQDDINNLRKIEYENLFTQNELLRNDFLNHEKLTKEVQSSLEDANKKIQKIIKERDYYIMHHKRVLQEKETLNKEIHKQKHEIEKIQNSVDEIKMKYEVCINNSFKSAIKEKMLVLLEKEKKDAKIEGLNKYIERLKDILGSSKLDDSTLDISSINAKESESSHNILKNDKNNLGKDNIKREDTPWPNNENADCAFTEENNERDNIYNLSITSLNIEKSFNAHNNAVLGLAYNDEVHLLATGGDDGLWKTWSSMNYELVMASQGHKKWIGDICFNNKGNILCTCSGDSKIKMWDLVKEKCVHTFKNSTGPIWSLSFHHQGDFFASASMDQTIRIFDINSLRQRQILRGHVDSVNSVNFHPYFRTLVSASVDKTISIWDMRSGLCENTFYGHHFPCNYSNFNKDANWIISCDSGGVVKIWDIRTNKCFINIDAGPACANKCPMDKNNKYLFIASEDHTIKIFNVVEKKFIRVLKHEFPIKVKKKI

SEQ ID NO: 18207 - protein, 547 aa, Plasmodium falciparum 3D7
MSNPIGTDINILDNNLIQIFRDSDEWLTLEYFLQVNARTSRVKLVQAWHISPVQVINKFQKKNSEKLVLKTFIDTSALDTDNTIQDICARGFCISSKGLKLSIGNFNIPGFPLTSLNKNKTFNQCNELTYENDPQNSRKKKLRKIMEHSQNSLLSGVGLSLSVYEKDVSTYNRDVLPIEYDSIFIKKQKEESLDDALTIHYKNKENENHKHNNEYNNVNNNEINLALGGDIMPTYGVLPYYTFHHEYIIYDNSQILPRYLIQFECDPNDDEHFSLPLCDYCSDAPAILYCESDEVKLCEKCDTLIHSQNKIVKKHIRKALNEAQKISGKCKRHMTNDVNMFCTICHIPICNLCISSHVHTDLTTNQNFPYLKNSNNNQDTIISLNMAYKAILHHSNNPSNFIKQKKKNLNDLLAKIDTLHEQVRINMNDAEKSVYTILEDLVKQLHIITDQKMCSVLSEEYELKRQFNEIIWNESFLYYLQTILPPADFMNAWLKHCQFREQIEKNSKVVEELHSLIFPDMRIKGNINIVTESSIQHDKIYHPNDKL

SEQ ID NO: 18208 - protein, 268 aa, Plasmodium falciparum 3D7
MARHSKNNTANPIFTYHERKKVKGTLRERLGKDSMRKFEQCWICLRTAENPVSSPYGHIFCKICIINNFLNQKKIYARKKKEYEDYIKDLKKKKKEELLQEKEKEKKKFVQDLENLNTVNVQKEEEKNLLDISNNFWLSCNTSKVKKDTIQKKLKPPSKNLICPITKKPLKMNELITINPEVIKNGDSENGGWVCSFSKKNIDHHKAVLLKKTGKIILKSFFENFIYGKKNSYDITVGEDDFINLEAGGTAFCSHSNVEKTLYRESLL

SEQ ID NO: 18209 - protein, 479 aa, Plasmodium falciparum 3D7
MVENKSKVKDISLAPFGKMQMEISENEMPGLMRIREEYGKDQPLKNAKITGCLHMTVECALLIETLQKLGAQIRWCSCNIYSTADYAAAAVSTLENVTVFAWKNETLEEYWWCVESALTWGDGDDNGPDMIVDDGGDATLLVHKGVEYEKLYEEKNILPDPEKAKNEEERCFLTLLKNSILKNPKKWTNIAKKIIGVSEETTTGVLRLKKMDKQNELLFTAINVNDAVTKQKYDNVYGCRHSLPDGLMRATDFLISGKIVVICGYGDVGKGCASSMKGLGARVYITEIDPICAIQAVMEGFNVVTLDEIVDKGDFFITCTGNVDVIKLEHLLKMKNNAVVGNIGHFDDEIQVNELFNYKGIHIENVKPQVDRITLPNGNKIIVLARGRLLNLGCATGHPAFVMSFSFCNQTFAQLDLWQNKDTNKYENKVYLLPKHLDEKVALYHLKKLNASLTELDDNQCQFLGVNKSGPFKSNEYRY

SEQ ID NO: 18210 - protein, 524 aa, Plasmodium falciparum 3D7
MNVLTRTLIITIFFNLQIYIGKCLNHDNIKNIKNVPMNFHLKNTNGKIYQKNKRPSQINRKNTNKQAFNIPVFSIPNYKPKYNTCTKTKNIAFVNSRINQAHNRNIQVTKAAELNAIKKIKNDKKFTLFNSGNRDNIKTYEHDINKGIIDDISTTNNSYSNIGDTSENTYQPNNFNNTLTEKKPCTFLNKAVEVGKTVSLLGMWYVCNIFYNIENKKALNILNMPITIAITQIYVGLPIFLIPWLLKLRNQPELFYDEQELKRINMSDRNALIKGFQKYVLFLKKYSSIMKQSIYHGYAHLLSVIAMGAGAISFVHIVKASAPLFAAFFSYFFMNNKMSIYTYSSLVPIVFGVSLASIKELSFTYKALYSTLSANVLSTMRAIEAKIMMGKNLDKLGRNLTPENIFALLTLSSAIFLTPALYIDSHKWKDAYEYLMNNKNVLKVLGRHVLMSGVWFYLYNQLSFISLNRLNHITHAVASTVKRVFLILTSYFIFGTKFSFLGGLGSSIAVGGTFVYSLVKKKFG

SEQ ID NO: 18211 - protein, 447 aa, Plasmodium falciparum 3D7
MNVFTKRSFFSFFVGSLVGLSFSYVLTKKKSINEFIKYAIKYVTHKKGKKNKNNNNNNNNSIPDECPGLDSEHAGKSKACEGCPNRKICNDPELKKEKEKERNQIFNEVQENLKNVKFKILILSGKGGVGKSTVAAQLAFALSYLNYEVGLLDIDICGPSIPVLTKTIDHDVNYSMNGWVPIYKNNLSIMSVGYLLPNFDDPVIWRGPKKNGLIKQFLCDVYWKNLDFLIIDTPPGTSDEHLTICSYLKDNLDGCLIVTTPHILSICDVKKEIEFCKKTNIPILGIVENMYQPIFVSNYTVQKMCSDMNVHYAGKVTFHQNLIEACQQGVGCCDIDPYSPSSKELYHLCSILIQQIQKRYMLLQMGSNNDNNNLVQENNHQNKDNTRNSDNQKLTYQEEAYENNVNKNYDTLSKYNELNYDHANLSKLQVLDKLLSEINPFLEEKKE

SEQ ID NO: 18212 - protein, 510 aa, Plasmodium falciparum 3D7
MASGWKADEVFGGVMSYTYDDIICMPGYIDFALSDIDLTNNMTDNITLKTPVISSPMDTVTGHKMSIALALSGGLGVIHNNMSIEKQIEEVKKVKRFENGFIFDPYTFSPEHTVADVLETKNRVGYKSYPITVDGKVGSKLVGIITGVDYLYLTNKSMKIGDIMTTDVVTGSYPINLSDANKVLCDEKKSVLPIVNKNNELIALVCRNDMHKNRIFPHASKSQNKQLIVGASISTREHDLERANQLIKNMIDVICIDSSQGNSIYQIDTIKKIKSAHPDIPIIGGNVVTSQQAKNLIDAGADVLRIGMGSGSICTTQDVCAVGRAQGTAVYHVSKYAHTRNIKTIADGGIKNSGNIVKALSLGADFVMLGNLLAATEESCSEYYFENNVRLKIYRGMGSMEAMYNKGFNSKSRYLVDERKNEYTDENIDEIKVSQGVSASLVDKGSVLNLIPHLFKAVKHGFQSMGIRNIPELHSKLYSGDIRFDVRSFNTIKEGKVSDNLIFNNKKFTT

SEQ ID NO: 18213 - protein, 301 aa, Plasmodium falciparum 3D7
MSVLHRFYLFFLFTKFFHCYKISYVLKNAKLAPNHAIKNINSLNLLSENKKENYYYCGENKVALVTGAGRGIGREIAKMLAKSVSHVICISRTQKSCDSVVDEIKSFGYESSGYAGDVSKKEEISEVINKILTEHKNVDILVNNAGITRDNLFLRMKNDEWEDVLRTNLNSLFYITQPISKRMINNRYGRIINISSIVGLTGNVGQANYSSSKAGVIGFTKSLAKELASRNITVNAIAPGFISSDMTDKISEQIKKNIISNIPAGRMGTPEEVANLACFLSSDKSGYINGRVFVIDGGLSP

SEQ ID NO: 18214 - protein, 1147 aa, Plasmodium falciparum 3D7
MDSLEHLKEQERIVLLNILHNFEGKKCLFFEKSLHVMLSVILNDDDINKEHIENIFFVHKVNDINVNAINNISNVLFFLRPYFYEIKNIFEIIDKIEKSKSTKRKNNYVFIFVPYMSYLCKQEILKYNVLDIPLKIILFPLYFFPLYNDVYSLEIKNLFKEYYVDNDFSNLIFCSFSLMFLQFLFNGVFKNIKSIGNLAQFSSEQLIQLRKEIMASNFNIQSPNDFQDDFYDILTNIQNFQDLKNFKNANDTTVVPLKYALHKIFISEKKTKKKKNNKIKNNNKNKPTIFASEEGNEYFSCLTKEEPSGNYSQDEDEDEDEDEDEDEDDDDEEDDDEEDDDDEDDDDEDDDEEDDDEEDDDDEDDDDEDDDGDDDEEDDDGDDDDDEDDDDEDNDDDHHDDDHDDHINQLNKPVSPNEPITKKLDNENLINLENEDISKPYFKSPKKKTSCSENNDDDEIEEYEKEKQHILQERISREGKLNDDTTINNDVIHNDNKNIINNYIDNYSPRDSSNDEENNLIVKREDSYFSINNNDDKIKKNEKDGIIHEEIKPEELQKCQEKEEENYQDEYKNEYIHKNEIKKKKKKSLSSNHFYLNHEKEYSQILYAHSQESDINYISENNQEEKNKQNNNNNNNDNNYNNKVNRVTSKKANRKKKKKKKKKNGHLSNSNNIAHDFMINCDNTKYLMKKKDRDNLEKKNKKEKNYLLEKIGISNFNFLLNVCDHIDSCIIIDRRVDMITPFCTPFTYEGLIDHFFGIDNLQIEIPRYIIFNEENKHVKYDMMENKDKKECNNNMINNNNMNNMNNYDNSYGNNNNIINKTMKVRVKLKSSVDVLYNDIKDLSQNEIGSFLHKKASDIQKTYKEKDSLKDIEEINQYMRIFKEKHYEHNSLSTHVNIASFILNNIKKEYNFNKLKLEDEIIQLEINTNKNILLSIVKQIQLLIYTNDDIYEVYRLLCLFSILTNGINQNYINELKKDIIEQYGIKELTRLNKLYTCNILKFNNKQKFLWTQLKNNFHLLSNDENDISYVCNGYAPLSVRLIEYMAAFKNNLQVFPEIFNLLNGPTLDIIQNPIGYETLPIQNKTKNNHINLNNTKKKKKNVLLFYIGGISYAEIASIRALNKKNQHYNYLIFTTEIVSSKKFLQSME

SEQ ID NO: 18215 - protein, 402 aa, Oryza sativa (japonica cultivar-group)
MADNSLVTVAAAGSGGEGGGGEAGERVGEEGGQRAGGGRKEASEEAVTEPQPSPSRATPTVAESPQRWHANNRSRLTRKLQEGGRMAKRERGEGGADVPLSRASSPTPATSSAVSTPASSTPPPLLSLICLAGVDWLRSHSQLTCGTYVGPTLTQPEDIPEPGKRGVVVVYKTAATPIILRSTSPRIHRERSANSLANQKRRLEFRRERARVMEADKSGEGEKAGGKTISFRCSDGQAFHMPVAAAMLSTAIRKMFDKYPSIDHGGVIELPHQISSGIFPKVKEYCTKHAKVDDKGNPTVSTNTGAAAAASSSSTDDEEEDLKNWDKEFVNMEVKPLHDLLLVAHLLDIKGLFHITCRKVADMLKGKTSEEMRQILNIRNDFTEEEDKAIKEQNPWVFPDPE

SEQ ID NO: 18216 - protein, 320 aa, Oryza sativa (japonica cultivar-group)
MGRGKVQLKRIENKINRQVTFSKRRNGLLKKAHEISVLCDAEVAAIVFSPKGKLYEYATDSSLTILLIIKESVNTYTYGYRIMGRMDKILERYERYSYAEKALISAESESEITLPQLTTCTASRSTHGICFQYCLMSKTLGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 18217 - protein, 200 aa, Oryza sativa (japonica cultivar-group)
MEEAEARPAPPDPNDARQRFLLELEFIQCLANPTYIHLAQNRYFEDEAFIGYLKYLKYWQRPEYIKYIYPHCLFFLELLQNANFRNAMAHPASKEVAHRQQYFFWKNYRNNRLKHILPRPPPEPTPTPAPAPAAVPPSASVPSTVVPPVAAPPSALLPMSAAGASAMSPMQFAGTPGTNIPKNDMRNVMGGQGGRKRKDG

SEQ ID NO: 18218 - protein, 299 aa, Oryza sativa (japonica cultivar-group)
MAGSPVLRAAILAAVLVLPFVGVPAPAAAQTKKFCLSQFAIASQACAILPPGEDHHHHHDDDDDDDDDDDDDDDDDDDDDEDDQGGGDDDGGGGGGGGGGGGGGGGDDSGGDDGGGGGGGGDGDRRSNRKSMVTVDAEVDTDDDALRVNGTGAGAGAGNHTRGSGGVVVRRRHRRRRRSRRRRRRHRHHPGVREGEDDDSGGDDEDHGGDDDDDHDDDDDDDDDDDDDDDDDDDDDDDDDDDDDDHRANRDCCRWLKEVEPACVCDALLRLPPFLVKPQHKYTVKVGDSCKYTYHCGGY

SEQ ID NO: 18219 - protein, 441 aa, Oryza sativa (japonica cultivar-group)
MEMASARSRPAARARQASDQIVAWAACVLVSALSLLLLVAVSSGFGAARLTGEISVLVRTTTAATTTSSSDAVDDVAVVAAAEHCDVVDGEWVRDDDDERRPLYEPRRCPFVDEGFRCRENGRPDDAFAKWRWQPRHCTLPRFDAKNLLETLRNRRLVFVGDSIGRNQWESMLCMLATAVAFAGDGDGDKAASIYEVNGSPITKHEGALSFRFRDYNCTVEHYRSPYLVRRGRPPPRRAHRGAACSTLQLDAMDARAHRWKDADVVVFNTGHWWSRERLLQLRCNFQVGKKLILNMSIEAAYQRAMNTLTSWVHREVNPHKSLVIFRTYSPAHTRASSNGGCAKETTPELNSSRISLHRWPGMVNPAFEPSRSGTAAAKLRVLNVTLMTAQRRDGHPSVFNVAAAARSPARQRADCSHWCLPGVPDAWNELLYAMILKRFS

SEQ ID NO: 18220 - protein, 373 aa, Oryza sativa (japonica cultivar-group)
MERELLEAFEAARKAADAVGEAAAAAGAGEGESPEAARCVDALRRLRGARVTTAALVSTQIGRRIRYLTKHPHSSIKATASDLLGHWKKVVIEEDKKNGALQNGKSSSTVVKVEKVEPMKVEKASPRATVNNNNMDTRVVNHKGGKVEKFSNAELRTQSIKVEKVQKVVHKVSSVEKPSPVQGGPPRLTSVVKCGDASRDRIRAILGDAFSRVSEETRKDDREEVRNIIEEVKACDPFRIAVMVECALFQKLGNFNGPNKQRYRSLMFNLKDDHNTDFRRRVLLGQVQPERIADLTPTEMASDTRKLENKKIEEKALFECERGGAPKATTDQFKCGRCGQRKTTYYQLQTRSADEPMTTFVTCVNCNNHWKFC

SEQ ID NO: 18221 - protein, 461 aa, Rattus norvegicus
MYTNGYDEEIYYIGGKRVFLTPKAWPFPHSAPEIVHEDMKMGSDGESDQASATSSDEVQSPVRVRMRNHPPRKISTEDINKCLSLPADIRLPEGYLEKLTLNSPIGDKPLSRRLRPVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNVINMHNVKLFLFQLLRGLAYCHRQKVLHRDLKPQNLLINERGELKLADFGLAYAKSIPTKTYSNEVVTLWYRPPDILLGSTDYSGQIDMWGVGCIFYEMATGRPLFPGSTVEEQLHFIFRILGTPTEDTWPGILSNEEFRTYNYPKYRAEALLRHAPRLECDGADLLTKLLQFEGRNRISAEDAMKHPFFLSLGERIHKLPDTTSIFALKEVQLQKEANIRSTSMPDSGRPAFRVVDTEF

SEQ ID NO: 18222 - protein, 262 aa, Plasmodium falciparum 3D7
MMNDIVLINKKKTPSEEKNIDKNEEIKLRIYGCQLLQEAGIILKLKAVTIVTSQILFHRFYFKKSFTDFDVNIIAPSALYLSCKLEEDFCRIYKIINTFHFLCKYENIKSKHIYFDIKNLNPEHFRINIESEEYKNMKVDIYTYELLILKEIGFLVHKINQHPHSFLLPYIHSLFNNLNTIHKDLTKKLAQMSWGFLNDSMRTTLCCEYQPRCIAVASIFLAAYKLNIPLMNNTNWFKLFDVEYEDIKKICIRILELYKIGI

SEQ ID NO: 18223 - protein, 1193 aa, Plasmodium falciparum 3D7
MYSDEESDSDYYEIINNKDNDKRLYYLNGHYLMDKNEKNEYIIKVDENLCNWKLIYDKNMISSASSKEGLIGFFIYMPECEERYTEKFLKRILQKLILCLNDTNENVRDITLRACKILISIYSKNNTSLILKYIENKIYNNYWRIRKDCVILLNVLIEKNLQINKEERDFELLNTLHERFYFMLSIICIMKNDKNINVRQTAYTIYKNFVNKKLLQDMCSILLKKITQNLSSKNNFKQLISALSLGDLVYKTDARQLESILEHMVNEFKTTKFISIKKGISLGFYEIFSKNKYDNLIINHIHNIIHMIKELACHQNTSDKIKLLSSLLKNIDSSVLKNIINEIFDNVLETPTTSMKFFTSKHHIHFKSIKIFLHVHTELVLDFIIHHVFKPPYDACKLKLLSYISYAKTPVSKSIFPKIIKIFINLILHNLNRLKETHEIDIKNYAFILSSFKEENKEQCKDGHVKESIKQNIKQNTNDCTYSNDNINDYKINNSLIFNENEKCQNNKSTTKNSLYNNIEHSNVTQNRSEPFHEIDMDMKDITKCLKDFLRNINERNIDVFIEALLSELKLYSSKSDLSYNSLCRTYESLKLEDDKKKAQESADILKRYFIIHDKNNLNELSYLEYKEENGKIREIILSIFKYLLDIINNEDISVLVSNENLTPTQDNINNMDNINNMNKQKNIIKNINKKKNILCVYKKMYLLNIQRIEMYINALSNYTFVDINKNVLEISSIIYIYLIELIKKLEDNYSYAIIFHDIINKYCSDNNLNEITHDKYEIVGLNLCKPLFSSLMNMFTNVILLSNNTDVKIKAIDIIRKLFIYTNINISRPFMLKISGILIRILTNKFIEQAKFYIFSTFEVIIKKASDYVKPLIPQLQTCIIKSLNNENLKNQIIHILNIISEKKLSRVDLLINDLLNNINVQINLQISITILMILSNILNNGDINIKNILIKIINCVKPLFNHTNKDISFHSTKIYILLIFLHIPKKKEYLEPILSFKNILDTTSYYFLLHISEINNVYDILKKENFIDTFKEIYLHMIKEEVNSLQNICYQIFYNLTKYNYDNNDCLLFLYSIINLLKLPTFIMISIEIHRYYFKAVKNIFKKRNDIYKENVKNFMSIMDNILLALFNNIPAFKLLGESCTKCVLEMNDENQYKNKLEFLKENMESKKFNQLLEYINRVLIKKSNVISDSD

SEQ ID NO: 18224 - protein, 158 aa, Plasmodium falciparum 3D7
MVPKNILFIFVILFHLIGYLKNENKCFCQFTDQPEGEHEDEHMDDPSPTILEKQAAPEPKADDGNINNNNNNNGNFDFFNNYNFNGGDDDDDDDDDDDDDESIDTTNNDNDDNDDDDDDDDDDDDDDDDDDDDDEDEINKRKPGNKKKKPRKKKPIHF

SEQ ID NO: 18225 - protein, 1205 aa, Plasmodium falciparum 3D7
MIFNYVFFKNFVPVVLYILLIIYINLNGMNNKNQIKTEKIYIKKLNRLSRKNSLCSSKNKIACLFDIGNDDNRNTTYGYNVNVKNDDINSLLKNNYSNKLYMDKRKNINNVISTNKISGSISNICSRNQKENEQKRNKQRCLTQCHTYNMSHEQDKLANDNNRNNKKNFNLLFINYFNLKRMKNSLLNKDNFFYCKEKKLSFLHKAYKKKNCTFQNYSLKRKSNRDSHKLFSGEFDDYTNNNALYESEKKEYITLNNNNKNNNNKNNDNKNNDNNDYNNNNSCNNLGERSNHYDNYGGDNNNPCNNNNDKYDIGKYFKQINTFINIDEYKTIYGDEIYKEIYELYVERNIPEYYERKYFSEDIKKSVLFDIDKYNDVEFEKAIKEEFINNGVYINNIDNTYYKKENILIMKKILHYFPLLKLINNPSDLKKLKKQYLPLLAHELKIFLFFIVNITGGHFSSVLSSLEIQLLLLYIFNQPYDNVIYDIGHQAYVHKILTGRKLLFLSLRNKKGISGFLNIFESIYDKFGAGHSSTSLSAIQGYYEAEWQVKNKEKYGNGDIEISDNANVTNNERIFQKGIHNDNNINNNINNNNYINPSDVVGRENTNVPNVRNDNHNVDKVHIAIIGDGGLTGGMALEALNYISFLNSKILIIYNDNGQVSLPTNAVSISGNRPIGSISDHLHYFVSNIEANAGDNKLSKNAKENNIFENLNYDYIGVVNGNNTEELFKVLNNIKENKLKRATVLHVRTKKSNDFINSKSPISILHSIKKNEIFPFDTTILNGNIHKENKIEEEKNVSSSTKYDVNNKNNKNNDNSEIIKYEDMFSKETFTDIYTNEMLKYLKKDRNIIFLSPAMLGGSGLVKISERYPNNVYDVGIAEQHSVTFAAAMAMNKKLKIQLCIYSTFLQRAYDQIIHDLNLQNIPLKVIIGRSGLVGEDGATHQGIYDLSYLGTLNNAYIISPSNQVDLKRALRFAYLDKDHSVYIRIPRMNILSDKYMKGYLNIHMKNESKNIDVNVDINDDVDKYSEEYMDDDNFIKSFIGKSRIIKMDNENNNTNEHYSSRGDTQTKKKKVCIFNMGSMLFNVINAIKEIEKEQYISHNYSFSIVDMIFLNPLDKNMIDHVIKQNKHQYLITYEDNTIGGFSTHFNNYLIENNYITKHNLYVHNIYLSNEPIEHASFKDQQEVVKMDKCSLVNRIKNYLKNNPT

SEQ ID NO: 18226 - protein, 568 aa, Plasmodium falciparum 3D7
MKETEVEDMDTNRKDGKIKKKEKIVNMKNEEVKSTTKSTLADSDEDYSIITLCTKCLSKKLEDNKNRIILDSKAFKDNRLKGRCSVSSNEDPLDNKLNLSPYFDRSQIIQEIILMNNDELSDVYEIDRYKLGKGSYGNVVKAVSKRTGQQRAIKIIEKKKIHNIERLKREILIMKQMDHPNIIKLYEVYEDNEKLYLVLELCDGGELFDKIVKYGSFSEYEAYKIMKQIFSALYYCHSKNIMHRDLKPENILYVDNTEDSPIQIIDWGFASKCMNNHNLKSVVGTPYYIAPEILRGKYDKRCDIWSSGVIMYILLCGYPPFNGKNNDEILKKVEKGEFVFDSNYWARVSDDAKDLICQCLNYNYKERIDVEQVLKHRWFKKFKSNNLIINKTLNKTLIEKFKEFHKLCKIKKLAVTCIAYQLNEKDIGKLKKTFEAFDHNGDGVLTISEIFQCLKVNDNEFDRELYFLLKQLDTDGNGLIDYTEFLAACLDHSIFQQDVICRNAFNVFDLDGDGVITKDELFKILSFSAVQVSFSKEIIENLIKEVDSNNDGFIDYDEFYKMMTGVKE

SEQ ID NO: 18227 - protein, 385 aa, Plasmodium falciparum 3D7
MEFVSNDESADDIIQDESNEGEVELTDADFYDLTVINDKIDEEIIEDDEEEADNDDQENDNVQEVYNIDDEDNDIHNDKLLLDQQRDNDVNEEEEEEEEEEEEEEEEEEEEEEEEEEEEEDEDDDDDDDDDDDDDDDDDDDDYDDDDEYDEDDFNEATVSWIEWFCQLKQNLFLVEVDEDFIRDEFNLIGLQTKVPHFKKLLKIILDEDDDDDDDDDDDYDDEDDEINRDSEEMYKNKDMHEQNAACLYGLIHSRFILTSKGLALMREKYKSGIYGTCPSIYCENAKLLPTAISEIPKFLSPLLYCPRCCETYYPSKNSLLNQLDGCYFGTSFASFFALSFNIASDKKKVYYTPQICGFTINRNIRETLYMDVNKDNTESSEECQ

SEQ ID NO: 18228 - protein, 266 aa, Plasmodium falciparum 3D7
MTLIENLNSDKTFLENNQYTDEGVKVYEFIFGENYISSGGLEATKKILSDIELNENSKVLDIGSGLGGGCMYINEKYGAHTHGIDICSNIVNMANERVSGNNKIIFEANDILTKEFPENNFDLIYSRDAILHLSLENKNKLFQKCYKWLKPTGTLLITDYCATEKENWDDEFKEYVKQRKYTLITVEEYADILTACNFKNVVSKDLSDYWNQLLEVEHKYLHENKEEFLKLFSEKKFISLDDGWSRKIKDSKRKMQRWGYFKATKN

SEQ ID NO: 18229 - protein, 613 aa, Plasmodium falciparum 3D7
MEKIYVKIYELSGLEDKDNFSCYIKIYWQNKKYKSCILQKNPYKFNEIFLLPIDIKNNVKDEKNNILSIEVWSSGILNNNKIAYTFFELDHIRRERISSEKINLIDVVKKCTLQISVHIINNNQDILFCNIKDIFGNNKNDKEIHDAILKYGGNERHIIKELRKEKEIGQYNNIYFNDYVNVLNTDPSQNYIYNDMPKITPNNIYNNMNNDQTNHTYLKAPNSLYNNENTIYSSNVHYSTYMNNSPTYKNSNNMNHVTNMYASNDLHNSNHFKPHSNAYSTINYDNNNYIYPQNHTNIYNRASPGSDQTLYFSPCNQKKALLIGINYYGTKYELNGCTNDTLRMKDLLVTKYKFYDSSNNIVRLIDNEANPNYRPTRRNILSALMWLTRDNKPGDILFFLFSGHGSQEKDHNHIEKDGYNESILPSDFETEGVIIDDELHKYLIQPLNEGVKLIAVVDSCNSGSSIDLAYKYKLKSKKWKEDKNPFHVICDVTQFSGCKDKEVSYEVNTGQIAPGGSLVTAMVQILKNNMNTPSIITYEYLLHNIHAHVKQHSNQTVTFMSSQKFNMNRLFDFEHIIKNKNNQLGQIINKYIEKNKSKNKNKLKHELKNLFFF

SEQ ID NO: 18230 - protein, 288 aa, Plasmodium falciparum 3D7
MEKYHGLEKIGEGTYGVVYKAQNNYGETFALKKIRLEKEDEGIPSTTIREISILKELKHSNIVKLYDVIHTKKRLVLVFEHLDQDLKKLLDVCEGGLESVTAKSFLLQLLNGIAYCHDRRVLHRDLKPQNLLINREGELKIADFGLARAFGIPVRKYTHEVVTLWYRAPDVLMGSKKYSTTIDIWSVGCIFAEMVNGTPLFPGVSEADQLMRIFRILGTPNSKNWPNVTELPKYDPNFTVYEPLPWESFLKGLDESGIDLLSKMLKLDPNQRITAKQALEHAYFKENN

SEQ ID NO: 18231 - protein, 257 aa, Plasmodium falciparum 3D7
MDALILDEQIRIYALLPIFVIVVLVCIIKSNLAQMIHPGPKTDMEKLSQNNYLSRFDLLKSNNGLLSPLAFISRKLFYNKPEVGYFNDLPEQANPFDALLKQDPSDLFGMMKNQIPFLVLQLGLGFLINLFFSGYLVAKIPFPLTYKFKSTLQMGMDIELLDMKFVSSLSWYFLVMFGSSGLISIIDYFVLQDKDRSQNNAMDNLMATHNPLAKPPGNMNNIPDLRKFFNKKKEELDNVKYEFLLENIECELLQKWE

SEQ ID NO: 18232 - protein, 300 aa, Plasmodium falciparum 3D7
MNQYIDNDISVSNKEELIYYIKILNHLGSYDGKNIYEYYLFLIKYDILFIVSYILLTIETVTLIKSVNVENYNFNYTESLSVGFAFKNALNVKRKEKTILENIITNEKSSEREKICAELLKSKLNTDIRSIEKNTYAVLKNKCISRTTDDKILMLYWHILGDMSRYCADTFHGTDKEKMHEKSMKSYSYALHYANKMKIPPSSPKMLELLVSWTVLHKDMNKDINYSIELAAEAFRNAIQNMHLLENDDECSKTIRILGILRDNINKWCEISGRKNVNALFEINGENLDKYKDIMNSTHT

SEQ ID NO: 18233 - protein, 172 aa, Plasmodium falciparum 3D7
MKNDKIKLVSFEGDEFIVDKNTASMSTVIMNILEVMTAEEDTIPLPNIKTPILKKIIEYMEYHINNPADEIPKPLITSNLQDVVSSWDFDFVNTDKETLYELIEVKYKQMNIIMASNYLDIKPLLDLTCGKIASMMKDKTTEEIRAEFDIVNDFTREEEKQIREENRWCGDI

SEQ ID NO: 18234 - protein, 400 aa, Mus musculus
MTRPMIGKLKIFIHDDYKIAGTSEGAVYLGIYDNREVAVKVFRENSPRGCKEVSCLRDCGDHSNLVAFYGREDDKGCLYVCVSLCEWTLEEFLRLPREEPVENGEDKFAHSILLSIFEGVQKLHLHGYSHQDLQPQNILIDSKKAVRLADFDQSIRWMGESQMVRRDLEDLGRLVLYVVMKGEIPFETLKTQNDEVLLTMSPDEETKDLIHCLFSPGENVKNCLVDLLGHPFFWTWENRYRTLRNVGNESDIKVRKCKSDLLRLLQHQTLEPPRSFDQWTSKIDKNVMDEMNHFYEKRKKNPYQDTVGDLLKFIRNIGEHINEEKKRGMKEILGDPSRYFQETFPDLVIYIYKKLKETEYRKHFPQPPPRLSVPEAVGPGGIQSSWEVVHFWSFKQPGYL

SEQ ID NO: 18235 - protein, 1184 aa, Cryptococcus neoformans var. neoformans
MFVTRPPFSPLDHRGSPLEDDHTNTSGSSRDDVPSSHSTNTAFHEFKSSTPFPPHYLNVPSGLAFKTYLEKWGPEQIMGFLAIHGCEHHSGIFIKNSIDGKLLLDLDMSVLTSLGITKVGERVRLMAGIKCLRQRIAHEAEKDNVRSAHLCNGSLGMDRVKVMIHPKMSASLYVCRQGPFDSDPSTARRSRLTPSSSADRERNPSPMQRSQEVMKHSFITRSSGGQVIPPLWSGQIHNHGIDNSPTPGLYQPPMQRSVPLRSSVSYSDIAAKGMPLLVTQSINSAADHTFAVTDSHDTTSSLGGHLPRPDYFHSTNDAFQTCTKGEDNTISELPQRNQESSPSKWKKSGVICEDEAMLDSSPFAPTSPKHPFAINVTGNNVMEYPPNLPIKNCLSLRSFQSPDKSAGEDRLNMNPRAPSLDDLRRKLVKFVNAEDGTTRTVNVMKATSGAEVLERALRKFGKTGTGSAPFLDEENHNGGKYEGSLCIDGWGVFAEDLLGEEIGPMTEGDLFDICASLQNGAAIQRDALILRQTSESQKRKDMRFYLGNMPVLPTPVNLPISFYSPHSGQFERNSALQHTAQHQPLLSKNRSRASMMSIMSGLGVSHPDIKQPTHDSVQSPTSVTRSSSKKKSMYNFFGHRPPSELISSHLADYFPSAKKRDVAKVRGSMLRLNIAHTAEHDPRSVKSLGMIETDDMPFSSTEQSLTEQGGHYFDPSTCQPADTSSRGHVDHIITDHAGNSKGYYRLPCDEKASPTVKTQELHSANSANSILRACPPNLPPTYQSARLTDLHSDSTFSQLQLLRHSSSLSFKQPSSSHRRTVDEITAEMQHRQTSLSSNRPTSTIDSDISGPPCDSETSPDHTSDVSDVSESSSEYWDDQSSVSSKDSDHNTVEHTRAFTSNGSKRNIKWIKGALIGAGSFGSVFLGMDAQSGLLMAVKQVELPRGIAKMEARRRDMLSALEREIELLKDLQHENIVQYLDSSADANHLNIFLEYVPGGSVAALLNSYGAFEEALVGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPDIPSDISAHAADFLSRAFALDYRMRPSATSLLQHAFIIHDGSGGNDEV

SEQ ID NO: 18236 - protein, 1231 aa, Drosophila virilis
MSCFSAMNTPLLGEMEQTICMLERGTIVTKLYGKQRRPDRRHLMLIRETRQLLWSTVAAQTRTEYEGTIQLREIREIRVGKNSKEFRLHADDCQRFESSKCFVIMYGNSFKLKSFSVVALSEIEADNWVRGLRYMVKDTIHSPYPLQIDRWLRREYYSFENVNSHLTKSDQSSQVTIKDFKTFLSNVSCKMSTSKFMECFTDDIKRKHDLKFDDFSRLYQKLLLPVNFISVLGSAEFAYSEDKKIVRPIEFKRFLETEQHDLNALDLNSISSFMRDFVQDVERDVQEPYLTISEFVDYLFSKQNDLWDTRFDAVFMDMNQPLSSYWIASSHNTYLTGDQFSSESSCEAYARALRMGCRCIELDCWNGPDNLPYIFHGHTMTSKIKFMDVIKTIKDHAFTTSEYPVILSIEQNCSLEQQRNMAHALIEVFGDMLLTQPCDRNELHLPSPNQLRRKIILKHKKLPQFDENVSAINLPAVGVNNGTIASFSHRSSLGGATDDNENLQKILKKGLLYFKDPVDKSWNLYQFVLTQQELIYTSEISECRNGNSEDDDFGLSSCTLNSNMQQKQKDTSANDELHFGENWFHGKLEGGRQEADQLLETYKHLGDGTFLVRESATFVGDYSLSFWRRNRPNHCRIKLKHENGSIKYYLVENFVFDSLYSLIVYYRKNMLRSSEFSIILKEPVPQPKKHESQDWFHPNTTKEQAEQGLLKLDIGSFLVRPSVQSVNAFVISFTINRKIKHCRIMQEGRLYAIDTMQFESLVSLIHYYMRNPLYRNVKLVHPVSQELLRQSLIENAQLHGEHSNNDSSGASNYMGSNLEEYVTCKALYSYKADKPDELSFPKHAIITNVQRNNSMWWKGDYGGMIQQHLPANYVKVIDSATEDYNSVTEEGNDGRTDSIEIYGAVASLFESNEPGIIIKLQIQTPTMQNPFIIGFDNQETAYEWIKSIQDAALIASQLATERRKKERTARVAKEMSDLIIYFRSVPFRDHSWIFQEMSSFPETKAEKQFIQQNMPLFLSYHRNQISRVYPKGQRLDSSNFNPVPFWNIGSQMIALNYQTGDKAMQLNQAKFRNNGQCGYILKPAFMMSENFNPNNPLSDGLIETKVSVRIIAARHLFRGGKSNNPQIVVEIVGASFDSGIKYRSKVNENGFNPIWNESFEFTVHNPQFALLRFEVQDEDMFAETHFIAQACYPLTCVRQGYRSVILRNKFSEELELSSLLVNIEISNREST

SEQ ID NO: 18237 - protein, 1250 aa, Drosophila pseudoobscura
MSCFSAMNAPLLGEMEQTIGMLERGTIVTKLYGKQRRPDRRHLMLIRETRQLLWSTVAAQTPRTDFEGAIQLREIREIRVGKHSKEFRLFADDCQRYENSKCFVILYGNHFKLKSFSVVALSEIEADNWVRGLRYMVKDTVNASYPLQIDRWLRREYYQIENVNSHSAKSSEQSQTQVTIKDFKMFLASVSCKMTTSKFMECFTDDVRRKHDLKFDDFSRLYQKLLLPHSFANILCGGTAASSAFPYSEDQQTVRPTELKRFLETEQRDLNVGELNSGSISGFIRDFVQDVERDVQEPYLTLSEFVDYLFSKQNDLWNSKYDAIFMDMNLPLSSYWIASSHNTYLTGDQFSSESSCEAYARALRMGCRCIELDCWNGPDNLPYIFHGHTMTSKIKFMDVVKTIKDHAFTTSEYPVILSIEQNCSLEQQRNMAQALIEVFGDMLLTQPCDRNEQHLPSPYQLRRKIILKHKKLPQYDETTFSGVGISNGGIAAAAAGGGGGSSLTHRSSLSGGVGENEGENMRKVFKEGLLYFKDPVDKSWNLYQFVLTQQELIYTSEISESHRNGTSEDDDFGLSSSCSLNNTMQQKQKDTSANDELHFGENWFHGKLEGGRKEADDLLQKYKHLGDGTFLVRESATFVGDYSLSFWRRNRPNHCRIKLKHESGSIRYYLVENFIFDSLYSLIVYYRKNMLRSSEFSIILKEPVPQPKKHEDQDWFHPNTTKEQAEQGLFKLDIGSFLVRPSVQSINAFVISFTINRKIKHCRIIQEGRLYAIDTMQFESLVSLIHYYTRNPLYRNVKLCHPVSQDLLRQALAENAQQGTDHSNDGNGASNYMGSNLEEHVTCKALYSYKANKPDELSFPKHAIITNVQRNNTMWWIGDYGGMIKKHLPANYVKVIDAATEDYNSVNEEGTDGRTDSIEIYGAVASLFESNEPGIIFKLQIQTPTMQNPFVIGFDNQETAYEWIKAIQEAALIASQLATERRKKERTARVAKEMSDLIIYFRSVPFREHSWIFQEMSSFPETKAEKQFFQQNTQLFLSYHRNQISRVYPKGQRLDSSNFNPVPFWNIGSQMIALNYQTGDKAMQLNQAKFRNNGQCGYILKPSFMKAESFNPNNPLSDGLNEVRVSIRLIAARHLFRGGKSNNPQIVVEIMGASFDTGIKYRTKVNENGFNPVWNEACEFTVRNPQFAILRFEVQDEDMFAETHFIAQACYPLTCVRQGYRSVILRNKFSEELELSSLLVNIKITNITST

SEQ ID NO: 18238 - protein, 352 aa, Leptosphaeria maculans
MPPTGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 18239 - protein, 574 aa, Lotus japonicus
MEGKGYTLDGTVDLAGRPVLSSLTGKQKACTYILVYRVLERFAYYGVGANLVNFMTTQLNKDVVSSITSFNNWSGLATLTPILGAYIADTYTGRFWTITFSLLIYAIGLVLLVLTTTLKSLRPACENGICREASNLQVALFYTSLYTIAVGSGAVKPNMSTFGADQFDDFRHEEKEQKVSFFNWWAFNGACGSLMATLFVVYIQEKNGWGLAYSLSAIGFLLSSIIFFWGSPVYRHKSRQARSPSMNFIRVPLVAFRNRKLQLPCNPSELHEFQLNYYISSGARKIHHTSHFSFLDRAAIRESNTDLSNPPCTVTQVEGTKLVLGMFQIWLLMLIPTNCWALESTIFVRQGTTMDRTLGPKFRLPAASLWCFIVLTTLICLPIYDHYFIPFMRRRTGNHRGIKLLQRVGIGMAIQVIAMAVTYAVETQRMSVIKKHHIAGPEETVPMSIFWLLPQNIILGVSFAFLATGMLEFFYDQSPEEMKGLGTTLCTSCVAAGSYINTFLVTMIDKLNWIGNNLNDSQSRITIMPFFSVISALNFGVFLWVSSGYIYKKENTSTTEVHDIEMSAEKTVKY

SEQ ID NO: 18240 - protein, 121 aa, Hordeum vulgare subsp. vulgare
TKSASETTEATKKMGSEAMGKVSETVQAGQDRAVEGKDQTASFLGEKTEAVKKTATETADAAKEKSTEAAQHVQDTAAEYTKDTPVAPKENVFQKAGGNIVGAATDAKDAVMNTLGMGGDK

SEQ ID NO: 18241 - protein, 467 aa, Caenorhabditis elegans
MEISQYTKDKASCTRISIESYYSKRVTQCAERENRLKKLEEDISARGLSDEEKEEKRKIHHSKETDYLRLKRTRLTVNDFESLKVIGRGAFGEVRLVQKHDTGHIYAMKILRKSEMVEKEQTAHVRAERDILSEADCDWVVKMYYSFQDYSNLYLVMEFLPGGDMMTLLIKKDTLTEEATQFYIAEAALAIQFIHSLGFIHRDIKPDNLLLDARGHVKLSDFGLCTGLKKFHRTDHYRNWPSTLPPDFISKPFESKRKAETWKRNRRAYAYSTVGTPDYIAPEVFQPNGYTKSCDWWSLGVIMYEMLIGYPPFCSELPQETYRKVINWQQTLVFPSDVPISIEAKATIKRFCCEAERRLGNHGGLDEIKQCPFVKRIDWNHIRERPPPIRVTVKSIDDTSNFDDFPDEDLTWPTSTLIRPEEQPGRRGEFVDFTYKRFDGLTQKMRYSDLKKQAKKNKKGGQQGTSD

SEQ ID NO: 18242 - protein, 482 aa, Gallus gallus
MAAEESQYLLAHRTSDAYLRVQNKKLYLATFAAVLGPLSFGFVLGYSSPAIPELRKIDNPKLRLDSNQASWFGSIVTLGAAAGGILGGYLVDKIGRKLSLMLCSIPFVSGYIVIISAQNVWMLYFGRILTGLASGITSLVVPVYISEISHTDVRGMLGSFVQLMVVTGILGAYIAGLTLKWHWLAVLCSFPPCVMLLFMLFMPETPRFLLDQKKRAEAIAALQFLRGPYVDHEWECRQIEANVEEEGLSLFEFKNPSIYRPLLIGVILMFLQQVTGINAVMSYAETIFEDANFQDSRMASVVVGFIQVCFTAVAALIIDKTGRKVLLYVSGMIMALSTALFGFYFKMVLPNGNNSSNTDLWFTLNSVTPGTDTRLSWLAVVSLGLFVAGFALGWGPVPWLVMSEIFPLKARGVSSSACVLTNWVMAFLVTKEFHDFIGFLTSYGTFWLFSAFCCLSVTFAAFYVPETKGRTLEQIEAYFRKS

SEQ ID NO: 18243 - protein, 299 aa, Rhodobacter capsulatus
MSSYANLPAPSPEQGLNRYLQEIRKFPLLEPEEEYMLAKAWVDHQDPKAAHRLVTSHLRLAAKIAMGYRGYGLPQAEVISEANVGLMQAVKRFDPERGFRLATYAMWWIRAAIQEYILRSWSLVKLGTTSAQKKLFFNLRKAKSKIGAFEEGDLRPDAVAKIAHDLNVSEGDVIEMNRRLAGSDASLNAQVGAGDGESATQWQDWLEDEDADQAEAYAEADELQARRAMLVAAMDVLNERERDILMARRLRDEPVTLEELSSQYDVSRERIRQIEVRAFEKLQGRMKALAKEKGMSLPG

SEQ ID NO: 18244 - protein, 348 aa, Homo sapiens
MVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 18245 - protein, 360 aa, Homo sapiens [sequence omitted]

SEQ ID NO: 18246 - protein, 520 aa, Coriolus versicolor
MSRFHSLLAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAANVGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 18247 - protein, 624 aa, Rattus norvegicus
GSMDQRQKLQHWIHSCLRKADKNKDNKMNFKELKDFLKELNIQVDDGYARKIFRECDHSQTDSLEDEEIETFYKMLTQRAEIDRAFEEAAGSAETLSVERLVTFLQHQQREEEAGPALALSLIERYEPSETAKAQRQMTKDGFLMYLLSADGNAFSLAHRRVYQDMDQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMARHLRAILGPILLDQPLDGVTTSLPSPEQLKGKILLKGKKLGGLLPAGGENGSEATDVSDEVEAAEMEDEAVRSQVQHKPKEDKLKLVPELSDMIIYCKSVHFGGFSSPGTSGQAFYEMASFSESRALRLLQESGNGFVRHNVSCLSRIYPAGWRTDSSNYSPVEMWNGGCQIVALNFQTPGPEMDVYLGCFQDNGGCGYVLKPAFLRDPNTTFNSRALTQGPWWRPERLRVRIISGQQLPKVNKNKNSIVDPKVIVEIHGVGRDTGSRQTAVITNNGFNPRWDMEFEFEVTVPDLALVRFMVEDYDSSSKNDFIGQSTIPWNSLKQGYRHVHLLSKNGDQHPSATLFVKISIQD

SEQ ID NO: 18248 - protein, 423 aa, Mus musculus
MSTRNCQGTDSVIKHLDTIPEDKKVRVQRTQSTFDPFEKPANQVKRVHSENNACINFKSSSAGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTVYNSKSLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 18249 - protein, 214 aa, Paeonia delavayi
IVESVGEGVTDLKPGDHVLPVFTGECKECRHCKSEESNMCDLLRINTERGVMLSDGKSRFSINGQPIFHFIGTSTFSEYTVVHVGCVAKINPEAPLDKVCILSCGISTGLGATLNVAKPKKGSSVAIFGLGAVGLAAAEGARIAGASRIIGVDLNPKRFEEAKKFGVTEFVNPKDYDKPAQEVIAEMTDGGVDRSVECTGSIMAMVSAFECVHD

SEQ ID NO: 18250 - protein, 214 aa, Paeonia brownii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSVMAMMSAFECVHD

SEQ ID NO: 18251 - protein, 214 aa, Paeonia californica
IVESVGEGVTDVKPGDHVLPIFTGECKECRHCKSEESNMCDLLRINTDRGVMLNDGKSRFSVNGQPIFHFVGTSTFSEYTVLHVGCLAKINPEAPLDKVCVLSCGISTGLGATLNVAKPKKGSTVAIFGLGAVGLAAAEGARISGASRIIGVDLNPKRFDEARKFGVTEFVNPKDYNKPVQEVIAEMTGGGVDRSVECTGSVMAMMSAFECVHD

SEQ ID NO: 18252 - protein, 214 aa, Paeonia lutea
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRSDEARKFGVTEFVNPKDYNKPVQEVIAEMTGGGVDRSVECTGSIMAMMSAFECVHD

SEQ ID NO: 18253 - protein, 214 aa, Paeonia delavayi
IVESVGEGVTDVKPRDHVLPIFTGECKECRHCKSEESNMCDLLRINTDRGVMLNDSKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 18254 - protein, 214 aa, Paeonia suffruticosa subsp. spontanea
IVESVGEGVTDVKPGDHVLPIFTGECKECRHCKSEESNMCDLLRINTDRGVMLNDGKSRFSINGQPIFHFVGTSTFSEYTVLHVGCLAKINPDAPLDKVCVLSCGISTGLGATLNVAKPKKGSTVAIFGLGAVGLAAAEGARIACASRIIGVDLNPKRFDEARKFGVTEFVNPKDYNKPVQEVIAEMTGGGVDRSVECTGSIMAMMSAFECVHD

SEQ ID NO: 18255 - protein, 214 aa, Paeonia szechuanica
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECAGSIMAMMSAFECVHD

SEQ ID NO: 18256 - protein, 214 aa, Paeonia rockii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 18257 - protein, 214 aa, Paeonia rockii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHG

SEQ ID NO: 18258 - protein, 214 aa, Paeonia anomala
IVESVGEGVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 18259 - protein, 214 aa, Paeonia tenuifolia
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 18260 - protein, 214 aa, Paeonia veitchii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARMAGASRIIGVDLNPKRFDEARKFGVTEFVNPKDYNKPVQEVIAEMTGGGVDRSVECTGSIMAMMSAFECVHD

SEQ ID NO: 18261 - protein, 214 aa, Paeonia veitchii
IVESVGEGVTDVKPGDHVLPIFTGECKECRHCKLEESNMCDLLRINTDRGVMLNDGKSRFSINGQPIFHFVGTSTFSEYTVLHVGCLAKINPEAPLDKVCVLSCGISTGLGATLNVAKPKKGSTAAIFGLGAVGLAAAEGARMAGASRIIGVDLNPKRFDEARKFGVTEFVNPKDYNKPVQEVIAEMTGGGVDRSVECTGSIMAMMSAFECVHD

SEQ ID NO: 18262 - protein, 385 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 18263 - protein, 245 aa, Oncorhynchus mykiss
DIDQAVKPNYLAGQEITGNMRAILIDWLVQVQIKFRLLQETMFMTVGIIDRFLQDNPVPKKQLQLVGVTAMFIASKYEEMYPPEIVDFAFVTDQAYTTAQIRDMEMKILRVLKFSFGCPLPLQFLRRASKIGEVTAEHHTLAKYFVELTMVDYEMVHFPPSQVASAAFALTLKVFNCGEWSSTLQHYMNYTEDSLVHAMQHIAKNVLKVNEGQTKHMTVKNKYSSQKQMRIATISQLKSSLIKDL

SEQ ID NO: 18264 - protein, 316 aa, Paracoccidioides brasiliensis
MAEQLVHRGTLEGHNGWVTSLATSLENPNMLLSASRDKTLIIWNLTRDDTAYGYPKRSLHGHSHIVSDCVISSDGAYALSSSWDKTLRLWELATGNTTRTFVGHTNDVLSVSFSADNRQIVSGSRDRTIKLWNTLGDCKFTITDKGHTEWVSCVRFSPKPQNPVIVSAGWDKLVKVWELSSCRIQTDHIGHTGYINTVTISPSGSLCASGGKDGTTMLWDLNESKHLYSLPAGDEIHALVFSPNRYWLCAATSSSITIFDLEKKSKVDELKPEYVEKGKKSREPECISLAWSADGQTLFAGYTDNKIRAWGVMSRT

SEQ ID NO: 18265 - protein, 297 aa, Mus musculus
MGFVKVVKNKAYFKRYQVRFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVNGGEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMMEEMYKKAHAAIRENPVYEKKPKREVKKKRWNRPKMSLAQKKDRVAQKKASFLRAQERAAES

SEQ ID NO: 18266 - protein, 395 aa, Paralichthys olivaceus
  unsure (1)..(395): unsure at all Xaa locations
MADLCCTAAEVGAAGSDSAAADGADGTVALDVGGAPVAAVPKIESESVKGQIFDVGPRYTNLCYIGEGAYGMVCSAMDNVTTXRVAIKKISPFEHQTYCQRTLREIKILLRLDHENIIGINDILMYKLRARHIDNMGDVYIVQTLMETDLKSQRLSNDHVCYFLYQILRGLKYIHSANVLHRDLKPSNLLINTTCDLKMCDFGLARIADPEHDHTGFLTEYVATRWYRAPEIMLNSKGYSKSIDIWSVGCILAEMLSNKPIFPGKDYLDQLNHMLGVLGSHLKMNLNCIINMKARNYLQSLPEKPKIPWEKIFNRADSKALDLLGRMLTFNPIRRISVEEALGHPYLEQYYDPSDEPVAEEPFTFTMELDDLPKEKLKELIFEETARFQETYQGS

SEQ ID NO: 18267 - protein, 111 aa, Plasmodium falciparum 3D7
MAGTSEAVKKWVNKIIEENIIAVFAKTECPYCIKAISILKGYNLNSHMHVENIEKNPDMANIQAYLKELTGKSSVPRIFINKDVVGGCDDLVKENDEGKLKERLQKLGLVN

SEQ ID NO: 18268 - protein, 562 aa, Plasmodium falciparum 3D7
MNDLIIKNNKKGSCDVIIKYKCKKSDENIKRRKSSHKYIKNKSVVLGRSIMTNKKEKLKGALKYKGSKKEIKICNKKSMIKNDKDENTTLKSMKSDNFKFSRRGFILSFTGNLEDFYNLSKEPLGKGTYGCVYKATDKLLKISRAVKVVSKKKLKNIPRFRQEIDIMKNLDHPNVVKLLETFEDSNQIYLVMELCTGGELFDKIVKKGCFVETFASFIMKQIFSVLNYLHIRNICHRDIKPENFLFYDMTPESLIKIIDFGLASYFTHNNYEMKTKAGTPYYVAPQVLTGSYNYKCDMWSSGVLFYILLCGYPPFFGESDHEILSMVKKGKYQFKGKEWNNISEEAKDLIKRCLTMDADKRICASEALQHPWFKKKKYAFNMDMKMDIHVLENFKNYGLLLKFQKLAMTIIAQQSNDYDVEKLKSTFLVLDEDGKGYITKEQLKKGLEKDGLKLPYNFDLLLDQIDSDGSGKIDYTEFIAAALDRKQLSKKLIYCAFRVFDVDNDGEITTAELAHILYNGNKKGNITQRDVNRVKRMIRDVDKNNDGKIDFHEFSEMMKLKF

SEQ ID NO: 18269 - protein, 203 aa, Spirulina platensis
VQSNLRLVVSIAKKYMNRGLSFQDLIQEGSLGLIRAAEKLDHEKGYKFSTYATWWIRQAITRAIADQSRTIRLPVLLYETISRIKKTTKLLSQEMGRKPTEEEIATRMEMTIEKLRFIAKSAQLPISLETPIGKEEDSRLGDFIESDGETPEDQVSKNLLREDLESVLDTLSPRERDVLRLRYGLDDGRMKTLEEIGQIFNVT

SEQ ID NO: 18270 - protein, 188 aa, Anabaena variabilis
MNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVT

SEQ ID NO: 18271 - protein, 188 aa, Oscillatoria agardhii
MNRGLSFQDLIQEGSLGLIRAAEKFEHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLENVLDTLSPRERDVLRLRYGLDDGRMKTLEEIGQIFNVT

SEQ ID NO: 18272 - protein, 188 aa, Calothrix brevissima
MNRGLSFQDLIQEGSLGLIRAAEKFDHEKGYKFSTYATWWIRQAITRAIADQSRTIRLSVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLGDGRMKTLEEIGQIFNVT

SEQ ID NO: 18273 - protein, 188 aa, Anabaena cylindrica
MNRGLSFQDLIQEGSLGLIRAAEKLDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVT

SEQ ID NO: 18274 - protein, 188 aa, Microcystis wesenbergii
MNRGLSFQDLIQEGSLGLIRAAEKFDHEKGYKFSTYATWWIRQAITRAIADQSRTIRLPVHLYETISRIKKTTKILSQEMRRKPTEEEIATKMEMTIEKLRFIAKSAQLPISLETPIGKEEDSRLGDFIEADGETPEDEVSKNLLREDLENVLDTLSPRERDVLRLRYGLDDGRMKTLEEIGQIFNVT

SEQ ID NO: 18275 - protein, 188 aa, Synechococcus leopoliensis
MNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIEADGETPEDEVAKNLLREDLEGVLSTLSPRERDVLRLRYGLDDGRMKTLEEIGQLFNVT

SEQ ID NO: 18276 - protein, 203 aa, Phormidium sp. IAM M-99
VQSNFRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEGVLATLSPREKDVLRLHYGLDDGRMKTLEEIGQIFNVT

SEQ ID NO: 18277 - protein, 203 aa, Pseudanabaena sp. PCC 7367
VQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPDDQVAKNLLREDLENVLGTLSPRERDVLKLRYGLDDGRMKTLEEIGQIFNVT

SEQ ID NO: 18278 - protein, 203 aa, Stanieria cyanosphaera str. PCC 7437
VQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIEADGETPEDQVSKSLLREDLENVLDTLSPSERDVLRLRYGLDDGRMKTLEEIGQIFNVT

SEQ ID NO: 18279 - protein, 188 aa, Oscillatoria sp. PCC 7112
MNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLESVLDTLSPRERDVLRLRYGLDDGRMKTLEEIGQIFNVT

SEQ ID NO: 18280 - protein, 203 aa, Xenococcus sp. PCC 7307
VQSNLRLVVSIAKKYMNRGLSFQDLIQEGSLGLIRAAEKFDHEKGYKFSTYATWWIRQAITRAIADQSRTIRLPVHLYETISRIKKTTKLLSQERGRKPTEEEIATRMEMTIEKLRFIAKSAQLPISLETPIGKEEDSRLGDFIEADGETPEDQVSKSLLREDLESVLDTLSPRERDVLRLRYGLDDGRMKTLEEIGQIFNVT

SEQ ID NO: 18281 - protein, 188 aa, Nodularia sp. PCC 73104
MNRGLSFQDLIQEGSLGLIRAAEKFDHEKGYRFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVT

SEQ ID NO: 18282 - protein, 203 aa, Pleurocapsa sp. PCC 7314
VHSNLRLVVSIAKKYMNRGLSFQDLIQEGSLGLIRAAEKFDHEKGYKFSTYATWWIRQAITRAIADQSRTIRLPVHLYETISRIKKTTKLLSQERGRKPTEEEIATRMEMTIEKLRFIAKSAQLPISLETPIGKEEDSRLGDFIEADGETPEDQVSKSLLREDLESVLDTLSPRERDVLRLRYGLDDGRMKTLEEIGQIFNVT

SEQ ID NO: 18283 - protein, 188 aa, Pleurocapsa sp. PCC 7327
MNRGLSFQDLIQEGSLGLIRAAEKFDHEKGYKFSTYATWWIRQAITRAIADQSRTIRLPVHLYETISRIKKTTKILSQEMRRKPTEEEIATRMEMTIEKLRFIAKSAQLPISLETPIGKEEDSRLGDFIEADGETPEDEVSKNLLREDLENVLDTLSPRERDVLRLRYGLDDGRMKTLEEIGQIFNVT

SEQ ID NO: 18284 - protein, 203 aa, Leptolyngbya sp. PCC 7375
VQSNLRLVVSIAKKYMNRGLSFQDLIQEGSLGLIRAAEKFDHEKGYKFSTYATWWIRQAITRAIADQSRTIRLPVHLYETISRIKKTTKLLSQELGRKPTEEEIATRMEMTIEKLRFIAKSAQLPISLETPIGKEEDSRLGDFIESDGETPEDEVSKSLLREDLEGVLSTLSPSERDVLRLRYGLDDGRMKTLEEIGQIFNVT

SEQ ID NO: 18285 - protein, 203 aa, Pseudanabaena sp. PCC 7403
VQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPDDQVAKSLLREDLESVLGTLSPRERDVLRLRYGLDDGRMKTLEEIGQIFNVT

SEQ ID NO: 18286 - protein, 203 aa, Synechococcus sp. PCC 7001
VQSKFRLVVSIAKKYMNRGLSFQDLIQEGSLGLIRAAEKFDHEKGYKFSTYATWWIRQAITRAIADQSRTIRLPVHLYETISRIKKTTKTLSQEFGRKPTEEEIAESMEMTIEKLRFIAKSAQLPISLETPIGKEEDSRLGDFIEADIENPEQDVAKNLLREDLEGVLATLSPRERDVLRLRYGLDDGRMKTLEEIGQIFDVT

SEQ ID NO: 18287 - protein, 187 aa, Arabidopsis thaliana
RDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 18288 - protein, 162 aa, Rhodococcus opacus
MPGNRPLDVQLSRRRVLQWGAGAAFLGLTGACARTDDTEAPIGPDSPEVRAFAEAESRRFPGGRPVAYELSATQSEVDIAGKRTAAWLYNTQLPGPILRANVGDRVQVRFRNQLPDSTTVHWHGLAIRNDMDGVPDVTQAPIPADTEFVYDFIPPDPGTYWY

SEQ ID NO: 18289 - protein, 502 aa, Arabidopsis thaliana
MATAAVIGLNTGKRLLSSSFYHSDVTEKFLSVNDHCSSQYHIASTKSGITAKKASNYSPSFPSSNRHTQSAKALKESVDVASTEKPWLPNGTDKELEEECYDDDDLISHSVEAILLLQKSMLEKSWNLSFEKAVSSEYPGKGTIRKKKIPVITCSGISARPRRIGAKKKTNMTHVKAVSDVSSGKQVRGYVKGVISEDVLSHVEVVRLSKKIKSGLRLDDHKSRLKDRLGCEPSDEQLAVSLKISRAELQAWLMECHLAREKLAMSNVRLVMSIAQRYDNLGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKVFSLDRDAFPSLNGLPGETHHSYIADTRLENNPWHGYDDLALKEEVSKLISATLGEREKEIIRLYYGLDKECLTWEDISKRIGLSRERVRQVGLVALEKLKHAARKRKMEAMILKN

SEQ ID NO: 18290 - protein, 385 aa, Macaca fascicularis
MALPHDSNETSYLLPPNNEDWDRQAIPDFVYGQKDLMAEGIQWPRNAPGVLEALPQSPFDAALCSAWKQRVELGLFRYRLRELQTQILPGVVGFVAQLNVERGVQRRRPQTIKSVRQAFDPEQFNFNKIQPGEVLYRLHREPDLPGTLLQEDILVVINVSPLEWGHVLLVPEPARGLPQRLLPGALRAGIEAVLLSLHPGFRVGFNSLGGLASVNHLHLHGYYLAHRLPVEQAPSEPLDPGGHLHLLQGLPAPGFLFYTRGPGLDLESLICRVCRATDYLTDHEIAHNLFVTRGAPPGKTSPSSALTGVRVILWARKSCFGIKDGEAFNVALCELAGHLPVKTSQDFSSLTEAAAVALIQDCRLPPSQAEEVQAALVALMSQKEQ

SEQ ID NO: 18291 - protein, 436 aa, Oryza sativa (japonica cultivar-group)
MVLDLNVESPGGSAATSSSSTPPPPPDGGGGGYFRFDLLGGSPDEDGCSSPVMTRQLFPSPSAVVALAGDGSSTPPLTMPMPAAAGEGPWPRRAADLGVAQSQRSPAGGKKSRRGPRSRSSQYRGVTFYRRTGRWESHIWDCGKQVYLGGFDTAHAAARAYDRAAIKFRGLDADINFNLNDYEDDLKQMRNWTKEEFVHILRRQSTGFARGSSKYRGVTLHKCGRWEARMGQLLGKKYIYLGLFDSEIEAARAYDRAAIRFNGREAVTNFDPSSYDGDVLPETDNEVVDGDIIDLNLRISQPNVHELKSDGTLTGFQLNCDSPEASSSVVTQPISPQWPVLPQGTSMSQHPHLYASPCPGFFVNLREVPMEKRPELGPQSFPTSWSWQMQGSPLPLLPTAASSGFSTGTVADAARSPSSRPHPFPGHHQFYFPPTA

SEQ ID NO: 18292 - protein, 84 aa, Oryza sativa (japonica cultivar-group)
MKVKILQWHGVASWTWNAQDETCGICRMAFDGCCPDCKFPGDDCPLIWGSCNHAFHLHCILKWVNSQTSTPLCPMCRREWQFKG

SEQ ID NO: 18293 - protein, 132 aa, Beta vulgaris
EGVTDLQPGDHVLPVFTGECKECAHCKSVESNMCDLLRINTDRGVMLNDGKSRFSIKGKPIFHFVGTSTFSEYTVVHVGCLAKINPEAPLDKVCILSCGISTGFGATVNVARPKKGQTVAIFGLGAVGLAVS

SEQ ID NO: 18294 - protein, 132 aa, Beta vulgaris
EGVTDLQPGDHVLPVFTGECKECAHCKSEESNMCDLLRINTDRGVMLNDGKSRFSINGKPIFHFVGTSTFSEYTVVHVGCLAKINPEAPLDKVCILSCGISTGFGATVNVARPKKGQTVAIFGLGAVGLAVR

SEQ ID NO: 18295 - protein, 133 aa, Beta vulgaris
GEGVTDLQPGDHVLPVFTGECKECAHCKSVESNMCDLLRINTDRGVMLNDGKSRFSIKGKPIFHFVGTSTFSEYTVVHVGCLAKINPEAPLDKVCILSCGISTGFGATVNVARPKKGQTVAIFGLGAIGLAVS

SEQ ID NO: 18296 - protein, 131 aa, Beta vulgaris
SVGEVVTDLQPGDHVLPVFTGECKECAHCKSEESNMCDLLRINTDRGVMLNDGKSRLSINGKPIFHFVGTSTFSEYTVVHVGCLAKINPEAPLDKVCILSCGISTGFGATVNVARPKKGQTVAIFGLGAVD

SEQ ID NO: 18297 - protein, 300 aa, Toxoplasma gondii
MEKYQKLEKIGEGTYGVVYKAQDHSGEISALKKIRLEAEDEGIPSTAIREISLLKELHHPNIVRLRDVIHTDRRLTLVFEYLDQDLKKLLDVCDGGLEPSTTKSFLFQLLCGIAYCHEHRVLHRDLKPQNLLINREGALKLADFGLARAFGIPVRSYTHEVVTLWYRAPDVLMGSKTYSTPVDIWSVGCIFAEMVNGRPLFPGTGNEDQLMKIFKVLGTPQVSEHPQLAELPHWNRDFPQFPPLPRDQVVPKLDPLGTDLLSRMLRFDSNQRISARQAMQHPYFSDLADNIKRLATFRGE

SEQ ID NO: 18298 - protein, 377 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 18299 - protein, 504 aa, Shigella flexneri 2a str. 301
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLAGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVMGLTASTWILWTVLGSNTLLLMDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 18300 - protein, 347 aa, Shigella flexneri 2a str. 301
MRIEEDLKLGFKDVLIRPKRSTLKSRSDVELERQFTFKHSGQSWSGVPIIAANMDTVGTFSMASALASFDILTAVHKHFSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFGGGADFVMLGGMLAGHEESGGRIVEENGEKFMLFYGMSSESAMKRHVGGVAEYRAAEGKTVKLPLRGQVENTARDILGGLRSACTYVGASRLKELTKRTTFIRVLEQENRIFNNL

SEQ ID NO: 18301 - protein, 398 aa, Shigella flexneri 2a str. 301
MKQLTILGSTGSIGCSTLDVVRHNPEHFRVVALVAGKNVTRMVEQCLEFSPRYAVMDDEASAKLLKTMLQQQGSRTEVLSGQQAACDMAALEEVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMRTPIAHTMAWPNRVNSGVKPLDFCKLSALTFAAPDYERYPCLKLAMEAFEQGQAATTALNAANEITVAAFLAQQIRFTDIAALNLSVLEKMDMREPQCVDDVLSVDANASEVARKEVMRLAS

SEQ ID NO: 18302 - protein, 267 aa, Shigella flexneri 2a str. 301
MAIPAFGLGTFRLKDDVVISSVKTALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNAIPAQVILAWAMGEGYSVIPSSTKRKNLESNLKAQNLQLDAEDKKAIAALDCNDRLVSPEGLAPEWD

SEQ ID NO: 18303 - protein, 620 aa, Shigella flexneri 2a str. 301
MSFDIAKYPTLALVDSTQELRLLPNESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLVILNFGTLMPETAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 18304 - protein, 158 aa, Shigella flexneri 2a str. 301
MHCHSAFSFSIFLTSCSLSRFSFLAHRLQYLLRVAEPLPNSDRRGSMKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 18305 - protein, 493 aa, Shigella flexneri 2a str. 301
MNKHASQPRAIYYVVALQIWEYFSFYGMRALLILYLTNQLKYNDTHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGYAQEEYSWAMGFGLAAVGMIAGLVIFLCGNRHFTHTRGVNKKVLRATNFLLPNWGWLLVLLVATPALITVLFWKEWSVYALIVATIIGLGVLAKIYRKAENQKQRKELGLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGLVLMIWLYQALKFRNRALALES

SEQ ID NO: 18306 - protein, 809 aa, Shigella flexneri 2a str. 301
MLQALREQGFDTTAIEQQEQEISRSLRQQGELVGRRLQLRQQQRQLSQQIAAADEIARLEQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALFQQDSEISNHLQTLAQNNIAQFAQFSSEVSQLVDTIELHNQHGLAHLEKASARGQYSLLLLGMVSLCALIMILWRVVYRSFTRPLAEQTQALQRLLDGDIDSPFPETAGVRELDTIGRLMDAFRSSVHALNRHREQLAAQVKARTAELQELVIEHRQARAEAEKASQAKSAFLTAMSHEIRTPLYGILGTAQLLADNPALNAQRDDLQAITDSGESLLTILNDILDYSAIEAGGKNVSVSDEPFEPRPLLESTLQLMSGRVKGRPIRLATAIADDVPSALMGDPRRIRQVITNLLSNALRFTDEGHIILRSRTDGEQWLVEVEDSGCGIDPAKLAEIFQPFVQVSGKRGGTGLGLTISSRLAQAMGGELSATSTPEVGSCFCLRLPLRVATAPVPKTANQAVRLDGLRLLLIEDNPLTQRITVEMLNTSGAQVVAIGNAAQALETLQNSEPFAAALVDFDLPDIDGITLARQLAQQYPSLVLIGFSAHVIDETLRQRTSSLFRGIIPKPVPREVLGQLLAHYLQLQANNDLPLDVSQLNEDAQLMGTEKIHEWLALFKQHALPLLDEIDIARASQDSEKIKRAAHQLKSSCSSLGMRSASQLCAQLEQQPLSAPLPHEEITRSVAALEA

SEQ ID NO: 18307 - protein, 527 aa, Shigella flexneri 2a str. 301
MSPEINGHAARGSLRPDVHKLHISDRRETGVIMNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 18308 - protein, 328 aa, Shigella flexneri 2a str. 301
MNCSVLMAKRNNDMDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 18309 - protein, 792 aa, Shigella flexneri 2a str. 301
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPSEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 18310 - protein, 306 aa, Shigella flexneri 2a str. 301
MKFRGGRMSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHSTRPAVMSLVIWSALIPIIPFFVVSLILDGSASMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 18311 - protein, 489 aa, Shigella flexneri 2a str. 301
MHLLTLSINPTFLMRSNHFKEFKMDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 18312 - protein, 474 aa, Shigella flexneri 2a str. 301
MQHKLLINGERVSGEGEKQPVYNPATGDVLLEIAEVSAEQVDAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 18313 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 18314 - protein, 306 aa, Shigella flexneri 2a str. 301
MRFRQLLPLFGALFALYIIWGSTYFVIRIGVGSWPPLMMAGVRFQAAGILLLAFLLLRGHKLPPLRPLLNAALIGLLLLAVGNGMVTVAEHQNVPSGIAAVVIATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 18315 - protein, 146 aa, Shigella flexneri 2a str. 301
MVLAYRVAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITLGNNVTVGAGSVVLDSVPDNALVVGEKARVKVIK

SEQ ID NO: 18316 - protein, 379 aa, Shigella flexneri 2a str. 301
MVYLYKKGVGMNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMAGKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDLDKGTPTVISRPESEFTAIYRQLADRVAAQLYWQGEVIPGEISFRAV

SEQ ID NO: 18317 - protein, 929 aa, Shigella flexneri 2a str. 301
MALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPCVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPHNKGVKGLSGKRCCLTVPNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQTLTVYAERVRKSRDS

SEQ ID NO: 18318 - protein, 831 aa, Shigella flexneri 2a str. 301
MLTIQFLCPLPNGLHARPAWELKEQCSQWQSEITFINHRQNAKADAKSSLALIGTGTLFNDSCSLNISGSDEEQARRVLEEYILVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIVANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPVDWQSEMGEVELVIMLTLGANEGMNHVKVFSQLARKLVNKNFRQSLFAAQDAQSILTLLETELTF

SEQ ID NO: 18319 - protein, 285 aa, Shigella flexneri 2a str. 301
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLCRLADPLEVGELAAFLASDESSYLTGTQNVIDGGSTLPETVSVGI

SEQ ID NO: 18320 - protein, 165 aa, Shigella flexneri 2a str. 301
MAFIMKNKSGNSCYREAVDIHSSLELSFILHKYHLRVDEKKSRNVFSAIRDELILDGDSRQNLATFCQTWLDDEIRELLNLAIDKNMIYKDEYPQMAEPEGRCVRMLSDSWSFPDSRHTLGCSTIGSSEAAMLGRLALKWQWCKKREVQGKSTEPDLRSCANMLA

SEQ ID NO: 18321 - protein, 490 aa, Shigella flexneri 2a str. 301
MPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 18322 - protein, 396 aa, Shigella flexneri 2a str. 301
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGEHLLATLDEMFSPGQEVLDAWGKAYGVLANVFINREAEIYNENASKAGGWEGTRDFRIVAKTPRSALITSFELEPVDGGAVAEYRPGQYLGVWLKPEGFPHQEIRQYSLTRKPDGKGYRIAVKREEGGQVSNWLHNHANVGDVVKLVAPAGDFFMAVADDTPVTLISTGVGQTPMLAMLDTLAKAGHTAQVNWFHAAENGEVHAFADEVKELGQSLPRFTAHTWYRQPSEADRAKGQFDSEGLMDLSKLEGAFSDPTMQFYLCGPVGFMQFTAKQLVDLGVKQENIHYECFGPHKVL

SEQ ID NO: 18323 - protein, 188 aa, Shigella flexneri 2a str. 301
MYERYAGLIFDMDGTILDTAPTHRKAWREVLGHYGLQYDIQAMIALNGSPTWRIAQAIIELNQADLDPHALAREKTEAVRSMLLDSVEPLPLVEVVKSWHGRRPMAVGTGSESAIAEALLAHLGLRRYFDAVVAADHVKHHKPAPDTFLLCAQRMGVQPTQCVVFEDADFGIQAARAAGMDAVDVRLL

SEQ ID NO: 18324 - protein, 342 aa, Shigella flexneri 2a str. 301
MFRQGITGRSHLMSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRK

SEQ ID NO: 18325 - protein, 918 aa, Shigella flexneri 2a str. 301
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISCVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSIQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQRQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLAGENPEGLVDLIHKLHGSCGYSGVPRMKNLCQLIEQQLRSGTKEEDLEPELLELLDEMDNVAREASKILG

SEQ ID NO: 18326 - protein, 748 aa, Shigella flexneri 2a str. 301
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSCIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 18327 - protein, 420 aa, Shigella flexneri 2a str. 301
MPHSLFSTDTDLTAENLLRLPAEFGCPVWVYDAQIIRRQIAALKQFEVVRFAQKACSNIHILRLMREQGVKVDSVSLGEIERALAAGYNPQTHPDDIVFTADVIDQATLERVSELQIPVNAGSVDTLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSIPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 18328 - protein, 507 aa, Shigella flexneri 2a str. 301
MSQQFNPYLCCFRPDTCVNCSRIFSQCLTLCWQEKMVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 18329 - protein, 253 aa, Shigella flexneri 2a str. 301
MILSAFSLQGKVAVVTGCDTGLGQGMALGLAQAGCDIVGINIVEPTETIEQVTALGRRFLSLTADLRKIDGIPGLLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPVVFLASSASDYVNGYTIAVDGGWLAR

SEQ ID NO: 18330 - protein, 258 aa, Shigella flexneri 2a str. 301
MLWIGEEVGKGDGPEVDIAVDPIEGTRMVAMGQSNALAVMAFAPRDSLLHAPDMYMKKLVVNRLAAGAIDLSLPLADNLRNVARALGKPLDKLRMVTLDKPRLSAAIEEATQLGVKVFALPDGDVAASVLTCWQDNPYDVMYTIGGAPEGVISACAVKALGGDMQAELIDFCQAKGDYTENRQIAEQERKRCKAMGVDVNRVYSLDELVRGNDILFSATGVTGGELVNGIQQTANGVRTQTLLIGGADQTCNIIDSLH

SEQ ID NO: 18331 - protein, 468 aa, Shigella flexneri 2a str. 301
MEGIMPDAKKQGRSNKAMTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 18332 - protein, 275 aa, Shigella flexneri 2a str. 301
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 18333 - protein, 778 aa, Shigella flexneri 2a str. 301
MKQIRLLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLSLNVQLKDNIAQLNQEIAVREKAEAELQETFGQLKIEIKEREETQIQLEQQSSFLRSFLDASPDLVFYRNEDKEFSGCNRAMELLTGKSEKQLVHLKPADVYSPEAAAKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTELTAEQEKYLKTIHVSAVTLGNIFNDIIDMDKMERRKVQLDNQPVDFTSFLADLENLSALQAQQKGLRFNLEPTLPLPHQVITDGTRLRQILWNLISNAVKFTQQGQVTVRVRYDEGDMLHFEVEDSGIGIPQDELDKIFAMYYQVKDSHGGKPATGTGIGLAVSRRLAKNMGGDITVTSEQGKGSTFTLTIHAPSVAEEVDDAFDEDDMPLPALNVLLVEDIELNVIVARSVLEKLGNSVDVAMTGKAALEMFKPGEYDLVLLDIQLPDMTGLDISRELTKRYPREDLPPLVALTANVLKDKQEYLNAGMDDVLSKPLSVPALTAMIKKFWDTQDDEESTVTTEENSKSEALLDIPMLEQYLELVGPKLITDGLAVFEKMMPGYVSVLESNLTAQDKKGIVEEGHKIKGAAGSVGLRHLQQLGQQIQSPDLPAWEDNVGEWIEEMKEEWRHDVEVLKAWVAKATKK

SEQ ID NO: 18334 - protein, 261 aa, Shigella flexneri 2a str. 301
MKTLATIGDNCVDIYPQLNKAFSGGNAVNVAVYCTRYGIQPGCITWVGDDDYGTKLKQDLARMGVDISHVHTKHGVTAQTQVELHDNDRVFGDYTEGVMADFALSEEDYAWLAQYDIVHAAIWGHAEDAFPQLHAAGKLTAFDFSDKWDSPLWQTLVPHLDFAFASAPQEDEALRLKMKAIVARGAGTVIVTLGENGSIAWDGAQFWRQAPEPVTVIDTMGAGDSFIAGFLCGWSAGMTLPQAMAQGTACAAKTIQYHGAW

SEQ ID NO: 18335 - protein, 284 aa, Shigella flexneri 2a str. 301
MTDKMQSLALAPVGNLDSYIRAANAWPMLSADEERALAEKLHYHGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVTSKDVREMESRMAAQDMTFDLSSDDDSDSQPMAPVLYLQDKSSNFADGIEDDNWEEQAANRLTDAMHGLDERSQDIIRARWLDEDNKSTLQELADRYGVSAERVRQLEKNAMKKLRAAIEA

SEQ ID NO: 18336 - protein, 487 aa, Shigella flexneri 2a str. 301
MLPLRINPTFLLPSNKFKEFEMDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKQGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 18337 - protein, 558 aa, Shigella flexneri 2a str. 301
MSAAFSTISVILARKFVIAVVKLLPTGEDFASHVYPCYTSHRKETIMTNNPPSAQIKPGEYGFPIKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 18338 - protein, 380 aa, Shigella flexneri 2a str. 301
MVDKIIFTVTPIFSIPPRGAAAVETWMYQVAQRTNFPNRIVCIKNPGYSNYTFVNDNCSIHRVGFSRIYKRLFQKWTRLDPLPYSQRILNIAHDFPITKESVIVVHNSMKLYTQIRKLAPQARVVIHMHNAFEPKLLEQNVKMIVPSLYLKKYYQSYLANADIEIVPNGIDLETYQSNFQPITRSELNISPEEKIIFYAGRIVPDKGILLLMQSFEKLAAAHKNLKLVVIGDYTEMSKSDKGAYQRNVREIAKRLKDRCIMLGSIPPEKMYCYYPLADLVVIPSQFQEPFCMVAIEAMGAGKPVLVSTRGGMTEFVKENTTGFHLKEPMTADSISSDILKTLANPELTAVAKQGQDFVFDHYSWDGVTQRFEEVIHNWFE

SEQ ID NO: 18339 - protein, 430 aa, Shigella flexneri 2a str. 301
MKARQQKYCDKIANFWCHPTGKIIMSLAGKKIVLGVSGGIAAYKTPELVRRLRDRGADVRVAMTEAAKAFITPLSLQAVSGYPVSDSLLDPAAEAAMGHIELGKWADLVILAPATADLIARVAAGMANDLVSTICLATPAPVAVLPAMNQQMYRAAATQHNLEVLASRGLLIWGPDSGSQACGDIGPGRMLDPLTIVDMAVAHFSPVNDLKHLNIMITAGPTREPLDPVRYISNHSSGKMGFAIAAAAARRGANVTLVSGPVSLPTPPFVKRVDVMTALAMEAAVNASVQQQNIFIGCAAVADYRAATVAPEKIKKQATQGDELTIKMVKNPDIVAGVAALKDHRPYVVGFAAETNNVEEYARQKRIRKNLDLICANDVSQPTQGFNSDNNALHLFWQDGDKVLPLERKELLGQLLLDEIVTRYDEKNRR

SEQ ID NO: 18340 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 18341 - protein, 353 aa, Shigella flexneri 2a str. 301
MRLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 18342 - protein, 488 aa, Shigella flexneri 2a str. 301
MKKVNHWINGKNVAGNDYFQTTNPATGEVLADVASGGEAEINQAVAAAKEAFPKWADLPMKERARLMRRLGDLIDQNVPEIAAMETADTGLPIHQTKNVLIPRASHNFEFFAEVCQQMNGKTYPVDDKMLNYTLVQPVGVCALASPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVRALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 18343 - protein, 648 aa, Dictyostelium
MSNSNNNSSSGNHNSTTINNPKVNVYSNIPNSTTYTYGSGGGGTLSGNNTNNNNTNNNNNNNNNSSGDNKNHSPVTSATDRLTKMDIEEKWDNKNYEKDEREKSPLFHILASNLNSFGNFKVPSTFSLTPPEPNKQQQPQQQPQQQQPQQQQPQQQQPQQQQQQQPQQQQQPQQQLQQNNQQQQQQLQQQQLQQQLQQQQQQQQQQQQQQQQKQQKQQQQQQQHLHQDGIVNTPSTTQTSTTTTTTTTTTNPHTSGLSLQHAHSSYTPSNVLHSPTHFQSSLPTRLDTNPITTPIRQQQQSQQQLQQQQLQQIPPPTVNSFFLPPPVNARERLKEFKQIRVIGTGTFGKVYLIQNTKDGCYYAMKCLNKAYVVQLKQVEHLNSEKSILSSIHHPFIVNLYQAFQDEKKLYLLFEYVAGGEVFTHLRKSMKFSNSTAKFYAAEIVLALEFLHKQNIVYKDLKPENLLIDNQGHIKITDFGFAKRVEDRTFTLCGTPEYLAPEIIQSKGHGKAVDWWALGILIFEMFGRLSPFYDDDTFAIYNKILAGRITFPLGFDVDAKDLIKRLLTADRTRRLGALKDGALDVKNHRWFSDINWERLYQRRDNGPFIPKIQHQGDSSNFEMYDEEEMVEEPPSSNYVDPYAHLFKDF

SEQ ID NO: 18344 - protein, 303 aa, Homo sapiens
  unsure (1)..(303): unsure at all Xaa locations
GPLGSMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYXHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 18345 - protein, 2604 aa, Giardia lamblia ATCC 50803
MSEDHFEKIRRGKHSQYKSMTIKAEDCHSWAGSTLGEAPTPSGGATIIPPAVVSNQSFATTISPKTRHIRTHSSSHLDDMSSTSFCINQDCILSQDILKSSDLGTDGFFNSGPYRHMLISDTLRQIIIIGTTDIDPEVRMSIIQALTTTNRYDIYLVHESSLRTLFIALYDDNIEIRILAVKLIGRLCSLNPALVTPEIRHLILVLLTELRLTTENNKRATSNELIVKIFKFCGSIVLPYVPMVYSAVMGLISKDCDDEYLLITSLTTLAELFTIGSTSMVHCLAEVIPLLITCIKEETSKTLRLTTTRCFVRIVEATSFVVFPWFIYHDLFTIVFGILKNDTSQEIRLEAAKLITTIGAIDPIFYQNGKPDLSALVPPTNLTCKCQSTDVFSLDYIMDESNIWVCHKGEGGAAQEASIKSHGKAVVSPITGHVVENVYIMKLDSGSEVSANVSDFELTLNVIMSTLYSILSESTLDMYHYDAVVVFRTIIQTECTAISLPMVPKIISLILENIQNCKVFMQETMLRELILIISSIGHHAHSYVSDIFDIIEVLWANQQLIELILALLEEVSIVLDLSLGNYGSQFFLKFVGLFTVLKSSQEISDSAKKLLIRACRSVVALSSLFSNHIHLIVDLLCSGIRKQKLGKELRFALLDTLSRLTICTNLSRFGASIIHPILEVIMEADPCTSVEHNKNANPEKGLNPMNIVSYKAFEVLHFICAQFGVSVTLYIPVITECLLKVGFTSGLLDSIFSLLLRREEVDPVTFYRLICEWKKKQAKKFSEYTSLASLLAMYETPVTQDTLLYMESISNKVPGDDKDAMILVVKDINFDDIGSVINYLHTSSTWFGDDMRPLPAGAIGVHSLSIQENDMLNKHVTIPQQIWRADTCKKNEEWRHWLSNLSLTLLQCSPLKCLRACHKLATSYPRVARDLFNYSFLACLSETYPSNNEHRNYIVESIRSVFLSQNCPLDVLQILLDLAEFWENRSREFSTTFSHNFLGEVAERCHAYTRSLRYKETEYAQHPIEAVGRLIAINYSLGYEETAIGTLRVECKRLNFISTNLIYDILLRCLYTGLDDVFTMMQREGGLEPGAAVNCSAESTLERIINKVVSKIVTKALTEAKKISNLNQSIPQQLVSYGSIGGIFVEGRPVMSGPEGSVLQVDYNEIGIYLSALARRMLKSKLTYQYPTFLMYEENLFQSVLKTLRYKAQGHMQDLYGPSPKWFENVCLWDKALSGYNRQIDQLKLSLKSNTSEARTLLPMLVNLTKDKIRCLFALADYSAVQEEADQLLNYLSSESKEEAGLTTVKHTLIKGFQADIATYAAWSLLEQDQEDVEIWLRVLPEDNIDGTIIRATSYIKANKMLEAHKLLCKLRLRIDPDLIGLSAESYTRAYNLCILLQTITELQNIISYKLALNGLKLDAPSTLIKEGGNPYENIFETTLISFNPPPGFADTEKERLRLMWSRKISMIRWDCESWEALLRVRRLIIFPIEDQEVWIRFSVLCLQSGRVQLARKTLETFINSSSVHHIKVSKSRGLYTLLGLTSFGTPRRYLKHGSGDVSTGGSVTPIGSALGAEMGVVQDLSAVGSSLAKYLLKDGVVKDAFTAQQHVALPTSDVLSIASHSVAKPTLQMIANASTHQGQSIEKETPLSIVGQQCDDAKRNAQRDLFNALIPPLNHVYPHVLYAYCKHLWVSSNENVLEKLVAFTHLIRLCNDVSIQKTEPKLVCRMLIRLGAWYSDLLTPLDHKSCSMIGTISPSEGYVNIPVQDTVTSCSAIWNSIVNNCDADASVCSTTYEATEHSAERLELSSASTLDKAVAKLVDNILLAYDELSNVSLEECNQYNTVGMSRIGLIALEWFQVAADRDETSNHIWKCISHTTYAIVNSFAAYIDKLNDRPGVDGGLQIVTRRSSVDATSDAVGSTSEALSQSVQDSDRPLVCPEHLGFVQNRQVLLEKAKLEYLVESIIAHFKCIETGRSIEALPTTLRLMTLWFRYGSYDEVETEIINGLAAVPINIWLDVIPQLIARLHSPQHKIRLLVHQLLVLIGTEHPQALIYPLVVASKSTILNRRVESLSIVDQIRRTNEAMILESLNINKELQRVAILWPEIAYDLITQASTAFCEEPRDLVKFFNYACQLQLLASRTPETQSESVFIQMFSSQLQAAWDSCRQFPVTNDLVCLNIVMKHYKEIYDRIHSELPFLNTIDLLQTSPLLYNISNTNLCVPGSYHPARAITTIVKFYQKVFVIRSKQRPRKVGLVASDGEYYAFLLKGHEDLRQDERVMQLFTLINNLLMNDSYCSRRGLMVMKYPITPLSQNSGLLYWVPGCDTIISLIKEFRQLKRIHLETEMQQIKYRAPAFMNMALHYKVDAFKYMLTTSDAIDLCRSLWNKASSAEDWLLKRMNYTRSIAVSSIVGYILGLGDRHPANLMIERTTGMVLHIDYGDCFEVAMHREQLPEKVPFRLTSIMMKAFESCGTEGSFRMTGEATMSILRSNKDSLVSVLETFIYDPLMSMKVLSGENTMGGKENIDGNTEFYGTRRPVQESYLEGNERNPKAVKIVQRIYDKLTGYDIKYIDRSLSVSEQIQSLIHSATNAENLCQLYIGWCPYW

SEQ ID NO: 18346 - protein, 256 aa, Danio rerio
MAASTRLISRLTLVTGGGSGIGRAVCQRFATEGASVVVADSNEESANQTLELLPREHRGQEHMSLGVDVSSKDSVEKLVTSIQRRYFQPPSVCVNAAGITQDEFILKMEEDDFDKVIKVNLKGTFLVTQAVSKALVSAGSVKGSIITVGSIVGKVGNIGQVNYASSKAGVQGLTRTTAKELSKFGIRCNCVLPGFITTPMTDKVPEKVIDKITSIIPLGRMGEPAEVADACAFLASDDSRYITGVSIEVAGGLFIG

SEQ ID NO: 18347 - protein, 638 aa, Xanthomonas campestris pv. campestris
MIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDAALTTLPIGKAQLRHSGARIALLGFGATVDAAEAVGRELGLTVVNMRFVKPLDKAMLLELAKCHEAFVSIEDNVVAGGAGSGVSELLNAEGVLMPMLHLGLPDSFQHHASREDLLAEAGIDQAGIRAAVLKRWPQLMAKGQQALNAAAG

SEQ ID NO: 18348 - protein, 490 aa, Arabidopsis thaliana
MASYGEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 18349 - protein, 494 aa, Spinacia oleracea
MAASAMGVLQEREVFKKYWIEHSVDLTVEAMMLDSQASDLDKVERPEVLSMLPPYEGKSVLELGAGIGRFTGELAEKASQVIALDFIESVIKKNESINGHYKNVKFMCADVTSPSLNISPNSVDIIFSNWLLMYLSDEEVERLVERMLKWLKPGGYIFFRESCFHQSGDHKRKSNPTHYREPRFYTKIFKECHMQDDSGNSYELSLIGCKCIGAYVKSKKNQNQISWLWQKVDSEDDKGFQRFLDSSQYKFNSILRYERVFGPGYVSTGGLETTKEFVSKLDLKPGQKVLDVGCGIGGGDFYMAENYDVEVVGIDLSINMISFALERSIGLKCAVEFEVADCTKKDYPENSFDVIYSRDTILHIQDKPALFRSFHKWLKPGGKVLISDYCKSAGTPSAEFAAYIRQRGYDLHDVKAYGKMLKDAGFVEVIAENRTDQFIQVLQKELDALEQEKDDFIDDFSEEDYNDIVDGWKAKLVRTTEGEQQWGLFIAKKM

SEQ ID NO: 18350 - protein, 474 aa, Zea mays; identical to SEQ ID NO: 1134

SEQ ID NO: 18351 - protein, 247 aa, Leptospira interrogans serovar lai str. 56601
MNDLFNVKNKTVLVTGSTRGIGRYFAEGFKNAGAIVYGTGSSQESIKKFDGSGIKGFAADIRQPDVMTPIIESIVKEHGRLDVLVNNAGIASNKPAAFLKEDEIESIIQTNFTGVFRACTAYYKIHKKKGGNIINIASILGMRGTKLASVYSGTKGAVINMTRALAVEWIGSGYRVNAICPGFIDTDMTEMIKEKPDVLEQMTNAIPMGRLGKPEDLVGAAIFFASDASSYVTGQTIVVDGGITAGL

SEQ ID NO: 18352 - protein, 235 aa, Leptospira interrogans serovar lai str. 56601
MFENIKFIRKYDPAAKSYLEIVLCYPGLHALWFHKLAHFLYRMKLPLIPRMINTFSRFITGIDIHPGAKIANGIMIDHGHGVVIGETATIAKGCLIYQGVTLGGTGKESGKRHPSLLENVVVGAGAKILGNITIGKNVRVGAGSVVMRDVPHDSTVVGIPAKVVRSKMPIGEEGEHMLDHNEIPDPVAKVFSILLERIETLQKEVHSIDKSGIHSVKSNDNLEEILDEFIHGGGI

SEQ ID NO: 18353 - protein, 328 aa, Leptospira interrogans serovar lai str. 56601
MKHYDVFGVGNALVDILVPTENVFIKRLGFEKGIMTLVDSEKQAEVLTALEGSKKELRSGGSAANTMIALANSGGTGTYTGKVSKDTYGEFYKKDMENAGILFEVAPEDKGHTGTCVVLTTPDAERTMLTHLGISITLQKSDVDLEKLKSSSISYIEGYLWDGQGTKEASLLTMEESKKNGVKVAYTYSDPFCVNRSREDFIRLTKEYFDIVFCNTEEAKALSQREDKLEALKFISGLSALVFMTDSANGAYFAENGKISHVDGFPVKPIDTTGAGDCFAAGVLYGITHGFSLEKSTRWGNYVASRIVQEVGPRLGIKLMGRQDEILK

SEQ ID NO: 18354 - protein, 256 aa, Leptospira interrogans serovar lai str. 56601
MENIMKDKVAIVTGGSTGIGKAVVKEFVSKGVKVVFCGRRLEEGKKLESEIRAEGGDVYFVVCDVTSGEQVKKVVDAALEKFGRLDFGINNAGIMGLNHLLHEYPEDVWDKVVNVNLKGTWLSMKYQIPEMIKMGGGVVVNVSSISGINGVVGINPYAAAKHGVVGLTKSAALEYAKKNIRINAICPGAVKTEILDELFHLAKDPVEAERQLVKLHPIHRIASPEEISKTVLWLCSEDSSFITGTAIPVDGGYSAK

SEQ ID NO: 18355 - protein, 704 aa, Leptospira interrogans serovar lai str. 56601
MNSVTIIIAMSILAIVTAVVYTLKVTSIKVGTLGGNEKETKKLLEISSAISEGAMAFLVREYKVISLFIAFMAVLIVLLLDNPGSEGFNDGIYTAIAFVSGALISCISGFIGMKIATAGNVRTAEAAKSSMAKAFRVAFDSGAVMGFGLVGLAILGMIVLFLVFTGMYPGVEKHFLMESLAGFGLGGSAVALFGRVGGGIYTKAADVGADLVGKVEKGIPEDDPRNPATIADNVGDNVGDVAGMGADLFGSCAEATCAALVIGATASALSGSVDALLYPLLISAFGIPASILTSFLARVKEDGNVESALKVQLWVSTLLVAGIMYFVTKTFMVDSFEIAGKTITKWDVYISMVVGLFSGMFIGIVTEYYTSHSYKPVREVAEASNTGAATNIIYGLSLGYHSSVIPVILLVITIVTANLLAGMYGIAIAALGMISTIAIGLTIDAYGPVSDNAGGIAEMAELGKEVRDRTDTLDAAGNTTAAIGKGFAIGSAALTSLALFAAFITRTHTTSLEVLNAEVFGGLMFGAMLPFLFTAMTMKSVGKAAVDMVEEVRKQFKEIPGIMEGKNKPDYKRCVDISTSAALREMILPGLLVLLTPILVGYLFGVKTLAGVLAGALVAGVVLAISAANSGGGWDNAKKYIEKKAGGKGSDQHKAAVVGDTVGDPFKDTSGPSINILIKLMAITSLVFAEFFVQQGGLIFKIFH

SEQ ID NO: 18356 - protein, 334 aa, Leptospira interrogans serovar lai str. 56601
MASQIKTIKRRNRSNVCLLIEGAKMRNTSLKIVNQLAQKDDRVVFIGSDLGPGVLEEMKQSIPDRFYMEGVSEQHVIGMAAGMAMEGFIPYINTIATFLTRRCFEQVALDLCLHNLPVRLIASGGGIVYAPLGPTHLAVEDIAILRALPNMTIIAPCDAEEMKRLMPLTLDWPHPIYIRLAKGGDKVISKPEFGFEIGKAIVMQEGKDGLFVTTGVMTQLALEAIQQLESEGVSCGVIHMHTIKPLDGEILKKWIPKVSAIVTVEEHTRIGGLGSAVLEFCNDEIPNEVGKVRRIGLPDRFSEKYGSQESLLNYFGINKDSLVQTMRDAISIKK

SEQ ID NO: 18357 - protein, 1207 aa, Leptospira interrogans serovar lai str. 56601
MNMTIRGKLIVGFSIILGMLLISVLFVLDMVSDSNDRLKRIVDVSAKKVNLSHEILIGVLEASRHEKNIIIEKDPIKMVYYRDRIYKAVDSVDQNTIELQSYTEVQGSETLQNFISLWTAYKSDLAQIVSLSLENNKGRAFEISISKGLTIRDSIIKTLSYLIKKSEENMQSDKEENERKYYLTFLFFILLVLVSLFIEIAISYWIIRTIGNRIQFISQEAEKIANREFSNVPLAGAYKDELQPIYQFLNKIRESFKEITDNANNVASGNYFVDFVPKSEKDVLGNSLRMMTSSLRKKTQENEKHNWMTNGQNFLNEKLRGDKTESVLAKDVITFLSNYLNANVGAIYLCDDSECSLSVFGKYGFISENRSSERFALNEGLIGQVAAEQKRIFLTDVEEGSLRILSGILDTKPKQILIVPFVFEGKTQGVIELGKLDSFSPSEIEFIESSVQSIGISFNSARARRKIQELLEQTRIQSEELQTQQEELRQMNEELEEQTQVLRQQQEELKVSNEELEEQTHILEMKNKEVELAKSDIEQKTKQLELSGKYKSEFLANMSHELRTPLNSLLILSKDLADNKRKNLSEDQVESANIIYKSGHDLLVLINDVLDLSKIESGKMSVNLERVVLRKFAKELMSTFKLQATEKKLDLDLIFDDDLPEVIRTDSHRLNQILKNLISNALKFTERGKVQVEIKKQNKDKILFSVIDSGIGIPEEKHSAIFEAFQQADGSTSRKYGGTGLGLSISRELAKLLGGEIFLKSKVNQGSTFSLSLPIETNEISISEKENEVFHNSVDSIQNEFINYPTLQDDRNQIGENDKVLLVIEDDLKFASVLIKQANEKGFKCISAATGEDGLILTRKYKPHAIILDLDLPGIKGQTVLNELKADQSIRHIPVHIVSANEYSLELIRGGAVEHIRKPIHKKELDEAFNRIENFINRKMKNLLIIEDDFNSRKMMLKLIGNGDVKCFEADSGKEALRVYAENHFDCIVLDIGLPDMSGFELIQEMEKIKNGRIPPIVIYTGKELTKEEDKELQKYSESIIIKGIKSEERLLDETALFLHRMINDLPESKQNIINNLYDKDSVLFQKKILLVDDDMRNVFALSKILSEKGMNVLKAEDGNSALELLSKNEDVDLVLMDIMMPEMDGYETMKKIREISKYKNLTIIALTAKAMQNDRQKCIEAGANDYIPKPVDVERLFSLMRVWLSK

SEQ ID NO: 18358 - protein, 91 aa, Leptospira interrogans serovar lai str. 56601
MNIYIGNLAYQATEDDLRKAFESFGEVTSVRIITDKLSGKSRGLAFVEMANKEEGNAAIDGLNGTQIRGREIKVNEALPKKPFPEKSRSRY

SEQ ID NO: 18359 - protein, 186 aa, Leptospira interrogans serovar lai str. 56601
MTTIFLLISWYFKVSFQSIQGIRMNQNSEFDIVTLIELAKRNKYERAVAGFHTLDRIERLELPKKIKARKLAVQAMFALASEEVQYQYFTKEERIQLDREANLTNESYSKFNGLFEAPQAPIAEEDTEEDFIPEEAPRPILDGEDDEDEDSLDEDDDDDEDEDEDDDNEDEDDFDEDEEDSEKEED

SEQ ID NO: 18360 - protein, 432 aa, Leptospira interrogans serovar lai str. 56601 [sequence omitted]

SEQ ID NO: 18361 - protein, 508 aa, Leptospira interrogans serovar lai str. 56601
MSNQTYRDSEYLDGLSGEELFNLQIGLTYRDFLVLPGFIDFHPSEVELETRLTRNIKLKRPFISSPMDTVTESQMAIAQALMGGIGIIHYNNTIEEQVALVEKVKRFENGFITDPVILGPKNVIRDLDAIKERKGFTGIPVTEDGTRNSKLIGIVTNRDIDFEKNREITLDKVMTTNLITGKEGITLQDANEIIKKSKIGKLPIVDSQGKLVSLVSRSDLKKNKEFPDASKDERKRLRCGAAVSTLLESRDRVAALYEAGVDVIIIDSAQGNSNYQIEMIQFIKKEFKNLDIVAGNVVTRAQAENLIRAGADGLRIGMGPGSICITQDTMAVGRAQATAIYQTAKHSAKYDVPVIADGGISNIGDIANSLAIGASTCMMGFMFAGTTEAPGEYFYENGIRLKKYRGMASIEAMKAGGDKRYFNEGQKVKVAQGVSGSVVDRGSILNFIPYLSQGLRLSFQDMGYKSIPEIHKALRDGKLRFERRSESAQAQGSVHGLYSFSAPTMRAE

SEQ ID NO: 18362 - protein, 324 aa, Leptospira interrogans serovar lai str. 56601
MAVLTYREALNRAMCEEMDKDPNIFLMGEEVGHYDGAYKVSQGMLSKYGEKRVIDTPISENGFAGVGIGAAMVGLRPIIEFMTWNFSLVAIDQIINSAAKMNYMSAGQFPIPIVFRGAGGAGGRLAAQHSQSFESWYAHIPGLKVIAPYTPSDACGLLKTAIRDNNPTIFIESEVLYGTRGEVPDQEYSIPFGKADIKREGSDITIVSWSRALMYVLPAAEKLSKEGISVEVLDLRSIRPLDEEAIYTSIRKTNRALVVEEGWEVAGFGSQIAYLIQKNSFDDLDAPVERITQEDVPMPYAANLEKASLPSEEKIISKVREMLE

SEQ ID NO: 18363 - protein, 374 aa, Leptospira interrogans serovar lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 18364 - protein, 585 aa, Leptospira interrogans serovar lai str. 56601
MENLQSMPEVQKIISLGKANGEVSYDDINEILPDKILNSEKIDDFFTLLHEMGIEIVEEYTRNTLEPASTLVPKDDSKPARKKKESSASTSGSEDPIKLYLREIGKVSLISGETEVFLAKRIEKGEKIIEETILSSSILRANYIKLLPKIRSKKIKVYDLIRVDKMYALNAEEAHKLEELFFKNILVIQEQEKVLQEAVSKIRKYSETSKKYKEFKEKIDASTEIIHNAIRELGVSQKEIQKISQKIKSMVFRIKEIDRHFLKIKAQYGQDVRDIKAFNRFIEKNEKLDDIEVKMGVNIDEVREVIKDIRNNERKLRRMEQEAGSTVQEIKDWGEKIIKGEREISQAKKELVKANLRLVVSIAKRYANRGMHFFDLIQEGNIGLIKAVDKFEYKKGYKFSTYATWWIRQAITRAISDQARTIRVPVHMIEQVNKVIRETRLFIQEFGRDPNNEEIAERLGWPVQKVKMVKNVAREPISLEIPVGSEEDSELGDFIPDTEVETPVNAAASSILAEQIRQVLHTLPAREQKVIRMRFGLDDGYPQTLEEVGYQFKVTRERIRQIEAKALRRLRHPSRSKKLKDYIDG

SEQ ID NO: 18365 - protein, 610 aa, Leptospira interrogans serovar lai str. 56601
MIRSIFDSEKNCQILLLVNSVVEFETRFRMISSKRTAFPGITAFPGKLYGKVLKTGKRRNTILTGTYVHESEKEAEVEKFSVALEESLHSLRILITSLETSGPDQKEIQEILETQAMICSDPSLATSVRKRILELGENAILAVQNVTHEISEKFKAMENEFFRERVDHFQDVSNRLIEFIAGKKEEEDSFLSGLKEDLILVARELTPSQMILMDKTRIRGIATDLGGKTGHMAILARNYGIPTIVGLKDFSSHVKDNEFIFLDAESGNAIRFPTLEEVKYYGFSSSYPTEENETKKIRAITKDGIRVRIKCNLETELDCEQAIKSGAEGVGLFRSESLFLKYQDSNVSGEEQFLAYKAIAEGMQDKPVIIRTFDIGADKFSTGELEENPFLGNRGIRYSLSNPEWYSEQLTAILRASAFGNVSILLPMITGPVEITRTRKLLEECKRKLSAKKERYNKKIKIGAMIETPAAVAALDLIAREADFFSIGTNDLLQYIMAVDRNNIHVSSLYNPYHISFLRALIRIVEVSRDYDKPLSLCGELASDTDFTIFLVGIGIRELSVSIPFLSPIRKIIRSISLHQAGILVKKILELSEQENYESIEAFLFSKHLS

SEQ ID NO: 18366 - protein, 347 aa, Leptospira interrogans serovar lai str. 56601
MATIETIKIQRELTKIKHPELKKDIVSLGMIGSLDIQEGETNILLKTPNQDRRIQIGLEAQIRQVLTKLEGIGKVKIKFEVDPKLVLDDSNKIPGVKNVIAIGSGKGGVGKSTVTVNIAAMAASLGYKVGILDADIYGPSVGKMFGINGRVALKAEEDKIYPLEKDGLKLISFSFLIDEKQPVVWRGPMLGKAVEQFLYDIVWDELDYLFIDLPPGTGDVQLSLAQLIDLNGAVIVTTPQSVALLDATRASAMFSQVKVPILGIVENMSEFICPKCGHASAIFSKGGGHKLAESSETSFLGGIPLTMEIMNAGEDGKPAILKDKNGPVYQAYKIIFDKLNEEIKKWE

SEQ ID NO: 18367 - protein, 434 aa, Leptospira interrogans serovar lai str. 56601
MDVQNKDVNSHPKGLTILFFTETWERFSFYGMRALLVLFLTKVFHFSDVDANRIYGIYTGLVYLTPLLGGYLADRYLGFKKCIFLGATLMMFGHLSLAFETKPFFFLGLGLLILGVGFFKPNIATVLGRIYDEDNKTRMKDSGFTIFYMGINLGGFLGPLFCGYFSKSWGWGYGFGVAAFGVLFGILILLLGQKQFPEKVFEPGKKYHTVEGQKHSTLKKEEKQKLAVIFIFTLFVIIFWAAFEQIGSSINLFIDRHVNRNLFGYDIPTPFFQSLNPLLILIFAPIIASFWTTLAKNNWKPDTSTRFATGFFILALGFSVLTLVTLDFRPGHKISAVWLLLMVLCITVGELFTSPGGLALVTKLSPKQLGGFMMGVWLLSSFFGNILAGELAGFMKTDSFPTFFGMFAILAFVGGMILYITRKKLQNWMHGADQ

SEQ ID NO: 18368 - protein, 731 aa, Leptospira interrogans serovar lai str. 56601
MEPNRTNFEHSQEIYEILVNQISDSMLVTDTQLEPPGPKILFVNPAFCKMTGYTKEDLIGKTPRMLQGPLTNRKIMRDLKRSLTQGKDFSGETINYKKDGSPYHVEWRISAIRDLSGNILCFISIQRDITEKVKKGESVTRHLRLEMGITSATQILLSTSVELKILKYAMEQFLVFLDSERLYLFKNSENAESAELYLEVKDPSLETSEIPVLQSIVYNQDYSRWKKIFSSGGYLQGNLSEFSENEKKFFDQREICSVTLIPLFVSDEWFGFAGFENFKTTNIVKEEIFTIRTFVDLISVFLERKNILEELKVHREKLEVLVSQRTEELNLQKEMAEKANKAKSEFLANMSHELRTPLNSIIGFSRLMQFPEGMERENRYLDLIFHSGVHLLNIINDILDLSRIEADKLVLNESDFDLKELISTSVEMILGEAITKKLEMTFEFFPKNANFEIRADPKRIRQVILNLLGNAIKFTDSTGKILITLNKLENNFQLAVQDSGIGIPTEEISKIFETFYQVKGEDRAAYEGSGLGLPIVKKIVEAHHGSIQVESALGKGSKFVVIFPFFTRLEHLNVSNSFSQEAEESPYPFHLKSVPILLSIQDRIYDRAIEKYFIHNSQEFISFRTVKDFSKIPQKSLDLHKILLYDTRLLLEETEVVKFLRSLLNEDSNFKHLILLETADIPLPFQEDLLPFFPNYTIQNPFSLDKLKSILIEIEKEIYLGNRTEKEEYSS

SEQ ID NO: 18369 - protein, 935 aa, Leptospira interrogans serovar lai str. 56601
MEVKIVSLENDHILFLFFTNFESYFSETPSIFLQDSELRSTIFQKSANAILLLDPDKDLILEINQTASRYFEIQNQSEILNLPFSNLLAQDFTHFEYTSRKKKILSGETPSWDLEFKTLRGKKFWGNTSCRMISTHLNKIILVQIKDITEKVNTRKSLLEQAGTIAEHEANLNAIIENSEAMIWSIDKNYKLLIFNSQFQNVMQNFYHSEISTGFNLFQKELPPEIAKYWKEFYDRALSGEKVSVARKRPNQDGTFIFSELSFQPIRNTEYEITGVSAISVDITDKKLAEEKFRLLFERSSEPHVLYDDFGILECNPATLKMLRCSDKKLVLGKHPIHFSVETEKEKTNELESIALEKGSYTFEWVYKRFNDEEFSVEVTLIPIIIHQKRVFLSVWHEITERKVYEDSLKRAKEIAEAASKAKTDFLAMMSHEIRTPLNGVIGTVSLLEGTFLNTEQKEYLDIIKSSGQNLLILLNDILDLSRIESGQLKLEIQPVSPEKLTNEVVNLFRPMAEEKGLVVESEVSFNVPNWIISDPYRLRQVLTNLIGNSIKFTEKGKIHLSVEAEKFPNDKLRLIFHVKDTGIGIAEEKLELLFRAFSQVDSSTTRKYGGSGLGLTISKKLAELMKGEITVKSQVNSGSEFSLSILTEKLEYEIPAGVQELHSKNLATSAVISIQEFQFKEQIKKFCERNGFLVKMARTAKETIRIIGEEERIGVFLTDLNFPDMNLSEMLNELKKQNPSLKLTVILFMEKELKDSYYLVTNSLFNRPGFQIFMMFKPILLEELSKNFEKAFPIKVLKKEKQNENKKLLSEKIPLQILLVEDNVINQKIALRLLTKLGYNADSALNGLEGIEKLKTKNYDLIFMDIQMPEIDGYETTFQIRKDFGKSKPVIVAMTANAMEGDREKCLEAGMNAYISKPIQIQDIESTIVLLFQS

SEQ ID NO: 18370 - protein, 320 aa, Leptospira interrogans serovar lai str. 56601
MGAPSTSTATEKATRDGYGDALHELGASRPDVVVLDADLSGSTKTNKFAKAFPDRFFNVGVAEQNLVGHAAGLALSGLVPFASSFAMFLSGRAWEIVRNSVVYPFLNVKLVASHGGITVGEDGASHQCIEDFAIMRVIPEMTVICPSDYNECKQIIHAIADYKGPVYVRVGRPNVPIIERENYKFQIGKAEVMREGKDVLIIANGVLVNEAIKASEELSKEGIQVTLLNMATIKPIDKETILKYAKECGIVVTCEEHNVVGGLGSAVSEFLSEEYPVHVLKVGMKDQFGKSGTWKELLDYFGLRSKNIVETVKKAKTLKK

SEQ ID NO: 18371 - protein, 301 aa, Leptospira interrogans serovar lai str. 56601
MFHIRHEIYLILCTLIWGGTFTMTIFGLRDTSPSIFLGLRFGIASMIFLPFAWKEFRKGKIWYPGAFLLGMFLYLGFACETIGLKTTTATKSSFLIGTLVVITPIFEAILKKRMPGKGNLLGASVVFTGICLIFAGEIGMEGTLTITNGDWITLGGAIFFSLYIIQMDRVSIQIPIRISVFYQSFVAGFFALVSVIILHFVGIEKVRLNPSARLIPGVLYNALLASVLTTFLQTKFQRYVSPTRVGIIFSLEPVFSSIIAFLLLGEKSGPVRIVGCTIVFLGLILAESIGKDQNLSMENTN

SEQ ID NO: 18372 - protein, 278 aa, Leptospira interrogans serovar lai str. 56601
MNNKENPLKQTIMLNNGISMPILGLGVWKTKSGKECKEAVLNALEAGYRHIDTARIYDNEVDVGQAIRESGIPRKEIFITTKLWNADQGSDKTRKALENSLDRLGIDFVDLYLIHFPVTSKRMDSWKELEKLYHDKLCKAIGVSNYTIIHLTELLKNSQITPAVNQVEFHPFLNQIHLLEYCKKHKIQLEAYSPLAHGQKIEDPTIAKIAQKYDKTPAQILIRWAIEQKIVVIPKSIKKERIIENSKVFDFAISEEDMKILNSLDEDFRTCWDPSEVV

SEQ ID NO: 18373 - protein, 634 aa, Leptospira interrogans serovar lai str. 56601
MQQELTLLDRINYPAELRNIPLEKLPQICKEVRNYIIDTLSGIGGHFASNLGVVELTVALHYVFDTPKDRLVWDVGHQTYPHKILTGRKDKLNTVRKFNGLSGFPKREESPYDLYNTGHAGTSISQALGEAAARDLVKENYNVVAIIGDASIATGMALEAMNHAGHLKKDMIVILNDNYMSISKNVGSISNYLNNIITSHFYNHWKRVFYTFLKWLPIIGPATERFFKKVEKGFKDVLTPGGLFEDLGFGYIGPEDGHDVIRLVKMLEKVKKMKGPILLHIITQKGKGYDPAERDPIKYHGVTPFRKEDGAMDSGDTSKIAYSKIVGKMLAILTETNPKIAAITPAMIEGSGLKEYAEKYPEHLFDVGIAEQHSVAFAGAMTNGNIIPYMCIYSTFLTRAMDQLVQDVSLMNLPVRFVIDRAGCVGPDGETHQGLFDLGYLLGLPNMDVFVPSNGQDLIDALRWMEKYDKSPVAIRFPKSSVDLKTLDFYKETELQPGTFRVFKRGTDVALISIGSMIDEAKKASERLENEGLSVTLIDLVWLRPLGAEALNEELVNVRCFVILDESYIDSGVTGYLLNRMTRENLSKYIKTFGFPPEPIHHGERKEVFQKYRLDGESIAEQVAAVLKKNLIKP

SEQ ID NO: 18374 - protein, 391 aa, Leptospira interrogans serovar lai str. 56601
MDMTTSVCLLGASGSVGESTLKVLRAHPEKFRLHSFSVHSNLEKAKEIQKEFSPDFICVSSDFADVGVLGNKLGRTQILYGESSLCELVREPEVEIVITAIVGSVGLRPTIAAITAGKRLGIANKETLVTSGPLIQSLIAKHNTKVVPVDSEHNALFQLLESLNPNSVEKIILTASGGAFRDLPVEQLSSVTKEQALHHPTWNMGPKITIDSNGMINKGLEVIEAHFLFNVPYDKIGVVIHPQSIAHGIVELKDGASFLYASYPDMIFPIAHSLFHPEPVPKVLRSYPAKDWGKLEFREPDFKRYPGLGLAFEAGKVGGTAPCIFNAANEAAVELFLKDEIRFIEIPDYIRETLDEIKIEFPLSLEEYEEADRIARETVRNLKARKVVSAC

SEQ ID NO: 18375 - protein, 348 aa, Leptospira interrogans serovar lai str. 56601
MGIMGMKAAVLESGKKILEIRDVSVPQLRAEQVKVRIKACGICGSDVHLVVHGTLKCKHFPRVPGHESSGIIEEVGENVRRFRKGDRVVIAAGTSCGVCSYCKEGKENLCKDLGVFGFDRDGSFAEFNIVEERYLYSLPDEIPFDQGAILADAVSTPYHAIRYRGNIQESDTVAIFGCGGLGIHAVAIARAMTKGKVIALDVDSGALENATKYGADEVVNLKEVRNSGKVLKEVSKGVDLLADFSGYMSNVEDSIRAMNPGGRIVLVGIGRQPLKFQIPFILIEKMISVSGSYGSDRRAIPELIELYLKGKINLSHSITSHHPLEELNECLEALDQRKGNPIRFIVEP

SEQ ID NO: 18376 - protein, 259 aa, Leptospira interrogans serovar lai str. 56601
MREIMSKQFEGKVALVTGAASPRGLGRAIANTIAKEGGDIVLVDLNKEQIEQAAADVAKEFGVKTLGLSCNVTKPEDCDSVIAGVKEKFGKLDFLVNNAGVLKDNLFIRMSEQEFDFVLDVNLKGVFLMTKYASKLLLKAESGRIVNISSVSGLTGQPGQANYSSSKAGVIALTKVAAREFAGRNVLVNAVCPGYVQTDMTASLPEEVQKKLTDPAFIPLRRPGTQQEIANAVKFFLSDQSNYITGTYLRVDGGAAIGM

SEQ ID NO: 18377 - protein, 696 aa, Leptospira interrogans serovar lai str. 56601
MNESSHKTFTDKINEFYKRSFELFSKGSYLEEMDKFYSLCKTTLYADFIILLESKDPLSIKIVESQPKFNFSIDQTNINLLSISYSENRPVLPYTLTRQEINFSNFDALEEIDFAQMIAVPIPNENIEDRRKNILLFLYSKNTEHISEFLKLITELSPRIYEIFSIKNKEILLNSVHSRLDSILKTIPQAIIFMDSGTGKTWINESAAKLLSLSEGGEVSSWKVSTSMTELIQSAVNQKEIFLEMNRNLSNMNLEKFSTQWMFTDPEKKVFEVTSLLLPGKTAPGRLWFFEDITSFHSQQETLALLNQALKEKSEIAQQENQAKTVFISNISHEIRTPMTGILGITELLLNTPLNPDQKDSLELIQRSGDKLLKIVNHLLDFSKADTGKIELESIPFNMQELLNDLVSLLRTEILKNKNELNILFPPNFPKLLKGDPVRIGQILTNLVSNATKFTKEGTVEVGFHILEKTNSELSFRTWVFDTGIGIPPTKFNSVFEPFVQSDKSITRHFGGTGLGLSITKKLIELMGGKIHVESQPGIGTRFWFELKLEIPESIDEESFTENSEAEVITDKSDLSRLKVLIVEDNLINQKLLGRILKKKKIEPFLVEDGMKAIEKARKFHYDLIFMDINMPGIDGLSATEIIRKFPKGDSIRIVGLTANAAPEIQKVATQRGMDDLLTKPYNVSQIEKILNLFEK

SEQ ID NO: 18378 - protein, 86 aa, Leptospira interrogans serovar lai str. 56601
MSVNIYVGNLSYDLNEGTLGDLFRAHGTVNSVKIIMDQYSGKSKGFGFVEMPNKEEADKAIKDLDGKNVLTRNLKVNVAKPKNERF

SEQ ID NO: 18379 - protein, 114 aa, Leptospira interrogans serovar lai str. 56601
MKLIVAIIQPHKLEEVKSELTKNEIYRLTVSDVQGYGQQKGKTEVFRGHEYQVNLLRKVRLEIAVNDEFVKPTVDAILKAAKTGDGKIGDGKIFITPLEDVIRIRTGERGSSAI

SEQ ID NO: 18380 - protein, 440 aa, Leptospira interrogans serovar lai str. 56601
MGAPLKTPDGFNIGTLCVFDSQPKHLNPKQRVILKALSNQIIYNFELNKKNIELLLIQKKEEELQKSKSLFFANMSHEIRTPVHGILGVSGLLSETELQQEQKEYVDTIQRSGKLLLNLLNDILDFSKLESFNMKIEIIAFDLIDLLKDVFHLFEADAKRKNIEFKLVGKQPSHSIVSTDPHRFKQILVNLISNAIKFTEKGSVLIEFDFKSDLKHCDIQIRIKDTGVGIPEQKLKELFQAYRQVDTSVSRKYGGTGLGLSISKNLSEMMNLKLTARSIINQGSVFEISGQIPLAEKSEVNFEPKKATQNIEIQNLNILVAEDNETNQMLIKKILEKLGYKPVIVSNGIEALHHIKMYKTDVLFLDIQMPELNGIEAAKILTQQNDSSIRPYIIAMTANASQTDKEDCMASGIDQYLSKPFHKEEIADLLNQFISHKTTN

SEQ ID NO: 18381 - protein, 180 aa, Leptospira interrogans serovar lai str. 56601
MSNLKKEILVAVSGSIAAYKTCELVRNLTKEGYPVSVIMTANATKFVGPITFEALTGKKVRVDEYEQGMAHIDAKNSASVIAIVPATANIIGKMANGIADDLVTSTYLAANCPVVIAPAMNPFMYAHPSVQRNLKRLIEDGVILADPSEGVVVCGDEGYGKLAEISIIQKMILDLYQRNF

SEQ ID NO: 18382 - protein, 473 aa, Leptospira interrogans serovar lai str. 56601
MKMNSFSASYKNLGRTVRTLHHLAHTFYRNIRPSLLNSMILKLAVPVVFGMLSQTVVWVTDTMMVGRLGKHSIASIGIGGIAHFTVLAFLMGFSMGIQVIVARRFGEKNDSEIGKIGVTALYLVIVFGSILSIGGATISEWLMNLLNKDEIVRRLSSEYLYFRFLGTIFFFLLFTTRAFTDGLGITTAGLASMIITCFTNIFLNWMLIYGNLGFEPMGVKGAAIASSLAGGAGLFAFPFYFYSKDLGKYFSHISWVFSWDHFREILKASTAPALAELLNNISFMIFTEFATIVGTTALAVTNMLFSTLSLSFLPGYAFGIAATTILGQALGAGKPKLAYHGAFRSAFFAACVMGSMGLVFIFWGKDMLSFYTKDQELIEEAYSPLLILGMIQVVDAYHMVIACALRGAGLQDFVFRAYTAASYLVFLPSAYFMGIYLGMGSAGLWSGIVAWVLVLASVFVVRFRRKDWVQNPV

SEQ ID NO: 18383 - protein, 820 aa, Leptospira interrogans serovar lai str. 56601
MRFLLLYIIFLFHYSLMAESLSPVSGKISQLQKDSSLSFFVYYFSSDSDENFRERIFAKDSSLSFQNIPAEVFSLGFTSNTVWFYIPLKNDTEKDYRGEFEIFNSYLEEVDIFYRYGSKDSIHEILAGTSRVYEKSFPALNFYLRPGEEIQIVCKIKSGTPMRIPIVLESEENFNFTKLFRAILFGLTLGFGIAMGLYNFSLYMFFRTRSYLYYFIMILFSTVYLASWDGLISPLFKPNYGRYYLPFILVLFYTSALFLFLFSMEFLYPEKKERYVKIIIFLYVVVNLLLIPLSIFYPTHLNRISYYLGLVNNLIIVYFCIVRIRGGFKSAKNFLIIHLVFPVAGILTNLSTFGAISIDYLSLHLLKLAFISQSVLFSVMLVQRIKELEFRLKDGLQSEIHKNIVLLKKEIQQRRETEWELIQAKEVAEKASKVKSNFLANMSHEIRTPMNGVLGMVQLLGTTKLNDEQKEYVEVLSVSAKSLLQIINDILDFSKIEAGKVILEREVFSIRSVLDEIHDLLYPLAKQKEINFRLEGKLEIQEYVYGDPLRLRQILWNLAGNGIKFTSRGEVVLKVTQKNISKSSVSIEFTVMDSGIGIPLEKQKQVFEAFSQNDTSTARKFGGSGLGLSITKQLVELQGGVLKLESKDGEGSKFTFTIDYDIPSALEIEKILEAEKTKDLEKSFQDVVAKSTRILVAEDNETNCLLIERALKKLGYDPTVVHNGREVIERMQLEAFDIILMDIHMPEVDGIEATKWIRSKNQNSEFPIIIALTADAIESSKEKYISKGMNDCLTKPLDLPILKSTLDLWSNRVDVSHWKL

SEQ ID NO: 18384 - protein, 384 aa, Leptospira interrogans serovar lai str. 56601
MFDSNLVFILFYSGEFFLTDFSESLIDLFSAVKTGKTNEIQKLLNALKGEAILIDWLKDYRDSYGSGVLSWAVKNSDQEAIELLLEAGAEPDETNARGETPLLNALDQNNEDLIRIFLEAGADTEKKDFAGNTPLTKAVSTGNVSIVEMVLENEYSTPDLEERNGEGYTPILLAVDLGHLDIVEYLLDQGADFLKKNSEGRTILHLTALHNDFEILDLFLEKEETKIILEDKDADGNTALLLASSHDSVECLEKLIQVGANILQLNASGKTGLEEAERQKYHHVTKILKKVLTEKLFFAAKHGEDELCKNILQIGISPNPIDQEGNTPLHVAVIHDQISTTELLIQWNASPFLKNLNGKSPLDIAKAAEKIELVRILEPEPEND

SEQ ID NO: 18385 - protein, 201 aa, Leptospira interrogans serovar lai str. 56601
MSKSPSDQNLSGKKSDSDQKKVKTEFLISKNIESDSITFQLSTKEDSVIRTDNKILSDFLNKLENLVTRDREEIPSFTRIYHKEKLISETFNEVEKKSDSSFHSEILCIRNAKEKLKTRYLADCMLITSLEPCLMCAGTILLSRIPKVVYLLPAKQGEGISSLSIEMIYSRNFFPELFCIPTEISKNAFKSFFKVRRKKFN

SEQ ID NO: 18386 - protein, 254 aa, Leptospira interrogans serovar lai str. 56601
MIDLKGKNAVVTGAARGIGKSTALTLAKAGANLVIADLNEESSKATADEISKQTGVKAIGIGTNVSDVDSAAKAIQACVDEFGSVDILVNNAGITKDTLLMRMKKEQWDAVIAVNLTGTFNCTQAAIKFMMKNPNGGSIINLSSIAGVNGNIGQTNYSASKAGVIGFTKAVALEMASRKVRCNAIAPGFIATEMTDAIPEKIRTAMVAAIPLKRAGQPEDIANTIAFLASDISSFITGQVIEVNGGGFLPGATA

SEQ ID NO: 18387 - protein, 436 aa, Leptospira interrogans serovar lai str. 56601
MSVTTQEKDLSYKVKDLSQAEWGRQEIILAEKEMPGLMALRQEYKGKKPLAGARIAGSLHMTIQTAVLIETLTELGAEVRWSSCNIFSTQDHAAAAIAKAGIPVFAWKGETEEEYWWCIEQTIFFGDKGPNMILDDGGDLTAYIHEKYPKLLSEIRGISEETTTGVKSLYKLLKKGELKVPAFNVNDSVTKSKFDNLYGCRESLADGIKRATDVMLAGKVALVCGFGDVGKGSAASLRNFGARVIVTEIDPICALQASMEGYQVLRVEDIIEQVDIVVTATGNDDIITLEHMKAMKDGAILCNIGHFDTEIQMSRLNNEKGVTKKEIKPQVDKYTFPDGKSIIVLAEGRLVNLGCATGHPSFVMSCSFTNQVLAQIELYNNKYELGVYTLPKHLDEKVAALHLEQLGVRLTKLNQKQADYLGVPINGPFKPDHYRY

SEQ ID NO: 18388 - protein, 869 aa, Leptospira interrogans serovar lai str. 56601
MNIFKIESQSSGFFAIIHLTIKKELLSKMIKSLRISCIFFILISFLTFLLNCSQFKQNNPIASNGVIDLSTWNPNIESINLKGNWEFCWDQWIPPNAEESQWKENCNGFYPAPAYWKFYNIPGKNLSPFGKATYRLKVILPTSFHDSYGIRWTEILSAFQIFINNKSVAQIGVLGTDFNTMTPKLKPDRTEIGPQNNQMTIVIWVSNFNHQNHGFWQPIYLGKWEIIRNTQVSHLMMDIASFASVALIGFYHLVLFLFRTRSKEYLFFGLFCISMGIRQLSVEDHAFIIFFPDIDFDFYIRFIYFTVLSIGIFMCMFIKSLFPEEVSSFFINSAIGVFGCSSFTLALPVRVFTEFFSIIFVLISFLPLGLTTYLFKAHKMKRKGATLILIAYLIFSTVVLNDILFTLGYISTGYISYIGITVFIFFQAGVLAQQLTQAFNHSEDLALELKSTLQENIETHNELLALKELQNTNLEFQVQSRTRELLKARDDAEFANKVKSQFLASMSHEIRTPLNGIIGLIEQFKSTPLDESQQHIRNLIQKSGENLLKIINDILDFSKLEEDKINLELHEFYWKETVEETIGIFLYQATQKGLVLSVDYSPDFIDKSVGDKRRITQVLSNLISNAVKFTDSGKIQIRAFSEKIETKIEYKIQVIDSGIGIPREKIDLLFQKFFQLDSSISRKYGGTGLGLAISKKLVELMNGKIHVSQNKSKGSTFEFTVLLSEFVSKDHSTYLPEITDLSSLSPDTFILIAEDDSTNIFLLSGILKKLKIKFELAKDGLEAITKVRVSRFDLIFMDINMPHLDGISASNFILTDPMISPKPVIIAVTADVLQEDKIKCRQAGMSDFLGKPYYKKDIEQMIYKWLVIH

SEQ ID NO: 18389 - protein, 472 aa, Leptospira interrogans serovar lai str. 56601
MDSLKSKSDELIQNKMTSEGLSSAFIQDFLKKTDLVRNGETGMVRWEEVGDLDPKADEITLEQIESENAPEPSILKNLVVIKLNGGLGTSMGLSGPKSLIELKNGMSFLEIVAKQSEVIEKKYNVSVPLILMDSFNTQKESQEELNRIGFRQKFPTSFLQHKVPRLLKKDLTPISCKNPDEEWCPPGHGDIWISLLETGLLDTLIQNGYKIAFVSNGDNLGATVHPGILSYMLKEKLEFCMEMTPKTLADKKGGAIYKRMVAGRAENYQLLETAQVPPEHMHEFEGLGKFRTFSTNNLWIDLVALRQRILLGSFELSLIVNPKTIEGQEVLQLETAMGSAIRNFEKVKGIIIPRDRFAPVKKCEDYLARRSDAYHLLENYSITMSDKRKESGLGEILIYLDERYYKKIGDFNRLFPEIPSLELCSSLTVQGEVLFDQKISIVGEVVIQNNETLPRRISDLKTRILESGKYSF

SEQ ID NO: 18390 - protein, 103 aa, Mus musculus
MSGRGKGGKGLGKGGAKRHRKVLRDNIQGITKPAIRRLARRGGVKRISGLIYEETRGVLKVFLENVIRDAVTYTEHAKRKTVTAMDVVYRLKRQGRTLYGFGG

SEQ ID NO: 18391 - protein, 84 aa, Burkholderia brasilensis
LIKPFKLDEVREALAEVGLTGLTVTEVKGFGRQKGHTELYRGAEYVVDFLPKVKIEVVVANEQTDQVIDAIIGAARTGKIGDGK

SEQ ID NO: 18392 - protein, 84 aa, Burkholderia tropicalis
LIKPFKLDEAREALSAIGVSGITVTEVKGFGRQKGHTELYRGAEYVVDFLPKVKIEAAVSDDIVDQAIEALERAARTGKIGDGK

SEQ ID NO: 18393 - protein, 84 aa, Burkholderia kururiensis
IIKPFKLDEVREALAEVGLTGLTVTEVKGFGRQKGHTELYRGAEYVVDFLPKVKIEVVVANEQTDQGDHAIIGAARTGKIGDGK

SEQ ID NO: 18394 - protein, 550 aa, Dictyostelium discoideum
IQYKQQSRLSNYTIMLRDIPNSMFTREELSNYFKSHLSNPSDLLDVSLQYPAPHIYALVSERENFVKKYESAIESYRRTKEKPTTKIGFLGCFGEEKDSIDYFQEKIDELTKKIEYERAEAETGYYIKNANSNVGGSSFVIFNQRKVQKEMVQTIMHAKYHVLFSRYYAPDPNDVFWKNIHIGLKSYYVRSLIVAILTFALVFLWGIPVAFLSGFSNLETISRVKAFSWITDIISKSKILQGFLSGFLPNLILIIFMILLIPIIYALSRACGYFSNSRIEASVFSKYFLFLVFNVFLVSAIAGTIFQSIEQIANDPTSIIGSIANSLGGLSFQMINYILIAAAGSFGAILRIVGLIIQLIKLKWLAKTKRQIDDTLHQGPFAYGVNYAKNLLILQLTLAYSTLSPFILIFGAWYFGLSYLVQKYNIIWVNTPNYQCGGFMSPMHFRRTIIGLLIYHILMIGTFNVYKFYYGILVVICLVVTIVFWYFAEYKFKDISKSGIMDQYQKQQTDGTNSGDIEMKASGSSVINDSTSLNPTVHQEFYKMFLGLFF

SEQ ID NO: 18395 - protein, 387 aa, Synechococcus sp. PCC 7942
MDIQLGRGKTVRRAYGIDEIALVPGDRTVDPAVTDTRWTIGGIEREIPILASAMDGVVDVKMAVRLSQLGAIGVINLEGIQTRYEDPEPILDRIASVGPTEFVPLMQELYAVPVQESLIRKRIAEVKSQGGIAAVSATPAGAAKFGPVVAEAGADLFFIQATVVSTDHVAPEGVEPLDLAAFCQSMPIPVILGNCVTYDVTLKLLKAGAAGILVGIGPGAACTSRGVLGVGIPQATAVSDCAAARDDYERETGRYVPIIADGGLITGGDICKCIACGADAVMIGSPFARAAEAPGRGFHWGMATPSPVLPRGTRIKVGTTGTLEQILRGPAQLDDGTHNFLGALKTSMGTLGAQTLKEMQQVYVVIAPSLLTEGKVYQKAQQLGMGK

SEQ ID NO: 18396 - protein, 977 aa, Synechococcus sp. PCC 7942
MKLRRQFLLFGVGTTFTAIAAISLSDVITNTRLSESSREEVQSLLQREQESILSRTYTVVRVQGTSIEKQLSRQIQVLDEALQRAGGLRTGSRLVRWQAKNQYTGAIQPVELPELQLGGRWLDQVSRFDQAVPVIDTVSRQMGGTVTIFQRINDRGDMLRVATTVPNQDKQRAIGTYIPVTNPSGDPNPVIAAVLKGQTYRGPAYIVNDWYIAIYQPLKDAQGRVIGMIYAGQRQDQTGELARSFQDLRFGQTGSAFVFLGQGSQRGETILTSDPSLQKKNFWDAKDASGQFFLRTSIADAIRQPGAFIRVRYLARPWTEGLQSTQPARQEQMLLVYYRPWNWVIGIRQDEQEFAEPFRRLEAIQQRSLYIQLLLGVIIAVLGAIAARGWAAHLGMRIEQLAHAADAMASGQLQQQIPTSGRDELTVLAQAFNRMAVTLRELLVSLEHRVQERTAALRETNDRLEQAREQAEAANQAKSAFLANMSHELRTPLNAIIGYSEMMMEEAEDGIEVEELLPDFRKINNAGKHLLELINSILDLSKIEAGRMELYLESFSLPELINGVKSIIKPLIEKNQNQLLVDCPADIGLMTADVTKLRQTLLNLLSNASKFTHQGTDSAAGCCQGDQVVFKVVDSGIGMSPEQIDRIFEAFAQADDSTTRKFGGTGLGLSISRHFIEMMGGKITVESVLGEGSTFTITLPRQVQPPQSIPAVDPVLTDEAIATATEQEDQNQPVVLVVDDEPSARELLRRMLEKEGYRVVTAAGGAEGLQRAQELRPALITLDLMMPQVDGWSVLTALKADPMLAEIPVVMVSMVEGRSLSYALGAADYLHKPIDRDQLRRILERYTHPDRQPLALVIEDDPVNRSLLRQLLERDGWQVAEANQGQQGLAVLESLEQPPDLILLDLMMPQMDGFAFVDALRANGNWQTLPVIVVTAKDLTEQDRQRLQGRVSQVIAKGNLAIDRLLAEIRQVGANRV

SEQ ID NO: 18397 - protein, 369 aa, Strongylocentrotus purpuratus
MADQGGAKTKRTNEEKPETVRGQVFDVGPRYVTLNYIGEGAYGMVCSAVDTRHGGKVAIKKISPFEHQTYCQRTLREIKILTRFNHENIINIQDIIKADTIEAMRDVYIVQSLMETDLYKLLKTQPLSNDHICYFLYQILRGLKYIHSANVLHRDLKPSNLLLNTTCDLKICDFGLARIADPGHDHTGFLTEYVATRWYRAPEIMLNSKGYTKSIDIWSVGCILAEMLSNRPIFPGKHYLDQLNHILGVLGSPSQDDLKCIINEKARAYLQGLPFKSKIPLKSLFPKADNKALDFLERMLSFNPDKRITVEEALAHPYLEQYYDPDDEPVKEEPFTFVTELDDLPKEKLKEMIFEEASKFNPSPSPNTS

SEQ ID NO: 18398 - protein, 1127 aa, Dictyostelium discoideum
MTDKLKFKTSLLNKVPPPPPKSNQPSPSTSTPASPNVNSTNNSPSVSPATTSPIPSPGMSPLLTPENNNNNTNIPHQTSLLNNSISNKSSVSFLNNSGGNTINKSSPLSQSSSNIKNGGPIRTSTTLAQFSGSSLPNTENSSPPPSSSLISSSSSPTAESLLYSEDSIASGGTVTVDPNTKNGNIYNGNGLRNNSADILPHNNHTYCVGDDGFYLFGGTLPDGSYTNDFYTFQFAIKAWTILTFGSAPSIRTRHTGVLYNNSMYIFGGYSPSGPKNDIYVFSFDTQTWSEVQTEGTKPSPRYGHTAVVESGHMIVFGGISCDQTTKQQTVNNDIFSLNLDTKQWSQVLSTCPPSPRTHHTATMHKGNMYVFGGQDQQSNQVEDIVHCYTWASNSWKSIQFEGSSMTPRSDHSAVLFQDSIFISGGSSKSQTSQNLEIYEYDLYQKKCFKISSSTIVQNRISHSSVVKGNSILFWGGCTDNSFDYFSFGKDEFEEDYQDDYESNRVQNIPKELWEASLMKKHPEILELREKTLAFTGSKSFAKTLATPSFSENRLALSHQFVLQLIMEYLERNTYHKVIEAIQKESGVLHQPTESGESRLVSLLRLVKPRLRNKNVFDTDLSLFSKEEGNDPEVAVVDHLYHDYRHLDEEEDITVWEEGEDTNRNIRKVETDNNKVQIKAATFNKLIHYLAPKEKAFDPNFLKVFLYTHSSFTTSEKLLKKLIQRYQVPNSNANEPKYKSEVVEPVRQRVVDVLKYWVDKCPWDFNAGPTSSVLVATLNNFIDGSLTRDGNSNIKKLRELKKKLQHEDVRPYSEPPPEPKVPKNIFSPQLTLAHIDELEIARQMTLVESKLFGAIPPPEFMVRVIGYGEFQYNMATSPNLMTFVNRATDVSRWIVHTVLNESRDKKNKMKMLDKFIKTTECLRQLNNFQTLHSVLQGLQHPLLLSRPDLFTPRHREIIADHEMLFSKIDNYKLYREALARSQPACVPWIDIIREDFAQIERDQPSNMNNLINFTKRQNLYEILSKIGHYQFPYNLQIVHQVATFVNKLPKYSEYDLNLLSESLQSQVNSPLAGVYQPSLIGTTGSSSSINLGSARELNNSNRDSNNITGSSSNNNSNSSNSLSPIVKL

SEQ ID NO: 18399 - protein, 593 aa, Pseudomonas aeruginosa
MHRTSRRTFVKGLAATGLLGGLGLWRAPAWALAGPGQQNLLAGDSFDLFIGETPVNLSGSPAAAMTINGSLPGPTLRWREGDNVTLRVRNRLAEDTSIHWHGIILPANMDGVPGLSFEGIAPGGLYEYHFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMAGMDMNGMDHSRMGMDTMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGARRSYRVTADALGRWAYHCHLLFHMEMGMFREVRVDEGDNA

SEQ ID NO: 18400 - protein, 493 aa, Corynebacterium diphtheriae
MTNAFSRRQFLLGGLVLAGTGAVAACTSDPGPAASAPGSSLRPTPTPTALGEPTVRRTLTARPLSLDIGGIEAKTWGYVSDTGDAAIEATAGDVLQVDITNELPESTSIHWHGIALHNAADGVPGMTQDPIEPGESFSYVFEVPHGGTYFYHSHTGLQLDRGLHAPLIIRDPQDAEDQDVEWTIVLDDWVDGIQGTPDDELDKLTGMGSGDHNGKKGMGGHGHMMHGTPDRVLGGDAGDVMYPHYLINGRIPRAHRTFEARPGDKARLRFINSGGDTIFKVALGGHRMTVTHTDGFPVQPWETESIYLSMGERVDVEVILGDGIFPLTALAVGKDDRAFAVIRTAGGQAPHPDVDFPELSSTGLLLSSLKPADRALLPEGTPDREVSIDLGGQMMPYEWRILTDGQSSSATVQEGQRLRMVMRNRTMMPHPMHIHGHTWALPGSGGLRKDTVLLRHGETMIADLIADNPGEWAFHCHNAYHMETGMLSSLRYE

SEQ ID NO: 18401 - protein, 591 aa, Bordetella pertussis
MSRAVSNQRRRFVQGLAGGGVLAGLGLWRQAAWAQPGAAQPEVLSGTEFNLEIGRTPANFTGAARMATTVNGSIPAPILRWREGDTVTLRVTNRLDEDTSIHWHGILLPTGMDGVPGLSFPGIRPGETFTYRFQVRQSGTYWYHSHSGFQEQTGLYGAIVIEPRRADPVRAERDHVVLLSDWTDEDPMSVFRKLKVMPDYYNYIQPTVDNLIDDARKQGWASTLGERLMWQQMRMNQTDLADVSGATYTYLANGKSPAGNWTGLFKPGERVRLRFINGSAMTYFDVRIPGLKMTVVAADGLPVRPVEVDEFRIAVAETYDVIVEPAEDRAYTIFSQAMDRSGYARATLAPREGMQAEVPALDPVQVLTMMDMGMAHDMPGMDHGAAGQQGAAMDHGAMGGMDHAAMGHGSSEASGGMVEVRHPYPAEHGPANSMLPDIVTTRLDDPGVGLRDNGRKVLTYADLRSMVEPEDNRAPTREIELHLTGNMDRYMWSFNGLKFSQAKPIVLKYGERVRFVLVNDTMMTYPIHLHGLWSDLESPDGNFQVRKHTISLNPAQRISYRVSADARGNWAYHCHLLYHMEAGMFRAVVVE

SEQ ID NO: 18402 - protein, 464 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 18403 - protein, 1001 aa, Homo sapiens
MPTEKKISSASDCINSMVEGSELKKVRSNSRIYHRYFLLDADMQSLRWEPSKKDSEKAKIDIKSIKEVRTGKNTDIFRSNGISDRISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQMSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSVNTKDSVPGVSPQLLHIKIISGQNFPKPKGSGAKGDVVDPYVYVEIHGIPADCAEQRTKTVHQNGDAHIFDESFEFQINLPELAMVRFVVLDDDYIGDEFIGQYTIPFECLQTGYRHVPLQSLTGEVLAHASLFVHVAITNRRGGGKPRKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 18404 - protein, 611 aa, Homo sapiens
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 18405 - protein, 261 aa, Homo sapiens
MAATAREDGATGEERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 18406 - protein, 778 aa, Homo sapiens
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 18407 - protein, 691 aa, Oryza sativa (japonica cultivar-group)
MAPVEDGGGVEFPVGMKVLVVDDDPTCLAVLKRMLLECRYDATTCSQATRALTMLRENRRGFDVIISDVHMPDMDGFRLLELVGLEMDLPVIMMSADSRTDIVMKGIKHGACDYLIKPVRMEELKNIWQHVIRKKFNENKEHEHSGSLDDTDRTRPTNNDNEYASSANDGAEGSWKSQKKKRDKDDDDGELESGDPSSTSKKPRVVWSVELHQQFVNAVNHLGIDKAVPKKILELMNVPGLTRENVASHLQKFRLYLKRIAQHHAGIANPFCPPASSGKVGSLGGLDFQALAASGQIPPQALAALQDELLGRPTNSLVLPGRDQSSLRLAAVKGNKPHGEREIAFGQPIYKCQNNAYGAFPQSSPAVGGMPSFSAWPNNKLGMADSTGTLGGMSNSQNSNIVLHELQQQPDAMLSGTLHSLDVKPSGIVMPSQSLNTFSASEGLSPNQNTLMIPAQSSGFLAAMPPSMKHEPVLATSQPSSSLLGGIDLVNQASTSQPLISAHGGGNLSGLVNRNPNVVPSQGISTFHTPNNPYLVSPNSMGMGSKQPPGVLKTENSDALNHSYGYLGGSNPPMDSGLLSSQSKNTQFGLLGQDDITGSWSPLPNVDSYGNTVGLSHPGSSSSSFQSSNVALGKLPDQGRGKNHGFVGKGTCIPSRFAVDEIESPTNNLSHSIGSSGDIMSPDIFGFSGQM

SEQ ID NO: 18408 - protein, 1430 aa, Mus musculus
MTVFRQENVDDYYDTGEELGSGQFAVVKKCREKSTGLQYAAKFIKKRRTKSSRRGVSREDIEREVSILKEIRHPNVITLHEVYENKTDVILILELVAGGELFDFLAEKESLTEEEATEFLKQILSGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYDFEEEFFRNTSTLAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINNDNVPGLQHLLGSLSSYDVNQPNKHGTPPLLIAAGCGNIQMLQLLIKRGSRIDVQDKGGSNAIYWASRHGHVDTLKFLNENKCPLDVKDKSGETALHVAARYGHADVAQLLCSFGSNPDFQDKEEETPLHCAAWHGYYSVAKALCEVGCNVNIKNREGETPLLTASARGYHDIVECLAEHGADLNASDKDGHIALHLAVRRCQMEVIKTLLGHGSFVDFQDRHGNTPLHVACKDGSAPIVVALCEASCNLDISNKYGRTPLHLAANNGILDVVRYLCLMGANVEALTSDGKTAEDLAKAEQHEHVAGLLARLRKDTHRGLFIQQLRPTQNLQPRIKLKLFGHSGSGKSTLVESLKCGLLRSFFRRRRPRLSSTNSTRFPPSPLAAKPTVSVSINNLYPGCENVSVRSRSMMFEPGLTKGMLEVFVAPSHHLHCSTDDQSTKAIDIQNAYLNGVGDFSVWEFSGNPVYFCCYDYFAANDPTSIHIIVFSLEEPYEIQLNQVIFWLSFLKSLVPVEEPIAFGGKLKNPLRVVLVATHADIMNIPRPAGGEFGYDKDTSLLKEIRNRFGNDLHVSNKLFVLDAGASGSKDIKVLRNHLQEIRSQIVSGCPPMTHLCEKIISTLPSWRKLNGPNQLMSLQQFVYDVQDQLTPLASEDDLRRIAQQLHSTGEINIMQSETVQDVLLLDPPMALHNVLGKLLSVETPRALHHYRGRYTMEDIQRLVPDSDVEELLQILDAMDICARDLSSGTMVDIPALIKTDSLQRSWADEEDEVMVYGGVRIVPVEHLTPFPCGIFHKVQVNLCRWIHQQSAEGDADIRLWVSGCRIANRGAELLVLLVNHGQGIEVQVRGLETEKIKCCLLLDSVCSTIETVMATTLPGLLTVKHYLSPQQLREHHEPVMVYQPRDFFRAQTLKESSLTNTMGGYKESFSSITCFGCHDVYSQASLGMDIHASDLSLLTRRKLSRLLDPPDPMGKDWCLLAMNLGLPDMVAKHNVNNRASRDFLPSPVHALLQEWTSYPESTVGILISKLRELGRRDAADFLLKASSVFKINLDGNGQEAYASSCNSGTSYNSISSVVSR

SEQ ID NO: 18409 - protein, 516 aa, Shewanella oneidensis MR-1
MTTPVDAPKWPRQIPYIIASEACERFSFYGMRNILTPFLMTALLLSIPEELRGAVAKDVFHSFVIGVYFFPLLGGWIADRFFGKYNTILWLSLIYCVGHAFLAIFEHSVQGFYTGLFLIALGSGGIKPLVSSFMGDQFDQSNKSLAQKAFDMFYFTINFGSFFASLSMPLLLKNFGAAVAFGIPGVLMFVATVFFWLGRKRYIHMPPEPKDPHGFLPVIRSALLTKVEGKGNIGLVLALIGGVSAAYALVNIPTLGIVAGLCCAMVLVMGFVGAGASLQLERARKSHPDAAVDGVRSVLRILVLFALVTPFWSLFDQKASTWILQANDMVKPQWFEPAMMQALNPLLVMLLIPFNNFVLYPAIERMGVKLTALRKMGAGIAITGLSWIVVGTIQLMMDGGSALSIFWQILPYALLTFGEVLVSATGLEFAYSQAPKAMKGTIMSFWTLSVTVGNLWVLLANVSVKSPTVTEQIVQTGMSVTAFQMFFFAGFAILAAIVFALYARSYQMQDHYRQAT

SEQ ID NO: 18410 - protein, 1188 aa, Shewanella oneidensis MR-1
MEQREEQVERHVLQIDLLLESSIRAVKSLRDVAVDHLRLGELVRKERLPQYGKFNESGQYFTLEPNYAKGGKPFTNMGRITGAGSLDGRSDKFYQELEMLFELSLSFPVAKEAAPKASAIYYLSRQRMMSYFPWTNDDERFRDELLNKKQFQYATPAMNPQRSVFWSEAYVDSTGKGLLTTLGVPVYLDDEFMGSINLDMTLASLARQIRVYFKMPGTVILLDQQNNILSHSDFDGSDINRVYHISQRIPSELHSLPESELFDAHEGIIRNGYYIHSVALHNAPWRLLYLQNEDDLFQDSVEKLQLTFILVVIALSVLVTIVHWQTRRSFVSPASRLLSHLEGCSQEPRKPPEKITPGWEPWFLLVSRIFEENKQYTHHLAEQNKRLDKLVARRTERLKDATERREREYALLRSLLDSIPEAIVFKDKEGNYLGCNKAAERMLGYTESEMIGLSSEDLTSPEMGIRIRAEDAQILKDRTPLRYQEKVELAGKPVLLDTLKLPFYNRRGELQGLIAVWRDVTREYESAEQLRLSEERYHLAMDAVEDGLWDWYLDSEHIICNPSYYSMLGYKPNEFPALVSAIDQLTHPDDRIRVEEYRNQYLENPVDAYEIEFRILGKNSSYHWVLSRGRVVEFTTDGQPKRMVGTHKDITRHKSNEVALLEAKQDAELANLYKSEFLANMSHEIRTPMNAIIGMLQLAQRTSLTAQQKDYLEKAGFSAQSLLRIINDILDFSKIEAGKLELERVPFPLDKVLDHALDLNALKAQEQGVELLLYAPVTAGLILKGDPLRLGQVLINLLSNAVKFTQSGEIELGCEDVGERDHRITLKFWVRDTGIGISKDQQEKLFDAFAQADGSTTRKYGGTGLGLSISKHLVSMMGGKMQVQSELGVGSTFSFTISFEIAEEAKIEPLVVPEKLNNLRTLVVDDNPTALQIYSALMRDFHFEVDTAASGAEALYKLSRDPIDLLLLDWMMPEMDGSDVISAIDTMVAEGRIAKRPIIIMMTAYAAEPLLHEVDSANVFAVLQKPFKASSLFDEIIAAFADEPRLNVVQPIAEVAVEEGEHTGLVLLVEDNFINQQVATELLKSAGYEVVVAGNGQIALDIVDSRPFDAVLMDIQMPVMDGLTAARALRERYSADVLPIIAMTAHAMSGDREKSLAAGMNAHITKPIVLTELFETLTHWIKHKHNHR

SEQ ID NO: 18411 - protein, 112 aa, Shewanella oneidensis MR-1
MKLVSAIIKPFKLDDVREAIAGIGIEGMTVTEVKGFGRQKGHTELYRGAEYQVDFLPKVKLEIATKAENLDMLIEAITTAAHTGKIGDGKIFVIDLEHAIRIRTGELDTEAL

SEQ ID NO: 18412 - protein, 1765 aa, Shewanella oneidensis MR-1
MDKSKLRTFRSKILSHIALPLILIMATVYGITSWFNYLSIEKRLYENLAQESSHSASRLQFLLEHAQANTQGLSDFIGLLADKDDINNPEKLKTVLTNRIQRNPDFFGSAIAFKPNTFPNKKLFSPYVYRSGSGFNYLDIGADGYDYTDGNWDWWSKAINQVGGYWSKAYFDEGAGNVLMITYAVPFGVQPDYFGVTTVDLALDRLPEQLGIAPSRLVVLDDQGRLIFHSDKEKVLAASSSGWLDKQNIKNIAFATLLNDGQAGQASFVDDKGTVYLASVAEVAKLKWRVVVMVPKHELFASLLDDIASAILNLSLLTLLLLLTCYIAAKRLTRPLEALESGILAFGQGKAQELTIPKGAVSEIVTLSETFNQMAALLAEREQAILDSRGNRFARLIDGMSDKSFYCSLDPDGQLAQVSEGVTKVLGIPPELLKRKYQRLFSANPLNEKNWEYTDLALKGQNVPPHQIELVDAKGQARRLDVFMQPLVSDTGELMSVEMLFTDVTEQFSAAAWSNAVLEAAPEAMLIVDQNGQIVFSNSRCQQLFGYDAKAMLALQIETLLPEELRHLHTGERLDFLREGRDRPMASARHVRALKSDGGEFVAEIALSILPSDFDGRRQVAASIRDMTQKIMVEQKIRDSELRFRGLVTNIPGAVYRTRIGEVWVIEYVSDNIAEITGYAASQFIENRQRTFTSLILEDDRALCNQHIERALAQQETFEVEYRIRHRDGSIRWVHEKGKASYSEEGLPLWFDGSIDDVTESKLAIDEIEASRQQLTNITESIPCTVYQLRWVSPTDRSFTFLSGAALAMLGLHREELLRDFNIIAERIFDEERPEVISALAGKSDDQLRWIREFRYRHPNGGIRWMEAGASGHYADDGSIIWNGYVMDVTERKSIEEELAVSEAHFKALFDGATIGIVNVDIKGLILDCNYQFCEDMGLSRDELRSTPIFDVLSAQDKDVAKAQFKELVEGKIDHYRGERSFVRPSGEPLWMTVNVSTLLDSQNQFESAVVSMVDMTELKLLSDELLVAKDEADAASKAKGDFLANMSHEIRTPMNAIIGMSQLCLQTQLDKKQKNYLEKIERASQSLLSIINDILDFSKIEAGKLDIENVSFQLDTMLEDLSDMFSERAAQKQIELLFAVAPNVPRHLLGDPLRLGQVLINLMNNAIKFTERGEVLLSLSLVEQQNDDVVLRFSVRDSGIGLTQEQQSKLFKSFTQADTSTTRKYGGTGLGLAISKQLVELMGGSIGVESQLGHGSTFFFTVKLCISSGQKLFVGQELDGMSILVADDNATARDIMRTTLESMGFNVDTVRSGDEAIMRCSQQEYAVALIDWKMPNLDGIETAKQIKQQTKNAPRILMVSAHANQDFLTQIEQLGLAGYISKPISASRLLDGIMNALGRSGILPVRRHQDNIAPELLLPLKGKRILLVEDNEMNLEVATEFLEQVGIILSIATNGQIALDKLAQQSFDLVLMDCQMPVMDGYQATKAIRQRPELAQLPVIAMTANAMAGDKEMCLRAGMNDHIAKPIEVNLLYQTLLKYLGAPVPSLENAEFVVNESLNPLNLDVESVVKWPEHPELDIDRGLQLVQNSKRLYQRIFDRFATSQRNVVDQINKALASNKREDAVRMAHTLKGLAGNLSSSKLAELARQLELHLSENADYQVELDQIQILVASICEAIEKAKPQFEETSTSTAEHLPKDALIAALKQLRQSLEDADSDAVTQMDALKPQMSALLWQQLSPALTMINQYQFDEAVDLIDEVLAKLT

SEQ ID NO: 18413 - protein, 285 aa, Shewanella oneidensis MR-1
MKVLGQFSAKPAMDGDGVNIRRVADFISTQFDPFLMMDEIKSDDKQDVIGGFPPHPHRGMETFTYIRKGGFEHRDQMGNVKAIRTGDVQWMSTGYGVVHSEMPLADALNGLHGFQIWVNMPAKDKLRPATYQDTASIPSVETTNDTGATLKALAGDWAFAGKSTISATIQGLAGEAAIADLMINANGEAQLDLSKHEFAALYIYQGGLSKGEGSQWSFNEGQFLVLDSQTPLQLKADDRGAGMLLFVGKPIREKIVQMGPFVMNTQAEIQQAIRDYQEGRFGQIA

SEQ ID NO: 18414 - protein, 1244 aa, Shewanella oneidensis MR-1
MAISPNRASHTLADIRNQLSTRILILDGAMGTMIQGYKLEEADYRGERFKDWHTDVKGNNDLLVLTQPHIIKQIHTDYLLAGADIIETNTFNATTIAMADYDMQSLSAEINREGARLAREACDAIEQATGKPRYVAGVLGPTNRTCSISPDVNDPGFRNIHFDELVTAYCESTRALIEGGADIIMVETIFDTLNAKAALFAIETVFDELFGANSPARLPVMISGTITDASGRTLTGQTTEAFYNSLRHIKPLSIGLNCALGPKELRPYVEELSRIAECYVSAHPNAGLPNEFGGYDETPEDMAKVIQEWAREGMLNIIGGCCGSTPEHIKVIREAVEQFAPRVLPEIPVACRLAGLEPLTIDAQTLFVNVGERTNVTGSAKFLKLIKEGKFEQALDVAREQVESGAQIIDINMDEGMLDGVEIMHKFLNLIASEPDISRVPIMIDSSKWEVIEAGLKCIQGKGIVNSISLKEGEEKFIEQATLVKRYGAAAIIMAFDEQGQADTKARKVEICTRAYRVLVDKVGFPPEDIIFDPNIFAIATGIDEHDNYAVDFIDAIKEIKATLPHAMISGGVSNVSFSFRGNNPVREAIHAVFLYHAIKVGMDMGIVNAGQLAIFDDIDPELKVRVENVVLNLPCPVEGSNNTEQLLEIAEKFRGDGSSSAKKEDLEWRSWPVNQRLAHALVKGITEFIDEDTEAARQAASRPLDVIEGPLMDGMNIVGDLFGSGKMFLPQVVKSARVMKKAVAYLNPFIEKEKVAGQSNGKILMVTVKSDVHDIGKNIVGVVLACNGFEVFDLGVMVSVERILEAVKEHNIDIIGMSGLITPSLDEMVHNVKTFHREGLTIPAIIGGATCSKIHTAVKIAPHYPHGAIYIADASRAVPMVSKLVNNETRQATIDETYAEYDDMRTKRLSQAKRKEIVSLEAARENRCQHDWANYSPFKPNVLGRQVFDDYPLTDLVDRIDWTPFFRAWELHGHYPEILSDKVVGVEAQKLFSDGKAMLKKIIEEKWLTAKGVIGLFPANTVGFDDIELYTDETRTEVELTTHHLRMQLERVGNDNFCLADFVAPKDSGVADYMGGFAVTAGHGIDEHVARFEANHDDYNAIMLKCLADRLAEAFAERMHERVRKEFWGYAADEQLDNEALIREKYKGIRPAPGYPACPDHTEKGLLWELLKPNETIDLNITESYAMFPTAAVSGWYFAHPKSRYFGVSNIGRDQVEDYAKRKGMTVAETEKWLAPVLDYDPE

SEQ ID NO: 18415 - protein, 296 aa, Shewanella oneidensis MR-1
MLYLFPLLAVVIWAGNAIVNKLSFGIIAPEAIAFYRWFFAMLILTPFMLKSVWKNRRRIIPLLPKLATLASLGMVLNQSLAYFAAATTTATNMALINSLVPMISLFLAVPLLKQRLSPLVLGGSVISLLGLVFMLSHGDIANLAIGVTEGDLLLLISAFVYALYGVLLKRWQLPISTWESVYIQGIIAVLMLTPLLFSAPSIAISSQATPLIVYAAFGASLIAPWAWINGINKLGAERTSIFFNLMPILAAIFAAIILNETLAIYHYLGGTMVILGVMLVQIKPKPKTTTIITCAE

SEQ ID NO: 18416 - protein, 1025 aa, Shewanella oneidensis MR-1
MAPLSLSRRSLTGRLMLAFSVLGLLLLLLVSLGSLSLHWLKQADRYLYEESLPASQAARQLVQASNALSDGVTQLGQVEDERQREFIGRKLNLESATMLNSIKVLLALDVNEDNHLPVLAGQIIEQLTLLGQSVGQRITLGDELQRRARELSVAAAHASELLQSELAVVDSAILAKLSQAYPDMAGNKRSGQLLDDVIERELDIQEQLNRALKLVHQIALLSQLFEVSELQSELQLSVPRLLATFASTLPSHPVAHINQQKGTAIEQASEAVTELSAPEVGIDLMALTTVSELIRDPGRLNALKAELVTLKHTPKIIKLQRDLSQSLQRQQRQQQALAEKLYSLNTLVDSALNQQQQRAELARSDYLMQLSYARFGLLATGMLMFVIMGWVIYRVIYRGIALRLNQATQAMSRLSLGDINVSLDARGDDELTAMANAIEAFKRKTAHNLKLQADLRQVADELTEHKKALEQTVATRTQELAETNLRLDAEAKGHAKARVVAEEASQAKSQFLATMSHEIRTPLNGLLGTLTLLGQSQLPPAQQQMLALSQYSGTLLQTVLSDILDFSRLEQGNLTNEPRPTDINALLDEVLAIMVAGANLAGLSLRLNRPQLPACINIDGPKLRQVLFNLIGNGIKFTSEGSVSLNVSLQGGRLAFVVADTGVGIAPEVREQLFIPYSTLPNQGRSRGTGLGLAICKQLVELMDANGRGIWVKSEPGKGSEFGFELCFTQCDKAQDAQTLVHKQVHTQRVLVVEDNKVNAMVAQGFLAHLGHSSTLAASCQLALECVSADKAFDAVMLDIQLSDGSGVALLPQLKALFGAKNVKFAAFTAQMQMEDLSLYREVGFDTVLAKPLSLQTLTQWLGVAMASSSLETESPGLSASPSFISASSAPLAQATDTSGAIPLGNQATETLLDIEQLQQDIEVLGVKAVSDMLALYKTSSAEQIERLSEATFVESSADSAKLLHALKGSSASMGLKALTQCCQVWEKQLKTTGAQKLEIQSANELRACWLASMTALEQWLVTVE

SEQ ID NO: 18417 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 18418 - protein, 616 aa, Shewanella oneidensis MR-1
MDHTPQSQLKLLLAKGKEQGYLTYAEVNDHLPADMVDSDQIEDIIQMINDMGIRVFEEAPDADDMMMSEDNTDEDAAEEAAAALATVESELGRTTDPVRMYMREMGTVELLTREGEIVIAKRIEEGINTVQSSVAEYPQAIAMILEQYDQYEADELRLSDIISGFVNPDEEDLGPTATHIGSELSEEDLEDEDDEEDDEDEDGDGDGDDDGNKGPDPEEARERFSQLRTAYESALKIIDAKGREHPESIQALFEIGEIFKEFRLVPKQFDRLVKSMRSMMDRVRVQERLLMKLCVEQAKMPKKNFVKFFTGNETNLDWFEAEKTSNKPYAEGLRMVEEDVQRCRSKLAAIEEETGLVIAAIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPSPEELAERMMMPEDKIRKVLKIAKEPISMETPIGDDEDSHLGDFIEDTTLELPLDSATSESLKSATHEVLAGLTAREAKVLRMRFGIDMNTDHTLEEVGKQFDVTRERIRQIEAKALRKLRHPSRSEILKSFLDE

SEQ ID NO: 18419 - protein, 744 aa, Shewanella oneidensis MR-1
MLNTLRDITQAVASAHSLETALEVLVSSTKAAMETQCCSVYILEQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHAFVLGGEISLEQPDIRCEDIVLESNRLVAAMGRCKEAIGALSQRFDREQDEEVASIFNALQLLLDDASLGGEYAREVLLGWEAESAVSRVSLRYIQQFLAMEDPYLKERASDIRDLGQKVLRQLIEPERLELEPDKPVILVTKEADATMLAEFPRQKLAGIVTELGGVNSHAAILARALGVPAITGVEQLLSADIDQKLLVVNASRGQLMVSPSPAIVSEYRSLISAQKALQRQYAQELTLPSVMLDGKRIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGAEGKQLSILLPMVSNLDEIDQALAYLEQAHVELKNDVNSNIKMPRIGIMLEVPAMLYQLDEVAKRVDFVSVGSNDLTQYLLAVDRNNPRVSSLFDSYHPGILRALHQARLDCEYHHLDISICGELAGEPMGAILLVAMGYHQLSMNQGSLARINYLLRRVSGEDLAQLLAQALSLSNGFQVRELVKEYLTLQGLVTILN

SEQ ID NO: 18420 - protein, 434 aa, Shewanella oneidensis MR-1
MTSYQILCILSALALVTSVASSRLHKLQETVAITALALGTSLLLLLGGKALGGNVYGYFVAGLEKLDFQALLLNGMLGFLLFAGALQIRLKILRHQKWEILILAFVGTLLSTFIVGGLLYYLAPMFGLPLALSHCLLFGALISPTDPIAVLAILKKMGAPEDIAIQVEGESLFNDGIGLVIFVAISHLAFSTEPLTFTQISLLFVQEALGGVLYGAVLGLLLHHFFRYCEEETQLMLVTLLIPTAGYVMAAELGVSGPLAMVSAGIIIGNYSVPKFFARQERVKLYTFWSLIESFFNALLFLLLGLLLLLVTFKAPLWWFMLLAIPLVLTARAVSVFLPYMGFRLVKSYNPYAESILIWGGLRGGLALAMAMSLPKGIIIDSQPGVELHELVLVMTYAVVVFSILIQGSSMTGLIRRSNAVVTRPDSHTTQESR

SEQ ID NO: 18421 - protein, 622 aa, Shewanella oneidensis MR-1
MSLDISQFPVLAQANTPNELRQLPQALLPQLADELREFLLKSVGMSSGHFASGLGTVELTVALHYVYNTPFDRLIWDVGHQAYPHKILTGRRDRMHTIRQKNGLHPFPWREESEYDTFSVGHSGTSISAALAMAVAAEKEQAGRKVVAVIGDGAMTGGMVFEAMNHAGDLHNDMLMVLNDNEMSISENVGALNNHLAQLMSGRFYTTIRESSKKVLKGMPVIKEMAKRTEEHLKGMVVPGTLFEELGFNYIGPIDGHDVDALVETLRNMRNLKGPQVLHIMTKKGRGYEPAEKDPIGWHAVPKFDPSLFKKPATKPGLPTFSQVFGKWLCDIAEQDEKVLGITPAMREGSGMVEFSQRFPKQYFDAAIAEQHAVTLGAGFACEGYKPVVAIYSTFLQRGYDQLIHDVALQRLPVLFAIDRGGIVGADGPTHQGAFDLSFMRCIPNMVIMAPSDENECRQMLYTGYCYDAGPSAVRYPRGSATGATQVEAMTALPIGKGVIKRLGKRIALLNFGTTLAAALTAAESLDATVVDMRFVKPLDVDLVKEMAQTHDVLVTVEENAIMGGAGSGVLELLQQLKMPKPVLQIGLPDEFIKHGSPDEVIHDLQLDAEGMLAQINAYLAN

SEQ ID NO: 18422 - protein, 396 aa, Shewanella oneidensis MR-1
MQNMVILGATGSIGASTLSVISANPTAYRVYALVANASVDKMLTLCLAHRPQVAHMVDHKAALALKAQLPAALNIQVTSGEDELIALVTAPAVDTVMAAIVGAAGLVPTLAAVKAGKRVLLANKEALVMSGELFIEATRASGATLLPVDSEHNAIFQCLPEEVQSNLGRCDLAASGISHILLTGSGGPFLTAELSNLAAMTPAQACKHPNWSMGPKISVDSATMMNKGLEFIEARWLFNTQKDQLKVVIHPQSVIHSMVQYRDGSVIAQMGNPDMRTPIAHCMSYPQRIRSGVEPLDFFKVGQLSFCEPDFNRFPCLALAIEACSQGQEATTVLNAANEIAVEAFLQGKIGFTHIGKINEDCLLSVPKQAMASIEDIIALDAQTRIYARELLAKFA

SEQ ID NO: 18423 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 18424 - protein, 567 aa, Shewanella oneidensis MR-1
MSITGIIVSSGIAFGKALHLNHCENHLDYRPIPLSRIPLQQSKFLKALQALKQQLSLSQAKLDPESENYQLIEADLLLLDDDELIEQVKEAIRTLQLSASVAVERIFAHQANELESLDDPYLANRAQDVRCLGQRIVTAINGRLEQGLADLSEATILLAQDLTPAEFALLPKEHISGIVLKTGGLTSHTAILARAAGIPAMLSCQFDAEFIPNNTPLVLDALSGVLYVNPEPEQQARLTVTLHHEQARRQALQTYRDVPAQTQDGHHVGLLANVGNLNEITHVKDEGADGIGLFRTEFMLMNTSTLPDEKAQYNLYCEALHALDGKTFTIRTLDIGADKELPCLCQNIEDNPALGQRGVRYTLAHPELFKTQLRAILRAANHGPIRLMFPMVNQVEELDEIFKLIAECQDALEEEEKGYGELSYGIVVETPAAVLNLASMLPRLDFVSIGTNDLTQYAMAADRTNPQLTKDYPSLSPAILHLINMTITQAKATGVTVSLCGELASSPQMAPLLVGMGLDELSVNLSSLLEVKAAICQGELAKFSELAHTAMQQNRISDLQQCITNYK

SEQ ID NO: 18425 - protein, 273 aa, Shewanella oneidensis MR-1
MGVIARLKEDIESIYHRDPAARSAFEILVNYPGMHAIWLHRISHKLWKRDWRLMARCLSTFSRWLTGVEIHPGATIGNRFFIDHGMGVVIGETAEIGDDCTLYHGVTLGGTTWQAGKRHPTLGNNVVVGAGAKILGPITMHDGARVGSNSVVVKDVPKDTTVVGIPGRVVATPSPQSKEKSERRSAMAKKYGFDAYAVSPDNPDPVANAIGQMLDHMHLMDSKVQELCQAIQRLGGDVCTERLPELNVGDFNDVEKAAADKRQSALDEFDPSI

SEQ ID NO: 18426 - protein, 459 aa, Shewanella oneidensis MR-1
MKHSGFQAKRLIQLALPVLIAQVTQTMMGFIDTVMAGRVSAVDMAAVAVGTSLWLPAILFVQGLLMAFTPLFAHHNGANNQKAIQPLAFQGAYLALIGGLGVMVFLASAPLVLSHMNLEPQLYNLTIGYIDGILWGAPAFVLYQVLRGCSEGISYTLPTMVIGFVGLAVNIPANYIFIYGHFGIPAMGGAGCGIATALVFWAMLIAMAIYMQFHKKFAALAPFSQFHRPDFATMKKMTKLGLPIAMALFFEVSLFAIIALLLAPLGATVVASHQIALNFSAIVFMLPLSIGIAVSIRIGYYLGRDRADISAVVAKVGLLLALSLALSTAILTVLFRFQIAELYNSDPEVVVLAGSLMLMAALYQLSDSVQVVAAGALRGYKDTRSAFYITLFSYWGIGMSLGYTLAYTDFIVPAMGAHGFWTGLIAGLTSAALLFFIRLRYIQKHRVHLSLIEGDSVHH

SEQ ID NO: 18427 - protein, 325 aa, Shewanella oneidensis MR-1
MAEMNMLQAVNEALSIAMQADERMVVFGEDVGHFGGVFRATSGLQEKFGRARCFNTPLTEQGIAGFANGLASNGMTAVAEIQFADYIFPAFDQIVNESAKFRYRSGNEFNVGSLVFRTPYGGGIAGGHYHSQSPEAYFTQTPGLKVVVPRNPAQAKGLLLASIRDKNPVVFFEPKRLYRASVGDVPAGDYEIELGKAEVLREGKDITLVAWGAQMEIIEKAADMAAKEGISCEIIDLRTLAPWDVNTVADSVKKTGRLLVNHEAPLTGGFAGEIAATIQQECFLYLESPISRVCGLDTPYPLVHEKEYMPDALKTFEAIKASVNF

SEQ ID NO: 18428 - protein, 275 aa, Shewanella oneidensis MR-1
MLNTTMFNYQGKNVVVVGGTSGINLAIAIAFAHAGANVAVASRSQDKVDAAVLQLKQAHPEGIHLGVSFDVRDLVAVEQGFEAIASEFGFIDVLVSGAAGNFPATAAKLTANGFKAVMDIDLLGSFQVLKTAYPLLRRPQGNIIQISAPQASIAMPMQAHVCAAKAGVDMLTRTLAIEWGCEGIRINSIIPGPITGTEGFNRLAPSVVLQQQVAQSVPLKRNGEGQDIANAALFLGSELASYITGVVLPVDGGWSLGGASIAMTALGELAAKGSN

SEQ ID NO: 18429 - protein, 529 aa, Shewanella oneidensis MR-1
MSADHTVTQLDSFSATTHSHATHSVQPELNFWQIFNMCFGFLGIQFGFALQNANVSRIFQTLGASIDEIPILWIAAPLTGLLVQPIIGYLSDNTWGCLGRRRPYFLIGAILTTLAIFVMPHSPTLWIAAGMLWIMDASINIAMEPFRAFVGDNLPPSQRTQGYAMQSFFIGIGAVVASALPYILSNFFNVANTAPAGEIADSVRYAFYFGGTVLFLAVTWTVISTKEYSPEELAAFHAKTKTDVEEQCKRSRTHKDYQFASFVWMGLGALLTFTVWAQDLDKQLYILSIGIFAFGPLQLYCALRLSQSQPSQRAQLGMVFNVVDDLFHMPKAMHQLAIVQFFSWFALFAMWIYTTSAVTSYHFGSSDVLSQAYNDGADWVGVLFASYNGFSAIAALFIPLLAKRIGIKLTHTFNMFCGGFGLISFYFIKDPNLLWLAMIGVGIAWASILSIPYAILSGTLPPKKMGVYMGIFNFFIVIPQLLAASVLGLILNGLFDGQPIYALITGGVFMLCAGIAVLFVEQPKALTPH

SEQ ID NO: 18430 - protein, 279 aa, Shewanella oneidensis MR-1
MKLETIDYRAADSAKRFVESLRETGFGVLSNHPIDKELVERIYTEWQAFFNSEAKNEFMFNRETHDGFFPASISETAKGHTVKDIKEYYHVYPWGRIPDSLRANILAYYEKANTLASELLEWIETYSPDEIKAKFSIPLPEMIANSHKTLLRILHYPPMTGDEEMGAIRAAAHEDINLITVLPTANEPGLQVKAKDGSWLDVPSDFGNIIINIGDMLQEASDGYFPSTSHRVINPEGTDKTKSRISLPLFLHPHPSVVLSERYTADSYLMERLRELGVL

SEQ ID NO: 18431 - protein, 371 aa, Shewanella oneidensis MR-1
MSSTQTDYRLSDDLLGPVLAILDAYIDPYLAKGLVSAGCVNKLAIEGKRLQLGLVYPYPCMTQYRDTVMALTNKLAVLDAIDEVECEIDFQPKVYSAIASIAPIANVKQVIAVASGKGGVGKSTTAVNLALALAAEGAQVGILDADIYGPSVPLMLGIPNFRPVSPDGKHMTAASAYGIAAQSIGFMLSGDEAAVWRGPMAAGALAQLLNETQWPELDYLVVDMPPGTGDIQLTLSQKVPVSGAVIVTTPQDIALADAKKGITMFQKVNIPVLGIVENMSFHLCPECGHKEHPFGTHGGSKMAERYQVPLLGALPLHINIREAMDVGAPTVVAEPDSEVAALYREIARKVGAELALKQSQKTVSISVSDDE

SEQ ID NO: 18432 - protein, 789 aa, Shewanella oneidensis MR-1
MQQYVLWYQELGMGDVNLVGGKNASLGEMISNLANAGVQVPGGFATTSYAFNEFLEQSGVNQKIYDILATLDVDDVNALAKVGAQIRQWVIDTPFQPALEQAIREAYEKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILSQGHKAVVRRNIGSKLIQMVYSDDAAHGKQVKIEDVAADKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQWVTVSCAEGDTGFIYEGKQEFEVVSNRVDALPALPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIELLKEQGLERGKDGLRVIMMCEVPSNALLADQFLEHFDGFSIGSNDLTQLTLGLDRDSGIISHLFDERNEAVKILLSMAIKAAKAKGAYIGICGQGPSDHADFAAWLVEQGIDTVSLNPDTVIDTWLYLAEAHA

SEQ ID NO: 18433 - protein, 248 aa, Shewanella oneidensis MR-1
MSINLSLAGKVALVTGASRGIGRAIAETLVEAGAVVIGTATSEKGAAAIQEYLGDKGFGLVLNVTDSQSVTDLFDSIKEKAGDVDILVNNAGITRDNLLMRMKDDEWNDIIDTNLTSLFRLSKPVMRTMMKKRFGRIINIGSVVGTMGNAGQVNYSAAKAGLIGFTKSLAREVASRQITVNAIAPGFIQTDMTDELTEDQQKAIMSQVPMERLGQAQEIANAVLFLASDSAAYITGETLHVNGGMYMV

SEQ ID NO: 18434 - protein, 488 aa, Shewanella oneidensis MR-1
MLRLIKEALTFDDVLLVPAHSTVLPNTAILKTRLTNTIELNIPLVSAAMDTVTEARLAIAMAQEGGLGFIHKNMSIEKQAEEVRKVKIYEAGVVQQPVTVTPSTTLADLKVLTAKNGFAGYPVVNDANELIGIITGRDVRFVTDWSKTVEEVMTPKARLVTVAEGTKLDEVQKLMHSHRIEKVLVVDDNFKLKGLITVKDFEKAERKPNACKDELGRLRVGAAVGAGAGNEERVDALVKAGVDVLLIDSSHGHSEGVLQRIRETRAKHPDLQIIGGNVATAEGALALVEAGVNAVKVGIGPGSICTTRIVTGVGVPQITAVSDAAEAVKGLGIPVIADGGVRFSGDLAKALAAGASCIMAGSMFAGTDEAPGETELYQGRAYKSYRGMGSLGAMSQGSSDRYFQSDNAADKLVPEGIEGRVPYKGKLKEIIHQHMGGLRSCMGLTGCATIQELNEKAQFVKVTSAGMGESHVHDVTITKEAPNYRSGS

SEQ ID NO: 18435 - protein, 326 aa, Shewanella oneidensis MR-1
MSRINSTAAEELVDFSVDTAEFDLDKEDIAADLVQELGLEQQVQDDLQKNLDATQLYLGEIGFSPLLSAEEEVYFSRKALKGCEKSRNRMIESNLRLVVKIARRYNNRGLALLDLIEEGNLGLIRAVEKFDPERGFRFSTYATWWIRQTIERAIMNQTRTIRLPIHVVKELNVYLRTARELAQKLDHEPTAEEIAEKLQVSSVDVSRMLKLNEKITSVDVPLGGDNDKALLDVLADDDNVGPDYKVQDEDISNSVVKWLNELNTKQREVLARRFGLLGYEPSTLEDVGAEIGLTRERVRQIQVEALKRLRDLLGAQGLSVEALFRN

SEQ ID NO: 18436 - protein, 398 aa, Shewanella oneidensis MR-1
MAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 18437 - protein, 929 aa, Shewanella oneidensis MR-1
MTKYSLRSWVLVLALAPTILVGILLGSYFTINRFYELEDTLIEQGSNIIEPLAIASEVGLVGNDREATKRLLAAAQLNKSTLVKSIAIFDIHNQLFVTSHYHKDFEIMRYKEALTNLQKTEIEHVGDSLILRTPIFATATPTGSEPANVDIQTDNGELLGYISVIINKERALLEQHRAAVAAFIIVLIGVQLNLLFTFRLVKNVTQPITEMVRVVAKIREGKLDARLQGNLIGELDLLKRGINAMAGSLSEYHDEMQQNIDQATSDLRETLEQIEIQNVELDLAKKRALEASRIKSEFLANMSHELRTPLNGVIGFARQLVKTPLHSSQVDYINTIERSATNLLAIINDILDFSKLEAGKMVLESMPFGLRETLGETITLISGSAQAKGLELVVDIAPNVPDNVNGDSMRVCQIINNLVGNAIKFTDSGSVLVKLELQAQTDEQVVLRCDVIDTGIGIDESQQDFLFQAFGQADSSISRRFGGTGLGLVITKRLVNQMGGQIGFTSSVDKGSNFWFTLPLGLGQFQIGDSLPLEKLQNKTVLFYEPRVLTHSVISRQLKQWDTKVTHHQHIPSLQTTLSTTEHQFDYVLLSCHGFNNPNHLVSTLIQAKAKTDCLIVLFDCQEQDMLSQFIRPNADVVLSLPVSEHQLARNMLYPPMEYDLLPPVSIAVPAARQSLTVLAVDDNFANLKLIDTLLNELVTTVIAVNSGEEAVKQAKTRTFDLIFMDIQMPGTDGISATKQIRQGSMNRNTPIIAVTAHAIAEERELILGSGMDGYLPKPIDEAALKAEINRWITRPKFTHFDLHTLNWDLCLTQANHKSGLALDMLRMLLDSLPQTVSAIEAALSQNDQVTMLSTIHKLHGASCYCGVPTTQRLCQEIESALKREARVEDLEPEILELLDELTKVESAAKQVLSQLSAEITDDQKNGLL

SEQ ID NO: 18438 - protein, 498 aa, Shewanella oneidensis MR-1
MSTPKTRSDWENLAVSLAINGKAFINGEYRDASSGNTFDCISPIDGRLLAPVASCDLMDANIAVANAREVFDSGVWSKAAPVKRKQVMIRFAELLEENANELALLETLDMGKPIRFSKAVDVAGAARAIRWSGEAIDKLYDELAPTAHNEIGMITREPVGVVAAIVPWNFPLLMACWKLGPALVTGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIGFNQGEVCTAGSRLLVESGVKDELVGLIAEELASWQPGHPLEPTTVSGAVVDKQQLDTILSYIKAGQNEGASLVYGGQQVLAETGGVYVQPTVFSNVKNQMKIASEEIFGPVLSVIEFNGMEEAIAIANDTIYGLAAGVWTADISKAHKTAKALRSGMVWINHYDGGDMTAPFGGYKQSGNGRDKSLHSFDKYTEIKATWIVL

SEQ ID NO: 18439 - protein, 112 aa, Shewanella oneidensis MR-1
MKKVEAIIKPFKLDDVRESLAEIGITGMTVLEVKGFGRQKGHTELYRGAEYMVDFLPKVKIELVIQDDLVDQAIDVIVETARTGKIGDGKIFVTDVERVIRIRTGEENEEAV

SEQ ID NO: 18440 - protein, 112 aa, Shewanella oneidensis MR-1
MKLITAIIKPFKIDDVREALTQLGIHGMTVTEVRGFGRQKGHTELYRGAEYAVDFLPKMKLEIAIHSELEEAVIEAIIQAAHTGKVGDGKIFVTPLEQVIRVRTAEEGVDAI

SEQ ID NO: 18441 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 18442 - protein, 1689 aa, Shewanella oneidensis MR-1
MAGYGLISLAILMILSAFKLVNMRTRYLAQLPLQSNVLWRLFPILFAFLFSSLSVLASPGGQIPLTTAVIDRVSAPTPVLRVSMILSVDTPFNRQIGARAQAAAVDLNIQLQVLYADGTHDGLMTLGREVMNQGIDGLIFSPVDDFGEALIREAQKLKIPVVTLRAKLDMLSSAALAELPNFIANVNINDQKSGQLLMHYLLSVDQLNRDVPAVLLIAGPQGYPNVERGVEDVQRFMNSLSTRGTLKIAYTDWSVEQALAQFDSAIAAQPALTTVVTMNASAAVAVAAKAHQQLGANAPAIGSMIWSESLVQDIKQGKIQAAITGSEFSGAIALSILFDHLSARGGPSRKGSFVAPLVVITPNNYQDYESILDFDPLRLNFRQISQHFNPDLSINELRLADLLTSEARVNFLKTLTEPELNFLRQHPSIRVGIEPDGAPIDYVDQAGKHTGLIASYLSEIAKLIPVRFEVQPTQSWGQTLKDFAADKLDMISLISASEDRKQRILFTDAIGHFPAVIVMRKDAELVDGIEGLFGKTVAVTRGDITEELLRKKYPEINIIAFDRLEDVLSTTLASQVDAAVMLLPKAGQSLLSPANKELTIVAPLDDEFEHSIGVRRDWPELQSILNKALAQIPSSTRAELDSRWFTVKYDFGMDPQQIKRWAISSAMVILGLFACFILWNYGLKRELLRRSRMAAQLESSMNKFHALFDSVMDACVIIDKRGVIKECNAALQTLLGVEDKTALVGTSLTQFHLADTFMGSAVQIAQSVEDVLKQGLLKFEADITDSQGQSIPAEVTLKSIELNTERFVLATYHNLAERRLVDRLIRHERNLLKNVLGMSPIGVWVCVNGTCRYVNAQMTLMTGLEVEHAVADIFLQPKDYWHYIRELAPEQECITFESKLKGYHGQILDVLFTAYPTFYDGQHANLCWALDITQEKAIQAELASAKLQADAANRAKSDFLANMSHEIRTPMNAIIGMSYLALQTDLAEKRKDYIAKVHQAAGSLLNIINDILDFSKIEANKLTVEHIEFDLDEVLTQLNNVIGFKVEENSMRLIYDIATDCPRYFIGDPQRLGQILLNYCNNAVKFSPKGSDILLSCQAELDKQGATLTFCVADDGIGIPLDKQARLFHSFEQGDTSTSRKYGGTGLGLAICKRLSELMQGEVWCESELGQGSRFYLRLHLPLVKPYDLSTQFAALQGESLSIVGFMPDLSAIYSRFAARVGMQARTLEMHMALAELSACTSQHLIMCETNAFEPELLSVVLANDKLGLLLIGNGSEPVAIQSLVDKHPQIIAKQHPILLRTLGESLLLLLNRDRAPFGQHLEHQSITTLKNQLAGVELLLVEDNYLNQELAVELLRQAGARVTVAQHGQEALTLLAQQSFDCVLMDGQMPVMDGYEATRLIRAQPQFADLPIIAMTANAMDSDRERALAAGMNAQINKPFQVQQLYSTIAQHVSVHSVQSLPESPEAHDLDKAQLKQGLPLVEELDIDAGLALCNYNADLYRHLLTLFVQTGAKLLQNQQNEFSQDNLSALRLSLHTLKGVAGNIGAVSLKEDSGRLEASLTDISSLQQLDANIQETVSQEIHLLHAKLQQLLTLLAEWQTVNQPDEASQSISMTELMRLFAQLTQNLKEYNTDALSLVERLSQLTVLQPQRQLIAELKQATGQFDFSQGLELAIQLQEWAQQQLAKE

SEQ ID NO: 18443 - protein, 391 aa, Shewanella oneidensis MR-1
MSQFQSIDVADYYDAQTFKRIEEFAKDKATPFVVIDTSIIAKQYDDMVNSFPYADVYYAVKANPAAEILTLLKDKGSNFDIASIYELDMVMNVGVTADRVSYGNTIKKRQDVRAFYERGVRMYASDSEADLRMIAEEAPGSRIYVRILTEGTDTADWPLSRKFGCQNEMAYELLVLANELGLEPYGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELEKCVIAGPTCDSADIMYEHYSYGLPNDLAIGDRMYWLTAGAYTTTYSAVCFNGFPPLKDYYL

SEQ ID NO: 18444 - protein, 408 aa, Shewanella oneidensis MR-1
MSVSLITKNVLLGIGGGIAAYKSADLVRRLKERGFDVRVVMSQSAMEFITPLTLQALSGHPVSSSLLDPAAEAAMGHIELARWADLVIIAPATANLLARINAGMADELITTTCLATEAPIALCPAMNQQMYRNLATQANLASLQSRGYTLWGPASGSQACGEVGPGRMLEPLEIAELASRFFATKDVYAEQESQPLAGQSVLITAGPTREAIDPVRYISNHSSGKMGFALAKAAADMGAAVTLVAGPVNLATPEGVTRIDVESAQNMLDAVMDNVDKKDIFIGCAAVADYRVNDIAACKIKKSAEEMQLALVRNPDILATVASLANRPFVVGFAAETHDVETYARDKLKRKNLNMIAANDVSVAGQGFNADANALRVFWPQGSQDLPATDKLTLARQLLSLIVKEKTK

SEQ ID NO: 18445 - protein, 414 aa, Shewanella oneidensis MR-1
MDHFLYQDNTLYAEGCRVNDLAQTYGTPLYIYSRATLERHWHAFNNAVAGHPHLVCYAVKANSNLAVLNVLARLGSGFDIVSGGELARVIEAGGDPAKVVFSGVGKTVAEMEQALNLGIYCFNVESSAELEQLNLVAGRLGKVAPVSLRVNPDVDAGTHPYISTGLKENKFGIAMDEAEAVFARAHALPHLQVKGVDCHIGSQLTEIQPFLDAMDRMLSLIDRLAEQGIVIEHFDVGGGLGVTYDDETPPHPDVYAAALLKRLGHRKLKLIFEPGRAIAANAGIFVTEVLYLKENSDKRFAIVDGAMNDLIRPALYSAWQKIIPVTPRDDQAHVFDIVGPVCETGDFLGKDREFAIAPGDLLVVRSSGAYGFAMASNYNTRPRAAEVMVDGDKAYLVREREKLPQLWQGEQLLP

SEQ ID NO: 18446 - protein, 241 aa, Shewanella oneidensis MR-1
MNNRVLVTGSSRGIGKAIALKLAAAGHDIALHYHSNQAAADASAAELRALGVNVSLLKFDVADRVAVRAALEADIEANGAYYGVVLNAGINRDNAFPAMSEAEWDSVIHTNLDGFYNVIHPCVMPMVQARKGGRIITLASVSGIAGNRGQVNYSASKAGLIGATKALSLELAKRKITVNCIAPGLIETDMVADIPKDMVEQLVPMRRMGKPNEIAALAAFLMSDDAAYITRQVISVNGGMI

SEQ ID NO: 18447 - protein, 1141 aa, Shewanella oneidensis MR-1
MSAIQKIRYQLLCILSYLPLLCMTFITHAEQPNTTTISVGVLANGWGPFQQVNDQITTGFSVELIQLLAKNLHYQIDWKIYPDWMSLYSAGCNGEVDVLLDAFRTTERTQCLMFSRSYYTSPTVVVIRYDSRFFRDVSEFGQARIAVEKGFSTEKLVKLHYPTVTEVTFSNTEQALSSVIDKTTDAYIGNLHVANQYISAHPELLIVAQAPLMMENLHLGITKNNSLLVTQLDNALMALSVEERNALEVTWLGMGDLHFLGHSNFLLRPNEREWLAGLPSLRVGFVDDWMPFSSVNNNGILVGLIADYLEQFREKLGLDYAAQKTRTWNEIQSALINHEIDLAIIPTRLKAQYPDWHMSEVFTSFPIVIATARNSPRIAGLSELNFQRVVITDNLLLPSIKKAYPNIDVVVSANPDEGLTLVAKGNAAAYMGNLAVVAMLIDNKFIDELRVAAPTPYKDELAVAIREPYWQLIPLINRVFSSMSEKEKQQIRNTWLAVNYSEGISWHTLITTLLPIAIGLLLFIGGLTIAYLKLRQEINKRRIVENALAIAKENAELATKRKAEFLAAMSHEIRTPMNGLVGMAEQLSFTPLGIEQKQMVQIISNGAEEILQIINNILDFSKIDMGKMRLESTPILLREVLDSTLNMVMNDLRTKDLSLYLHVDQGVAARVTGDSLRIKQILFNWVSNAIKFTERGFIEVSVKLEAEEEGQQLLLIGVQDTGIGMNADTQARIFNIFEQADVSTTRSYGGAGLGLAISHTLAEMMGGDIILNSAPHLGTFIGLRIRLPVVAQDEFDEQLQGLQAYIAISDIKLRHTLSWHLASLGIVLTQNKANADLLFTDNASDDRQHILCTHFNEALGYRYQNDQCLLNVNPLTSQAVKDVCYINMGWIDTIVSTPQRDITLKVNWPECKILLIEDHQLNQILVQRQLKQLRLDCDIAEHGVQALDLMQQTHYDLILCDCRMPVMDGYTFTQQVRAQEIDGQHVPIIALTANVLNEQKQRCAAVEMDDLLAKPLHLNELHEMLLKWLPHSKPALIDIKILENAFGRREALSKMLLMFKDELESSLKDIQLTAPQLADNIHRTAGTISMLGLTSIAEQAWLLEEKIRQEDSNNGEVELTEFRAIIIQLISELNAIIHTSN

SEQ ID NO: 18448 - protein, 506 aa, Shewanella oneidensis MR-1
MIYAQPGTAGALVNFKEKYANFIGGKWVAPVNGKYFDNRSPVNGQNFCKIPRSDAQDIELALDAAHAAKDAWGKTSVTERSNILLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGVLNVVNGFGAEAGQALATSKRIAKLAFTGSTEVGFHILKCAAESLIPSTVELGGKSPNLYFADVMDQEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRMGRGIQAGRVWINCYHAYPAHAAFGGYKKSGIGRETHKMMLNHYQNTKNLLVSYDINPLGFF

SEQ ID NO: 18449 - protein, 284 aa, Shewanella oneidensis MR-1
MPFVIALLAPVFWGTTYALVSLYLQDMSPYWVAVWRALPAGVLLLMLRPRLPTLAWSKLSLLAFCNIGAFFTLLFIGAYRLPGAVAGTLGATLPLIFLILAWLIDKKRPGMKWLLLGLMGLGGVILLLNPSADLDPIGVLCMLSATTLIAFSSRWMQRWDVGDFLVLTAWQLLLGGLMLIPLAWLMAGPPQIPSMDVVPSLIWLATANTAVAYWAWLWSMRNLGPEIMGMVALVNPVVAVSLGVLIVGETLDMRQWAGILVILLSLLLMKLPQKLRWNPLKARG

SEQ ID NO: 18450 - protein, 285 aa, Shewanella oneidensis MR-1
MTFQTQSMALTVPQGSSSLEAYIHSVTSMNMLDAETEYELAKRLQETGDLQAAKQLIMSHLRFVVHVAKGYAGYGLPQADLIQEGNIGLMKAVKRFDPDVGVRLVSFAVHWIKAEIHEYVLKNWRIVKVATTKAQRKLFFNIRKAKTRLGWFSDDEVTMVAENLGVSKADVTEMESRMAAQDPAFDLSSDNDDEHDFAPVHYLEDHSSDLAENIENDNWESNAQGRLLSAIKTLDERSQHILRARWLDDDKTTLQELAETYQVSAERIRQLEKNAMNKLKACMEA

SEQ ID NO: 18451 - protein, 376 aa, Shewanella oneidensis MR-1
MTAQILKSKAAVAWAVGEPLSIEIVDVMPPQKGEVRVKMIATGVCHTDAFTLSGDDPEGIFPCILGHEGGGIVESIGEGVTSVQVGDHVIPLYTPECGECKFCKSGKTNLCQKIRETQGKGLMPDGTSRFSKDGQIIYHYMGTSTFSEYTVLPEISLAKVNPDAPLEEVCLLGCGVTTGMGAVMNTAKVEEGATVAIFGMGGIGLSAVIGATMAKASRIIVIDINESKFELAGKLGATDFINPKDYDKPIQDVIVELTDGGVDYSFECIGNVNVMRSALECCHKGWGESVVIGVAGAGQEISTRPFQLVTGRVWKGSAFGGVKGRSELPEYVERYLAGEFKLSDFITHTMSLEQVNDAFDLMHQGKSIRTVIHFDK

SEQ ID NO: 18452 - protein, 449 aa, Streptococcus mutans UA159
MLENSITYEKPLYIIKMNQRKKIVQIALPAMAENLLQMLMGVVDNYLVAQIGLVAVSGVSVANNIITIYQAIFIALGAAVSSLVAKSLGEDNQARVRFYQSESVAITLMLSVVLGFISFVFGSNMLHLLGTTDSVTQAGGIYLAIVGGLVVSLGLQTTLGAILRAQGKARLPMYVSFLTNIVNVILATTAIYIGHWGIVGVAAATVLSRFLGTFVLACQLPIKAILRSMRIKIDKAFLAIALPSAGERLMMRAGDVVIIAIIVKFGTAAVAGNAIGETLTQFNYMPGMGVATATVILVAHNLGQGKKKVIKEVVRESYIISTVFMLLVGACIFFGGRQLTYLFTENKAALQASLVVLFYSFIGGPATSGTLVFTAVWQGLGKAKLTFYATTVGMWLIRIVLGYYLGVSLNLGLAGVWLATLADNVFRWLFLYCLYRKYMQGFNNNLSSS

SEQ ID NO: 18453 - protein, 372 aa, Streptococcus mutans UA159
MNTIKTRAAVAWAPNEPLKIEELDLMMPQKGEVMVHITATGVCHTDAYTLSGKDAEGVFPCVLGHEGAGIVEAVGEGVTEFQVGDHVIPLYTAECGKCEFCLSGKTNLCSAVRETQGRGVMPDGTVRFFKDGQPIYHYMGTSTFAEHTVVSEYSLVKIQDNAPLEEVCLLGCGVTTGMGAVLNTAKVEEGATVAIFGLGGIGLAAIIGARMAKASRIIAIDINPDKFDKARKLGATDLVNPNNHAKPIQEVIIDITNGGVDYSFECIGNVEVMRAALECCHKGWGESTIIGVAPAGAEIHTRPFQLVTGRVWRGSAFGGVKGKTQLPGIVGQYMAGEFALSDFITHTMPLEQINDAFDLMHEGKSIRTVIHY

SEQ ID NO: 18454 - protein, 337 aa, Streptococcus mutans UA159
MRRKRYMSETKVVALREAINLAMSEEMRKDEKIILMGEDVGIYGGDFGTSVGMLAEFGEKRVKDTPISEAAIAGSAVGAAQTGLRPIVDLTFMDFVTIAMDAIVNQGAKANYMFGGGLKTPVTFRVASGSGIGSAAQHSQSLEAWLTHIPGIKVVAPGTVNDAKALLKSAIRDNNIVIFMEPKALYGKKEEVNLDPDFYIPLGKGEIKREGTDVTIVSYGRMLERVLKAAEEVAAEDISVEVVDPRTLIPLDKDLIINSVKKTGKVILVNDAYKTGGFIGEIASVITESEAFDYLDAPVLRLASEDVPVPYSHVLETAILPDVAKIKEAIYKQVRKR

SEQ ID NO: 18455 - protein, 222 aa, Streptococcus mutans UA159
MTNKLLLNGRVWNKGDIMGWWKETIDIVKEKDPAARTALEVLLTYPGVKALAAHCLSHFLWTHHCKLLARMHSQFWRFWTQIEIHPGAEIAEGVFIDHGSGLVIGETAIVEKGVMLYHGVTLGGTGKETGKRHPTIRQGALISAHSQVIGPVEVGPGAKVGAGAVVVSDVPADVTVVGVPAKVVRIHGQKDETAIHEIEENREYYLKKLEEAKEASFHSSGL

SEQ ID NO: 18456 - protein, 156 aa, Streptococcus mutans UA159
MVGLTQAEKEFFMGEALKEAQLSLQKEEIPIGCVIVKDGQIIGCGHNAREEENLAIMHAEIMAINQANRTQESWRLLDCTLFVTIEPCIMCSGAIGLARIPQVIYGAKNAKFGGAGSLYDILTDERLNHRVEVERGILEKECAQMMQSFFRYRRTK

SEQ ID NO: 18457 - protein, 232 aa, Streptococcus mutans UA159
MTAQKMSAQEIIAFIGNAEKKTNVKVTFEGALAAALPENVVKLGNVLFGDWKDIEPLLANLTENKDYVVEQDGRNSAVPLLDKRNINARIEPGAIIRDQVTIEDNAVVMMGAIINIGAEIGEGTMIDMGAILGGRATVGKNSHIGAGAVLAGVIEPASADPVRIGDNVLVGANAVIIEGVQVGSGSVVAAGAIVTQDVPDNVVVAGVPARVIKEIDEKTQQKTALEDALRNL

SEQ ID NO: 18458 - protein, 577 aa, Streptococcus mutans UA159
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTDKMQELAQRALTECATMEEVLELEKEYIDFD

SEQ ID NO: 18459 - protein, 280 aa, Streptococcus mutans UA159
METVVLSNGVKMPILGFGVFQVPDLEECERVVTEAIKVGYRLLDTAQVYGNEEAVGNAVRKSGLAREEFFITTKVWISNAGYEKAKASLDESLRKLQTDYVDLVLIHQPFGDYYGTWSALEAYYKSGKIKAIGVSNFYPDRLVDLASFNEIVPMVNQVETHVFNQQIEAKKVSEEYGVQLESWGPFAEGKNNFFTNPTLTAIGEKYGKSAAQVGLRYLIQRGVVVIPKTVHQERMVQNFDVFGFNLSDDDMADILKLDQGESLFINHYDPETVKFLANYK

SEQ ID NO: 18460 - protein, 288 aa, Streptococcus mutans UA159
MEYITLNTGVKMPMEGFGVFQVTDPEICKESVLNAIKTGYRLFDTAAVYGNEKALGEAIHEAIEQGLVTRNELFITSKLWVQDMNYEAAKKGIERSLEKLGLDYLDLYLLHQAMRDYFGAYRALEEAYQAGKLRAIGVSNFYPNILTNFCETVSVIPAVNQIELHPFFTQEEALETARYYGVVPEAWAPLGGGRYDAFNNAILQEVASAHQKTVGQIMLRWNVQRGVVVIPKSTHKERIEENFAIWDFSLTDDEMTKIASLDMGYGDTRTKHFDPNFVRSVLNVKIHD

SEQ ID NO: 18461 - protein, 371 aa, Streptococcus mutans UA159
MVNNKKKTSSTFNVQVADFIRNHKKEGVAVDDEVTEKLVIPFELEAEQIDDLLERLTDGGISITDREGNPSTKYAVEEIKPEELTDEELLGSNSAKVNDPVRMYLKEIGVVPLLTNEEEKELAIAVENGDLEAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDYTTRVVLREQLDEVLDTLTDREENVLRLRFGLDDGKMRTLEDVGKVFDVTRERIRQIEAKALRKLRHPSRSKQLRDFVED

SEQ ID NO: 18462 - protein, 280 aa, Streptococcus mutans UA159
MEAYTLINGVHIPKIGFGTWKLADGDEAYKSVSYALEVGYRHVDTAQYYGNEVSVGRAIADSPIKREELFITTKIWNDKHSYDEAKQSVEESLAKLKLNYLDLLLIHWPNPKALRENDAWKTRNADVWRAMEDLYQAGKVRAIGVSNFMIHHLEPLLEVATVKPMVNQVLLAPGCSQEELVAFCRQNEMILEAYSPLGTGSIFDNQTAQDLANKYNKTVAQIALRWSLQKGFLPLPKSATPKNILSNLAIFDFDLTEDDILKLDKIENVKSQGNPDETAF

SEQ ID NO: 18463 - protein, 618 aa, Streptococcus mutans UA159
MSRLLDKLKTDILVADGAMGTLLYADGLESCHEYYNISHPERILAIHQAYIAAGADIIQTNTYGAKRHRLKSFGHDKEVKAINQAAVHLARQAAGDNTFVLGTIGASHGLKHCELSLEDIISQTVEQARFLLETKQIDGLLLETYYDIEELEAALKALRPLTDLPIITNVALHEPGITENGRPLVEAFSNLVMLGADIVGLNCHLGPYHMIQSFKQVPLFAQSYLSAYPNASLLSFSSDDNETPYHFSQNADYFEYCAKLFVEEGVRLIGGCCGTTPEHIKAIKRGIRGLKPIERKVTTPLISQEDLIYEVEKKESLVDKVKKGITIIAEIDPPKTLAVDKFVDGVKALDEKGIAAITLADNSLARTRICNLSMASMLKDEIATPFLLHLSCRDHNMIGLQSRLLGMDLLGFDHILAITGDPSKIGDFPGATSVYDATSFKLLSLIKQLNQGHGYSGASLKKATHFTVAAAFNPNVKNLSRTGRLIEKKVAAGADYFITQPVFSETVIQELSEVTKPYEQPFFVGIMPITSYNNAVFLHNEVPGISLSESFLAKLEAVKDDKETCQKVALAESKKLIDAILAHFNGIYLITPFLRYDLTVELIDYIQVKTATVAKKRT

SEQ ID NO: 18464 - protein, 316 aa, Streptococcus mutans UA159
MGRFKTLLNQEDYLILHGALGTELEFLGYDVSGKLWSAKYLLENPSIIQTIHETYLRSGSDIVTTSSYQASYQGLCDYGLSQEEAEKMIALTVSLAKNAREKVWQELSEKEKQVRPYPLISGDVGPYAAYLADGSEYTGNYGQLDKEVLKDFHRSRIKILVDEGSDLLALETIPNFLEAQALVELLQEEFPSVEAYMSFTAQNGTTISDGTAIEEVAELIDKASQILALGINCSSPSVYSSLLKKIADITDKPLVTYPNSGEVYDGQHQMWTQSADISHTLLENTKIWHTFGAKVVGGCCRTRPNDIESLSRGLRE

SEQ ID NO: 18465 - protein, 179 aa, Streptococcus mutans UA159
MTKKILLAVSGSIAAYKAADLSHQLTKLGYHVNVLMTNAAKQFIPPLTLQVLSKNPVYSNVMKEDDPQVINHIALAKQADLFLLAPASANTLAHLAHGFADNIVTSVALALPLEVPKFFAPAMNTKMYENPITQSNIALLKKFGYKEIQPKSSVLACGDVGSGALADLDTIIQKIEEQL

SEQ ID NO: 18466 - protein, 432 aa, Streptococcus mutans UA159
MSIITDVYAREVLDSRGNPTLEVEVYTESGAFGRGMVPSGASTGEHEAVELRDGDKSRYGGLGTQKAVDNVNNIIAEALIGYDVRDQQAIDKAMIALDGTPNKGKLGANAILGVSIAVARAAADFLEIPLYSYLGGFNTKVLPTPMMNIINGGSHSDAPIAFQEFMIVPAGAPTFKEALRWGAEIFHALKKILKERGLETAVGDEGGFAPKFDGTEDAVETIIKAIETAGYKPGEEVFLGFDCASSEFYDNGVYDYTKFEGEKGAKRSAAEQIDYIEELVNKYPIITIEDAMDENDWDGWKALTARLGDRVQLVGDDFFVTNTDYLARGIKEGAANSILIKVNQIGTLTETFEAIEMAKEAGYTAVVSHRSGETEDSTIADISVATNAGQIKTGSLSRTDRIAKYNQLLRIEDQLGEVAEYRGLKSFYNLKK

SEQ ID NO: 18467 - protein, 254 aa, Streptococcus mutans UA159
MTKVAIVTGAGQGIGLAIAKRLHADGFKIGMLDYNTQAVQEAAASISKEDALAVTVDVSKREAVFDAFDQIVKKFGDLSVVVNNAGLGPTTPVETITEEQFKQVYGVNVGGVIWGTQAAYKHFKALGHGGKIINASSQAGVVGNPELTLYSGTKFAVRGITQVTARDLAKDGITVNAFAPGIVKTPMMYDIAHKVGQNAGKDDEWGMQQFAKDITLQRLSKPEDVANVVSFLASPDSDYVTGQTILVDGGMQFH

SEQ ID NO: 18468 - protein, 188 aa, Streptococcus mutans UA159
MKILIVYTHPNPTSFNAEILKQVQTNLSKEHTVSTLDLYAEHFDPVLQFNETHKRRDLAKVAEMEKYRDLVTWADHLIFIFPIWWSGMPAILKGFIDRVFVADFAYSYKKVGLEGHLQGKSAWIITTHNTPSFAMPFVQDYGKVLKKQILKPCAISPVKLTELTSIEKISDDERQKLLHKVAQITRNI

SEQ ID NO: 18469 - protein, 113 aa, Streptococcus mutans UA159
MKKIEAIIRSDKLEDLKAALVQSGFIKGMTISQVLGFGNQRGYTEYVRGQKITPTLLAKVKVEIVAHDAAVEEMITTISQAVKTGEVGDGKIFVSPVDEIVRIRTGERDGDAI

SEQ ID NO: 18470 - protein, 416 aa, Streptococcus mutans UA159
MKTPFVSKEQLDKITAQFPTPFHLYDEKGIRETARAVNKAFAWNSGFKEFFAVKATPNPTILKILQEEGCGVDCATDVELKMADKLGFDRSAISFTSNDTQASEFVFARSINATINLDAYEHIAFLEEAAGLPETVSLRFNPGGVFSLGTDIMDHPEESKFGMTKEQLFQGYQDLKDKGVKSFGLHAFLASNTVTNDYYPTLAAQLFELAVEIKNELGISLDFINLSGGIGIDYSAADEQNDIAVIGEGVHQKFDDILVPNGLSQIKIYTELGRYMLASHGHLITKVLHLKDTYRHYVGVDASAVNLLRPAMYDAYHHITNISNPQGTVQVVDIVGSLCENNDKFAKRRELPEARVGDTLVIHDTGAHGFSMGYNYNGRLRSAEILLREDGQTQMIRRAETPEDYFATLYGFNFDR

SEQ ID NO: 18471 - protein, 244 aa, Streptococcus mutans UA159
MEIKNKNVFITGSTRGIGLAIAHKFAQAGANIVLNGRSEISQDLVAEFKDYGVKVATISGDVSHFEDAKRMVDEATEALGSVDILVNNAGITNDKLMLKMTEEDFERVLKINLTGSFNMTKAVLKPMTKARQGAIINMSSVVGLAGNVGQANYAASKAGLIGFTKAVAREVAARNIRVNAIAPGFIESDMTERIPNKMKDAMLNQIPMKTFGKTENVAEVAMFLAQQDYLTGQVIAIDGGMTMQ

SEQ ID NO: 18472 - protein, 493 aa, Streptococcus mutans UA159
MSNWDTKFLKKGYTFDDVLLIPAESHVLPNEVSMQTKLAKNLTLNIPIITAAMDTVTDSKMAIAIARAGGLGVVHKNMSIKEQAEEVRKVKRSENGVIIDPFFLTPEHKVSEAEELMQRYRISGVPVVETLDNRKLIGIITNRDMRFISDYETPISEHMTSEKLVTAPVGTDLETAERILHEHRIEKLPLIDEKGRLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVVAGVGVPQITAIYDAASIAREYGRTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMLGGIRSGMGYVGAANLKELHENAQFIEMSGAGLIESHPHDVQITNEAPNYSVQ

SEQ ID NO: 18473 - protein, 112 aa, Gluconacetobacter diazotrophicus
MKKIEAIIKPFKLDEVKDALHEIGLMGITVTEAKGFGRQKGHTELYRGAEYIVDFLPKVKLEIVCADNLVDRAVETIMAAARTGRIGDGKIFILPVEDVIRIRTGEHGEEAI

SEQ ID NO: 18474 - protein, 112 aa, Gluconacetobacter diazotrophicus
MKLVTAIIKPFKLDDVRESLTPLGIQGLTVSEVKGFGRQKGQTEIYRGAEYHVSFLPKVKIEVAVSDDIVDQVVDVILQSAHTGKIGDGKIFVSSLDSVIRIRTRETGEDAL

SEQ ID NO: 18475 - protein, 112 aa, Gluconacetobacter diazotrophicus
MKFIIAIIKPFKLDDVREALGTIGIQGLTVTEVKGYGRQKGQTEIYRGAEYQIQFVAKVKIEVAVADSMLDQALDTIRAAAHTGTIGDGKMFVLELQQAIRIRTNETGEIAL

SEQ ID NO: 18476 - protein, 706 aa, Pseudomonas tolaasii
MAQLKDGNLETCLAPLGSQELDQLASGINRMAETLQNAQEELQHSIDQATEDVRQNLETIEIQNIELDLARKEALEASRIKSEFLANMSHEIRTPLNGILGFTHLLQKSELSPRHVDYLGTIEKSADNLLGIINEILDFSKIEAGKLVLDSVPFNLRDLLQDTLTILAPAAHAKQLELVSLVYRDTPLAVVGDPLRLKQILTNLISNAIKFTREGTIVARAMVEDEEEDSVQLRISVQDTGIGLSNQDVRALFQAFSQADNSLSRQPGGTGLGLVISKRLIEQMGGEIGVDSTPGEGSEFWISLNLPKTRDDVDDLPSAPLLGRRVAVLENHDVARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKTPCTRKLRRALADLISPPVAQRTREPLSSRAPRVLCVDDNPANLLLVQTLLEDMGAKVLAVESGYAAIDAVKQETFDLVLMDVQMPGMDRRQSTEAIRQWESERHGTPLPVVALTAHAMANEKRALLQSGMDDYLTKPISERQLAQVVLKWTGLALRNQGPERGNDNLGHGVQLLVLDHEEGLRAAANKADLAADMLAMLLASLEADRLAITVAREAKDNNALIERIHRLHGATRYCGVAELRAACQRAETLLKQDDAQGHGALDELDMAIGAAGQ

SEQ ID NO: 18477 - protein, 716 aa, Kluyveromyces lactis
MESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 18478 - protein, 369 aa, Oryza sativa (japonica cultivar-group)
MVMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 18479 - protein, 569 aa, Oryza sativa (japonica cultivar-group)
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMY

SEQ ID NO: 18480 - protein, 268 aa, Oryza sativa (japonica cultivar-group)
MEERYSYHPLLLLLHLLPQMAADHAAFPALARFLARKRTRTAIAMVIMAAMLPGVECARRRRLRQGGGAGADAAAAGGGTRRSSFCVHAAGHGGGQTCGGAAANHSGKQRSSVMELIHGWSLDSNAREAKERLDQKLRSQRESVIKRHHSTGSIKLNRGATGGGGGGGRSTATAAMGVQREVYSRKGVMRRLMRWSRLRWDAAEQAECAVCLDEFAAGDVLAHLPCGHRFHWACALPWLEAGAAPRSCPFCRAAVDTPPPPPPPACSS

SEQ ID NO: 18481 - protein, 248 aa, Helianthus annuus
MSFQNEDSGDISPQRRIGKGKIEIKRIENTTNRQVTFCKRRNGLLKKAYELSVLCDAEVALIVFSSRGRLYEYANNSVTGTIDRYKKSCLDPPSTGSVAEANAQFYQQEATKLRQQIANLQNQNRQFYRNIMGESLADMPGKELKNLESKLEKAINRIRAKKNELLFAEIEYMQKRELELHNSNQFLRARIAENERAQQQHMSLMPGSSGYNDLGPHQSFDGLNDLQTNELQLNNNYSCQDQTPLQLV

SEQ ID NO: 18482 - protein, 167 aa, Helianthus annuus
MGRGKIEIKRIENTSNRQVTYSKRKNGIIKKAKEITVLCDANVSLVIYGSSGKMYEYCSPKTNLIDMLDRYQRLSGNKLWDAKHENLQNEIDRIKKENESMQIELRHLKGEDMTSLNYEELIGYEDALENGLTNIREKKDEIPKIMRKREQVLEDVVIYAFMQIMLR

SEQ ID NO: 18483 - protein, 369 aa, Synechococcus sp. PCC 7942
MKSRAAIAWAAGQTADDREVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 18484 - protein, 383 aa, Marthasterias glacialis
MLNGENVDSRIMGKVATRASSKGVKSTLGTRGALENISNVARNNLQAGAKKELVKAKRGMTESKATSSLQSVMGLNVEPMEKAKPQSPEPMDMSEINSALEAFSQNLLVGVEDIDKNDFDNPQLCSEFVNDIYQYMRKLEREFKVRTDYMTIQEITERMRSILIDWLVQVHLRFHLLQETLFLTIQILDRYLEVQPVSKNKLQLVGVTSMLIAAKYEEMYPPEIGDFVYITDNAYTKAQIRSMECNILRRLDFSLGKPLCIHFLRRNSKAGGVDGQKHTMAKYLMELTLPEYAFVPYDPSEIPAAALCLSSKILEPDMEWGTTLVHYSAYSEDHLMPIVQKMALVLKNAPTAKFQVLEILCGLLLCCLDCLVASYPQLKKKIV

SEQ ID NO: 18485 - protein, 328 aa, Schistosoma mansoni
  unsure (1)..(328): unsure at all Xaa locations
MQAAKDVKLLLLGAGESGKSTIVKQMKIIHEGGFTQEDNKQYKPVVYSNTIQSMVAILRAMNTLGIQFGDSEQGAEDARIVCDVIQAMEDTKPFSEDLLDAMKRLWADSGVQECFARSNEYQLNDSAKYFLDDLDRLGAKDYMPTEQDILRTRVKTTGIVEVHFQFKNMNFKLFDVGGQRSERKKWIHCFEDVTAIIFCVAMSEYDQVLHEDETTNRMQESLKLFDSICNNKWFTDTSIILFLNKKDLFEEKIKRSPLTICFPEYPGKQTYEEAAIYIQASFEXKNRSPNKEIYCHQTCATDTNNIQFVFDAVTDVIIANNLKGCGLY

SEQ ID NO: 18486 - protein, 211 aa, Lolium perenne
MAMAISSDLRAPCSLLMATLMLIIVQAQGITRHYNFNVQMANVTRLCATKSIVTVNGEYPGPALVARKGHRVLVRVTNHVAHNMTLHWHGIRQLRSGWADGPAYITQCPMQTGQSYLYNFTITGQRGTLWWHAHISWLRATVYGAIIVLPKHGVPYPFTAPHKEVPMIFGEWWRADTEKLVRQAIKTGGAPNISDAFTINGLPGPLYNCSA

SEQ ID NO: 18487 - protein, 464 aa, Arabidopsis thaliana
MSIMRNFLSMIIMLCVCLNWCFAEGAEKSDSGKVLDSYTIQVSSLFPSSSSCVPSSKASNTKSSLRVVHMHGACSHLSSDARVDHDEIIRRDQARVESIYSKLSKNSANEVSEAKSTELPAKSGITLGSGNYIVTIGIGTPKHDLSLVFDTGSDLTWTQCEPCLGSCYSQKEPKFNPSSSSTYQNVSCSSPMCEDAESCSASNCVYSIGYGDKSFTQGFLAKEKFTLTNSDVLEDVYFGCGENNQGLFDGVAGLLGLGPGKLSLPAQTTTTYNNIFSYCLPSFTSNSTGHLTFGSAGISESVKFTPISSFPSAFNYGIDIIGISVGDKELAITPNSFSTEGAIIDSGTVFTRLPTKVYAELRSVFKEKMSSYKSTSGYGLFDTCYDFTGLDTVTYPTIAFSFAGGTVVELDGSGISLPIKISQVCLAFAGNDDLPAIFGNVQQTTLDVVYDVAGGRVGFAPNGC

SEQ ID NO: 18488 - protein, 423 aa, Oryza sativa (japonica cultivar-group)
MGCGIDKDSTGRVPPFRFASPKPQAHPHQPKNHNLPLSSPLLAAGAAAAAVTAAFSLSSLSFSPPRGETIVLQPYQLFIWFQFNFIVNSQALKSYIWLQCFDGSIQQVEEEVAMFCPMICREIVKNGTGSSKNHAIALPERVNPTSLSLILDYCRFHQVPGRSNKERKSFDEKFVRIDTERLCELTSAADSLQLKPLVDLTSRALARIIEGKTPEEIRDIFHLPDDLTEEEKLEPLKNINDDPRIRLLNRLYAKKRKELQERQKLKDVQVQEEQKDERSLDEILCFINGDGGSGGGKASKNKKKNKRRKDHSKNPPKANPEPVNKEEATRGVPFNAGTGNISRTPCQSSDVQDDVEYPFEDADLDDGLDPAMQEELDREVEDFARRLNSVWPERMHLGQERRIESHMIGGNGSLQRFSGFNHR

SEQ ID NO: 18489 - protein, 426 aa, Caenorhabditis elegans
MSARTTLYRAPNYYSTNIIEHKTYSISKNTVNKSKMAAPAESHARLDGRFWLEGTPYLAEENVGAGAYGVVCKAMDTRNKKQVAIKKIPRAFTAHTLAKRSLREVRILRELLHENIIAVLDMFTAEGAHGKDIYLVMDLMETDLHQILHSRQTLMEQHFQYFFYQLLRGLKYLHSAGIIHRDLKPSNLLLNGDCLLRIADFGMARAYASASTVRDDANVGGHMTQYVSTRWYRAPEILFSMVEYDTKVDLWSAGCIFAEMLLRRQLFPGKDSVSQIKMIVYYLGSPEEEVINRITSDLVRDSIEACGRKTPLPFSAIFPKASPEARNMVSYLLQISPWKRYSADQILQHPFMAQYHNDQYEPLCPPRVQVDVDAIERFEGAQVVAGLDEEARIFEMRRGTNYDTRLAQRDASATALQKRAPDNMGG

SEQ ID NO: 18490 - protein, 177 aa, Cicer arietinum
MASHDQSYKAGETMGRTEEKTNQMIGNIEDKAQAAKEKAQQAAQTAKDKTSQTAQAAKEKTQQTAQAAKEKTQQTAQAAKDETQQTAQAAKDKTQQTTEATKEKAQDTTGRAREKGSEMGQSTKETAQSGKDNSAGFLQQTGEKVKGMAQGATDAVKQTFGMANDDKDKDHFPTNRH

SEQ ID NO: 18491 - protein, 155 aa, Cicer arietinum
MTSHDQSYRAGEAKGRTEEKTNQMIGNIEDKAQAAKEKAQQAAQTAKDKTSQTAQAAKEKTQQTAQAAKDKTQQTTQATKEKAQDTTGRAKEKGSEMGQSTKETAQSGKDNSAGFLQQTGEKAKGMAQGATDAVKQTFGMTNDDQDKDHFPTNRH

SEQ ID NO: 18492 - protein, 209 aa, Orchis italica
MGRGNTEIKRIENSTNRQVTFSKRRSGIIKKAREISVLCDAQVSLVIFSSLGKLSEYCSPSTTLSKMLERYQQNSGKKLWDATHENLSAEIDRIKKENDTMQIELRLKGEDLNSLTPKELIPIEEGLQNGLTSVREKQMDFLKMLKKNERMLEEENKRLKYLLQHQQLAIEGSMRELEISYHQKDPEYADQMPMTFRVQPFQPNLHGNN

SEQ ID NO: 18493 - protein, 497 aa, Spinacia oleracea
MAFPIPARQLFIDGEWREPIKKNRIPVINPSTEEVIGDIPAATAEDVEVAVVAARRAFRRNNWSATSGAHRATYLRAIAAKITEKKDHFVKLETIDSGKPFDEAVLDIDDVASRFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 18494 - protein, 416 aa, Claviceps purpurea
MTDIPGRRAFKCFNQEFVVDERYTVTKELGQGAYGIVCAAVNNQTKESVAVKKVTNVFSKKILAKRALREIKLLQHFRGHRNITCLYDMDIPRPDVFNETYLYEELMECDLAAIIRSGQPLTDAHFQSFIYQILSGLKYIHSANVLHRDLKPGNLLVNADCELKICDFGLARGFSADPEQNAGYMTEYVATRWYRAPEIMLSFQSYTKAIDVWSVGCILAELLGSRPFFKGRDYVDQLNQILHVLGTPNEETLSRIGSPRAQEYVRNLPVMPKKNFATLFPQANPHALDLLDKMLAFDPSSRISVEQALEHPYLQVWHDPADEPNCPTIFNFDFEVLDDVGEMRKVILDEVIRFRQMVRTASSAEPTTGQAQTAAAGQVPMPQAGGQWKAEDPRPQENTPQGNGLEQDLQAGLDAA

SEQ ID NO: 18495 - protein, 502 aa, Nicotiana sylvestris
MEHSLMATRSYFLLFSSFTFLLILLSFPVEKSHALEAKETIESHFHTLQLTSLLPSSSCNTATKGKRRGASLEVVNRQGPCTQLNQKGAKAPTLTEILAHDQARVDSIQARVTDQSYDLFKKKDKKSSNKKKSVKDSKANLPAQSGLPLGTGNYIVNVGLGTPKKDLSLIFDTGSDLTWTQCQPCVKSCYAQQQPIFDPSASKTYSNISCTSTACSGLKSATGNSPGCSSSNCVYGIQYGDSSFTVGFFAKDTLTLTQNDVFDGFMFGCGQNNRGLFGKTAGLIGLGRDPLSIVQQTAQKFGKYFSYCLPTSRGSNGHLTFGNGNGVKTSKAVKNGITFTPFASSQGATFYFIDVLGISVGGKALSISPMLFQNAGTIIDSGTVITRLPSTVYGSLKSTFKQFMSKYPTAPALSLLDTCYDLSNYTSISIPKISFNFNGNANVDLEPNGILITNGASQVCLAFAGNGDDDTIGIFGNIQQQTLEVVYDVAGGQLGFGYKGCS

SEQ ID NO: 18496 - protein, 265 aa, Arundo donax
AESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFLNPKDHSKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHTVPFSEINKAFDLMAKGEGIR

SEQ ID NO: 18497 - protein, 212 aa, Eragrostis japonica
KSRFSINGKPIYHFVGTSTFSEYTVMHVGCLAKINPEAPLDKVCVLSCGISTGLGASINVAKPPKGSTVAVFGLGAVGLAACEGARIAGASRIIGVDLNPNRFEEARKFGCTEFVNPKDHNKPVQEVLAEMTNGGVDRSVECTGNINAMIQAFECVHDGWGVAVLVGVPHKDAEFKTRPMNFLNERTLKGTFFGNFKPRTDLPNVVELYMKK

SEQ ID NO: 18498 - protein, 262 aa, Muhlenbergia setarioides
WPCSSCVHWGMQGVRPLQVVWEQPVWSAQDQHRPGCDDWCRQLTVSIDGKPIYHFVGTSTFSEYTVIHVGCLAKINPEAPLDKVCVLSCGISTGLGASINVAKPPKGSTEAVFGLGAVGLAAAEGARIAGASRIIGIDLNTSRFEEAKKFGCTEFVNPKDHDKPIQEVLAEMTNGGVDRSVECTGNINAMIQAFESVHDGWGVAVLVGVPHMDAEFKTKPMNFLNERTLKGTFFGNFKPRTDIPNVVELYLKKELVLEKFIN

SEQ ID NO: 18499 - protein, 188 aa, Anomochloa marantoidea
VIHVGCLAKINPEAPLDKDCVLSCGISTGLGAALNVAKPPKGSSVAIFGLGAVGLAAAEGARLAGASRIIGVDLNPNRFELAKKFGCTEFVNSKDLDKPVQEVLAEMTNGGVDRSIECTGNINAMISAFECVHDGWGVAVLVGVPRKDAEFKTNPMNVLNERTLKGTFFGNYEPRTDLPNVVEMYMRK

SEQ ID NO: 18500 - protein, 188 aa, Joinvillea ascendens
VIHVGCVAKINPEAPLDKVCVLSCGISTGLGATLNVAKPPKGSTVAIFGLGAVGLAAAEGARLAGASRIIGIDLNPNRFEQAKNFGCTEFVNPKDHNKPVQEVLAEVTNGGVDRSVECTGHIDAMVSAFECVHVGWGVGVLVGVPHKDAVFKTNPMNLLNERTLKGTFFGNYKPRSDLPSVVEMYMNK

SEQ ID NO: 18501 - protein, 188 aa, Lithachne humilis
VMHVGCVAKINPAAPLDKVCVLSCGISTGLGASINVAKPPKGSTVAIFGLGAVGLAAAEGARIAGASRIIGVDLNPNRFEEARKFGCTEFVNPKDHNKPVQEVLAEMTNGGVDRSVECTGNINAMIQAFECVHDGWGVAVLVGAPHKDAEFKTHPMNFLNERTLKGTFFGNYKPRTDLPNVVELYMKK

SEQ ID NO: 18502 - protein, 188 aa, Anomochloa marantoidea
VIHVGCLAKINPEAPLDKVCITSCGVSTGLGATLNVAKPKKGSTVAIFGLGAVGLAAVEGARLAGASRIIGVDLNPAKFGQAKKFGCTDFVNPKDYNKPVQEVLIAMTNGGVDRSVECTGHIDAMISAFECVHDGWGVAVLVGVPHKEALFKTHPMNFLNEKTLKGTFFGNYKPRSDLPNVVEMYMKK

SEQ ID NO: 18503 - protein, 280 aa, Bambusa multiplex
  unsure (1)..(280): unsure at all Xaa locations
IVESVGEGVTDLAPGDHVLPVFTGECKECPHCKSAESNMCDLLRINTDRGVMIGDGKSRFSINGKPIYHFVGTSTFSEYTVMHVGCVAKINPEAPLXKVCVLSCRISTGLGASINVAKPPKGSTVAIFGLGAVGLASAEGARIAGASRIIGIDLNPSRFEEAKKFGCTEFVNPKDHSKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSV

SEQ ID NO: 18504 - protein, 251 aa, Tuber borchii
MAPAHKAIVFTDFDGTITLKDSNDYLTDNIGYGPEKRREGNIDILENRVKFRDAFKEMLDSVKKPFPECIEILRKNIKLDPGFKDFYDWCLSEKIPVIVLSSGMEPIIRALLTDLVGPHADQIKIVSNQPKFLDPEGNEWTVEYHDDSDFGHDKSLAIKPTGNLPKEDRPVLFYCGDGVSDLSAARETDLLFAKYGHDLITYCEREGAPFTVFKTFEDIHRDIKDIMENKTTIDEVASRHLRAKDAAKAAE

SEQ ID NO: 18505 - protein, 482 aa, Comamonas sp. NCIMB 9872
MNSSLHYNYVGGDWVNGATERHNLNPSDLSDSIGIYVGANEAQTQAAIDAAFDARTAWACWTAEQRADALDRIGTSILASAKELGHLLSREEGKTLAEGIGEAARAGRIFKYFAAEALRCGGDLLPAIRPGVSVEVTREPEGVVGIITPWNFPLAIPAWKIAPALAYGNTVVFKPADLVPGSAWALTEIIHRVGGLPPGVFNLVMGPGSKVGNTLANAPKVRALSFTGSATTGRQVGLACMERGAKVQMEMGGKNPLVVLNDADLQSAASVAIQGSFYSTGQRCTGSSRLIVEAGIHDAFVEAMRQQMSALSIGHALKQGTDIGPVASEDQLQQDLEYIRIGVAEGGRLYCGGSQLERETEGFYLSPALLTETDNSMRINREEIFGPVASVIRVGSYEEALHTANDTVFGLSSGICTTSLKYASDFKRRSAAGMVMVNVPTAGVDYHAPFGGRKGSSYGAREQGAYAREFYTVIKTAYTSAG

SEQ ID NO: 18506 - protein, 502 aa, Pseudomonas aeruginosa
MEKTTTSPVGATYWRSRAENVEFEGRCLIDGKLIEAHSGQTFDCVSPVDGRVLTKVAEGGEADINKAVAAARAAFQDRRWAGQSPIFRKRTLQAFAALIRLHRDELALLETLDMGKPISASRSVDVEAVANCFDWYAEAIDKLYEQIAPTAENDLALITREPLGVVGAIVPWNFPMLTTAWKVAPALATGNSVVLKPAEQSPLTAIRLGQLALEAGIPEGVFNVVPGFGRSAGKALACHMDVDGIFFTGSTATGRLLTEYAAKTNLKRVCLELGGKSPNIILASYGDIEKAAVTAAESMFNNQGEVCIAPSRLIVERSIHKQVVEIVAEIARQRQPGDPLDPATRIGALVNAQHADRVMGFIERAKTDGATLAAGGTRALTETGGSYVVPTVFDNVSNDMEIAREEIFGPVLSVIPVSSVDEAVSVANDSPYGLGAGVWTDSLSDAHKISRKLRAGVVYVNCYNDCDITTPFGGVKQSGNGRDKSLYALDEYTELKTTWIRL

SEQ ID NO: 18507 - protein, 346 aa, Pseudomonas aeruginosa
MRAAVYESFQGKITVQTMPDPEPSEFGAVIEVKASGICRSDWHGWVGHDTDIVLPHVPGHEFAGVVAAVGRGVTKWKVGDRVTMPFMGVCGSCGECSSGNEQMCDHQFQPGFKHWGSFAQYVAIDMADRNLVALPEAVAFSTAAGLGCRFATSFRAMAFQARIEPGQWVAVHGCGGVGLSAIMIAEALGANTIAIDIADDKLELARALGAARTINARQVDNVASAIADLTGGGAHVSVDALGSVVTCRNSIESLRKRGKHLQVGLLAGDQALPAIPMGRVVLKELQLLGSYGLQPHKYGDMLAMIEAGKLKPEKLIGRTVTLEEATTILPKMDSFQERGVAIIDRF

SEQ ID NO: 18508 - protein, 526 aa, Candida albicans
MSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRRWTLILSTLIVFNLGVLLQTVATEKKLLIAGRAIAGTGVGLISSVIPNYISETTPKWARGAVTASYQWMITWGLLIAACANKGSQGRKDSGSYRIPIGIQFLWALILGIGFLFLPETPRYWVSKSEETKAKDSLRRIRNLPVDHPDLVSEYDDIKANFDFESKYATSSWTQVFKNVNKQHHRLFTGVAIQALQQLTGINFIFYYGTQFFKRSGIEDPFLIQLATNIVNVGMTVPGIILVETWGRRPLLMAGSVVMAVSQLIVAIVGVAASSHAANQCLVAFSCIFIAGFAATWGPLCWAICGESFALNVRSKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 18509 - protein, 500 aa, Trypanosoma brucei
MDAALALLFGQVATAVLPYVVNSIGRVPRPKRVDVKKAMGEAHQCRPVVPYRAPRPYTEGRVKALFIGINYTGSSAQLGGCVNDVMHMLQTLQRIEFPISECCILVDDRRFPNFTAMPTRENIIKYMAWLVYDVRPGDVLFFHFSGHGAETKGGRDSNEKMDQCLVPLDYDKAGAILDDDLFELMIKGLPAGVRMTAVFDCCHSASLLDLPFAFVAGRNVSSNQRHEMRMVRKDNYSRGDVVMFSGCEDSGTSADVTNTSSFGNGTVAAGGAATQAFTWALLNTTGYSYIDIFMKTREVLRQKGYKQVPQLSSSKPVDLYKQFSLFGPLTMNASLVQHLPQEYVQPWAPHPAYQQPHEATLPASVSQPHSQPVMGIPVASTSNGKSNPGVSDGGRASGEVYPPTQYPSSHPAPQQQAYYQPPQQAYYQPPQQAYYQPPQQAYYQPPQQAYYQPPQQAYYQPEPHHQPAPPPPPKKENKPARPGYPMSYCMKFSQGKPGRK

SEQ ID NO: 18510 - protein, 293 aa, Oryza sativa (japonica cultivar-group)
MEQYEEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMER

SEQ ID NO: 18511 - protein, 323 aa, Homo sapiens
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 18512 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 18513 - protein, 142 aa, Hordeum vulgare
MASSSVLLGGGAGAAAFTGAAAGKALPRPCFLAARPHTDSGRRLCLQTPPRATPDAVEKAKEAAGDAAGKVQDATDNAVEGAKSAGESVVDAAKDGASKVSETAQDLGGQAKQAAEEAWDATKDAAQSVADNVAAAVEDVSK

SEQ ID NO: 18514 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 18515 - protein, 647 aa, Drosophila melanogaster
MRVWVAYSAAALLLLVHAGPESISGQEVPQSKTSSNTTTTDNSSSIHTVSDVFVNSPLGNVTPSISASGNASTTKRGNASTLVTDPPLIDSHAVEQEHNSSLSLFFVICVIMLGILLIHSMLQTGFQYLPESIVVVFLGAFIGLSLNVMSGQNGSWKREEVFSPMGFFLVLLPPIIFESGYNLHKGNFFQNIGSILVFAIFGTTISALVIGAGIYLLGLGEVAFRFSESFAFGSLISAVDPVATVAIFHALDVDPILNMLVFGESILNDAISIVLTASITQSANVNAEASTGEAMFSALKTFCAMFFASAGIGVIFALISALLLKHIDLRKHPSLEFAMMLMFTYAPYVLAEGIHLSGIMAILFCGIVMSHYTHFNLSTVTQITMQQTMRTLAFIAETCVFAYLGLAIFSFKHQVELSFVIWAIVLCLIGRACNIFPLAFLVNKFREHKINNKMQFIMWFSGLRGAISYALSLHLNLDSQEKRHVIITTTLIIVLFTTLVLGGSTMPLLKYLKPGKKRRARGSGRNAAEEGGRRNGSGRKRSKSISLSKTREWGQAIDSEHLSELTEEEDVTFTQARDRFGRMDRKYFIPFFTRRFNSQELHECKSQMADLTNKWYQAIRVSPLDSDESDEEIGLAASTSQIHLTRS

SEQ ID NO: 18516 - protein, 279 aa, Drosophila melanogaster
MCCSPGISYCIFDLESAVFDTRHVYKRAVIELAASYNKIIPEAVLIKSGPMETAEMAELICRKCDLPVSWESFRFQLNERTSDLIANPTLMPGVERLVTHLGRCCMGLGLITSCSESMYCTKIRDREDFFQNFSSVICADDADLKAPKPEPDVYLIAMRRLGDAGPDCTLVFDGTPKGVQAATDARLPVVMLAEKDLPCCWSELATLRLETLEEFDPAEFNMPPYSCTEPPPKKPKASSHRSSQKSAGSQRGSAALKKAAADSEADEGEEEEGEGQEVA

SEQ ID NO: 18517 - protein, 216 aa, Drosophila melanogaster
MSAEEAGSRHERLRTETVQRILDPYGHTYSFDLKMRCMGKPDSEQAALIVNTFNLPFSMTEFENQQELQCRGKMGFIRLMPGVERLLHHLKAFNIPMAIASGCCRDSFRIKTRRHSRPFDVFHHVVLSGSDEEVKRGKPAPDVFLTTASRFEESPEPSKCLVFESSLVGMEAALSAGMQVVLVPDPLVSFRASAHATLRLRSLEGFKPQYFGLPPL

SEQ ID NO: 18518 - protein, 182 aa, Drosophila melanogaster
MRCMGKPDSEQAALIVNTFNLPFSMTEFENQQELQCRGKMGFIRLMPGVERLLHHLKAFNIPMAIASGCCRDSFRIKTRRHSRPFDVFHHVVLSGSDEEVKRGKPAPDVFLTTASRFEESPEPSKCLVFESSLVGMEAALSAGMQVVLVPDPLVSFRASAHATLRLRSLEGFKPQYFGLPPL

SEQ ID NO: 18519 - protein, 355 aa, Drosophila melanogaster
MLEELAKDDEKMDGNHTDANQIIKDRRRQEEHYFKLYGRIEIHEWLLKDSVRIKAYREAIQHNEFFRHKTVLDVGCGMGVLSMFAAKAGSKRVLAVEAATISEFAQQVVQDNEFGRVIQVIQGKVEDIELPDGIKKVDIIVCDWMGSCLFSGNMLESLLFARDKWLSATGHIYPDTAQLYLAAIKGRDQDLGFWHDVHGFDLSAIRRRCESKAVVEHVTGDQMMSRVCLVKSLDLYTEPRQSAKSRSLFELKVSRNGWVHGLVAYFDVGFSKSTQRISFSTSPSAPWTHWNQTVFYLETPLPVRAGECIKGVLTMKPSEDSIFDTEFDIFVNFDGREKSVTIHQSFVLSDPLTLC

SEQ ID NO: 18520 - protein, 433 aa, Drosophila melanogaster
MKNRQRTRRISLNENHNRYMGSGGIDVQIVTNTKEPNQVNLNSSSATTTSAEAALPASLPLAQIAQQPHTHPHPHPNPHLHQQHQLIVTPTTMTGKYHPAHAKLRRCKSTPSLNCDGMAEPMEEDQLHRFAACSRNPAAEAQQHAQPSCNSSSSSSDGSCNSNKCSSNICGAQPTTPESLRFGCAHYKRRAMFVTPCCNKFYKCRFCHDENETHHFDRKTLTELICSECNTRQTVREQCLNCGVRFGKYTCLICNLFDDADKQQYHCHGCGICRIGGAENFFHCEVCNMCLPIQLKIDGHRCVENISRSHCPVCLGDIHTSRIPCHIPDCGHLLHKMCFDQLLASGHYTCPTCQTSLIDMTALWVYLDDQAERMPVPLKYENQRVHIFCNDCHKTSKTKFHFIGLKCVHCGAYNTTQDVKRRLSLVTDEPSSA

SEQ ID NO: 18521 - protein, 727 aa, Drosophila melanogaster
MSHGDVDPEVEMTSPHRIHGDAGSHPRSQTFWKLQCWRSSMLLIVGFALCVLAPGCSATDTDIALDAKATLNHRIQSLDLLVFVFLLALTVLTIWLFKHHRVSWLHETGLAVIYGLIVGAIIRYAGTSATLVHMQVEPQGVPTYSDKLPPDTLWFRYPVNQTNGTKPPEGIKTYAYVFRGQVHDVDENEIDLKATFDPEVFFNIILPPIIFYAGYSLKKKYFFRNLGAILTFAIVGTTLSAFLIGGFMYGCVKLMPKYLSSSFTFLDSLYFGALISPTDPLTILAIFNDLRVDVNLYALVLGESVLNDAVAIVLSGAIQNYGEHYSNTGEFETTAFLRSLSDFFSIFLLSLMIGAAMGCLTALMTKFTRVRDFPLLESALFVLMSYSTFLLAEATELTGVVAVLFCGICQAHYTYNNLSEDSRQRTKQIFELLNFLAENFIFSYIGVSMFTFPKHHFDAGFIITAFICAAIGRAVNVYPLSWLLNIKRKPKISTNFQHMLFFAGLRGAMSFALAIRNTVSDERQTMLTATSLIVIFTVVIQGGAANFLLNWLKIPVGVDDETEQLNNYQVHSSDGYLQDVEGGGVNRNKMRLSGGTDTNLDTPVDGTNGSLGGASGGRRRNSHEKAILARIWGNFDTKYMKPLLTHSRPTLLETLPVCCNPIARLLTTTQQLTQDGSEFRRVDSDSDICIDNDTGNGLSQDGSGAAPGVGRRNSLSRVGGDHRNAYI

SEQ ID NO: 18522 - protein, 751 aa, Drosophila melanogaster
MSHGDVDPEVEMTSPHRIHGDAGSHPRSQTFWKLQCWRSSMLLIVGFALCVLAPGCSATDTDIALDAKATLNHRIQSLDLLVFVFLLALTVLTIWLFKHHRVSWLHETGLAVIYGLIVGAIIRYAGTSATLVHMQVEPQGVPTYSDKLPPDTLWFRYPVNQTNGTKPPEGIKTYAYVFRGQVHDVDENEIDLKATFDPEVFFNIILPPIIFYAGYSLKKKYFFRNLGAILTFAIVGTTLSAFLIGGFMYGCVKLMPKYLSSSFTFLDSLYFGALISPTDPLTILAIFNDLRVDVNLYALVLGESVLNDAVAIVLSGAIQNYGEHYSNTGEFETTAFLRSLSDFFSIFLLSLMIGAAMGCLTALMTKFTRVRDFPLLESALFVLMSYSTFLLAEATELTGVVAVLFCGICQAHYTYNNLSEDSRQRTKQIFELLNFLAENFIFSYIGVSMFTFPKHHFDAGFIITAFICAAIGRAVNVYPLSWLLNIKRKPKISTNFQHMLFFAGLRGAMSFALAIRNTVSDERQTMLTATSLIVIFTVVIQGGAANFLLNWLKIPVGVDDETEQLNNYQVHSVYNSMDNSHPQTSDGYLQDVEGGGVNRNKMRLSGGTDTNLDTPVDGTNGSLGGASGGRRRNSHEKAILARIWGNFDTKYMKPLLTHSRPTLLETLPVCCNPIARLLTTTQQLTQDGSEFRRVDSDSDICIDNDTGNGLSQDGSGAAPGVGRRNSLSRSVHLNEANHLANELSLVANNFM

SEQ ID NO: 18523 - protein, 258 aa, Drosophila melanogaster
MSRHPSDRKVYVGDLGNNARKNDLEYVFGAYGSLRSVWIARNPPGFAFVEFESARDAADAVRGLDGRTVCGRRARVELSTGKYARSGGGGGGGGGGGGGGGLGGRDRGGGGRGDDKCYECGGRGHFARHCRERKARQRRRSNSFSRSRSTSRRRRTRSKSGTRSRSRSAGSVGRRSGRSNGRDENGSASRYSDHERNGSGAVDSPPPPKRRYEDEDDDRVRGSPRSRSRSRSASPAVRRGSPPRRRGDSSASRSVSRD

SEQ ID NO: 18524 - protein, 681 aa, Drosophila melanogaster
MVKVQKPQPKSLNKSASIEGVVKKKGKPEKTKKLATDATLELASNKKAKNAAPVKKDAIKKEPEVSKKGAEKKQSKAAKRPLILAPPESPAAPAPAAKKSKAKPAASGAPVGKKIEAKKPLILAPPESPVPPKKQEKKTKAAPVKAKKEPAPAKKSVQDPVPSIKKVPAAKKSGQTAALTKKTAKTEKQAAPAKPAKAQPASQLQKKAKAVQKLSKPASPPKSKKALSKSKPGQAKGNAVNKEPAKSKKPVELTFELKAFDEKRFHEIVNENNVTKVCAALKSVVSEEVEKKKNTSIFSDYRYVLQVCSYKIPSCPKRMVKLNLKHSLVGKDDDVALIVPDLQRGAKFDYDPTKQHYEDMLREAGVKQRLTVVPFNQLRNEMGSFEAKRKFLNSYDYLLCDGRLSGQATAFLGKNTQKPRNVLHSLRLSKDNDKLPQEVTRALTRTAFRQLSKGDLIAVPVGNHEITAEQLAENILLVIKQLQEVYPGGLANIRSMYLKIDITGTSALPLYVSMCAPPEDVPYVVGPREQRMLKLKKQANEVLSKFAMTKDAEFIKLTSDQVKRKAQLRKEKAALLAADAAPKDNDGGDAAVPAKKARKESSSEGAKADAESDEEEEVEEAEDSAGESGDEDEEGHDGDDTDEDEDEDDDDDNEDGDDDEDEDDDEEDDDEEDDDDDDDEE

SEQ ID NO: 18525 - protein, 413 aa, Drosophila melanogaster
MLATLWIILLSSTFGKCLDNGLAKTPPMGWLSWERFRCNTDCVNDPDNCISEQLFQTMTDIVVADGYASVGYEYINIDDCWLEKHRSHDGKLVADRKRFPNGIKALSDYIHSRGLKFGIYEDYGNYTCAGYPGIIGYEEKDALQFADWNVDYVKLDGCYALPYDMDHGYSTFGRLLNSTGKSMVYSCSWPVYQIYAGIQPNYSAIQTHCNLWRNYDDIQDSWASVENIIDYYGNNQDVIAPNAGPGHWNDPDMLIIGNFGLSYEQAKTQFAIWSILAAPLLMSVDLRTIRPQFKHILQNRKIIAVDQDPLGIQGRRIYKHKGIEIWSRPIGPLYQNFYSYAIAFVNRRTDGTPSDISVTLKELGLINFSGYRVEDLYENVDYGVLYPNTKIKVKVNPSGVVMLKGEVQYPVDL

SEQ ID NO: 18526 - protein, 372 aa, Drosophila melanogaster
MTTAQHQHYTVEVGDTNFTIHSRYINLRPIGSGAQGIVCAAYDTITQQNVAIKKLSRPFQNVTHAKRAYREFKLMKLVNHKNIIGLLNAFTPQRNLEEFQDVYLVMELMDANLCQVIQMDLDHDRMSYLLYQMLCGIKHLHSAGIIHRDLKPSNIVVKADCTLKILDFGLARTAGTTFMMTPYVVTRYYRAPEVILGMGYTENVDIWSVGCIMGEMIRGGVLFPGTDHIDQWNKIIEQLGTPSPSFMQRLQPTVRNYVENRPRYTGYSFDRLFPDGLFPNDNNQNSRRKASDARNLLSKMLVIDPEQRISVDEALKHEYINVWYDAEEVDAPAPEPYDHSVDEREHTVEQWKELIYEEVMDYEAHNTNNRTR

SEQ ID NO: 18527 - protein, 247 aa, Drosophila melanogaster
MTELLIDPDIRVWVFLPIVLITFLVGIVRHYVSILISTQKKAEITQIQDSQAMIRARLLRENGKYLSAQSFSMRKNYFNNEETGYFKTQKRAPVAQNSSAMLTDMVKGNFINVLPMVVIGGWINWMFSGFVTTKVPFPLTLRFKPMLQRGVELASLDAAWVSSASWYFLNVFGLRSIYTLVLGENNHADQTQAQADAMTGAAMTMPQDPKAAFKAEWEALEITEYHNALKNIDADMLAIASAPAASS

SEQ ID NO: 18528 - protein, 341 aa, Drosophila melanogaster
MANTYFDEYENLEIHELMLKDRPRQEAYYNAILGNKDLFKDKIVMDVGAGTGILSAFCAKAGARLVYAVEASNVATKVALDLIEDNGLTNVVKVIQSRVEEFVLPAEAEKVDIIVSEWMGFYLLHEGMLDSVLLARDKFLKEGGLLFPSECTIFVAPCSVPSLFDDWHNVDGIKMDTFARKLRTQKSSRPEITQLNPQDLLHEGVVFHWMNLLDVEASDLDSIQFKEVITAQKAGNHQGFCIWFDVQFPGEDFVLSTSPLSPPTHWKQCVVVLPEESCENLEEKSPIAFQITMKRSAADMRKYNLEVDLLDPNTEEHPVPCSCHMTKCILTEAHLKMMDTS

SEQ ID NO: 18529 - protein, 570 aa, Drosophila melanogaster
MDFPDKMDLENERVLKLIFPDGVPDNLRGNPELDNYLAKLGTCKVEQLKKEQTRLAEEARTILEQTQDLAISNYRTFITTAENSRSIFSEFLRSEQQLDTLVSKLPDLSVQCERFLQDSAELNEQRRLNSITLQKNAQLLEVLELPQLMERCIREGRYEEALELAAYATRLGQHQGHIPVVTSIVRSVEALWHNMLVQLVAQLRTDLQLPKCLQIVGYLRRMQAFGDNELRLKFLQARDAWLTSCLEAIPTADAQQHLSKTIEITRINLFNIITQYRAIFPEDEGTLKTQSSLRPLQGVSCNGDRLFQAWLHNKISDFLQTLERDLQLGVGSVETVLGQCMYFGLSFSRVGADFRALMAPIFVGVIRRRFESSVEQVDEQFERELERFTLINKVALHSHARKQVDPEQESYAPPEALLDFYPLAALCNGYLSALNELRLCAPLALATDVTRCLQHSLQQAAQRVLAFYRQEQQAFAGSEREAFVRLCSCLAYDLVPYIQRCIHGVFPPQSLTVHLGISLLQLEQQQLTYLQQTRILEPLKHLLPTKALVQPQDKVMEAKPSAGVPVTAEG

SEQ ID NO: 18530 - protein, 257 aa, Drosophila melanogaster
MICMRLRVLRNLNRSALNGFRKDYIRSTGVNVNYSAVNFPAAIRTLKTFSNSILTKEPKPIFAFIASQRQYSCEKVGKTMEEHCVVPDVIAKAPAQTAVVEYPGDIVVKPGQVLTPTQVKDEPCVKWEADANKLYTLCMTDPDAPSRKDPKFREWHHWLVGNIPGGDVAKGEVLSAYVGSGPPPDTGLHRYVFLIYEQRCKLTFDEKRLPNNSGDGRGGFKIAEFAKKYALGNPIAGNLYQAEYDDYVPILYKQLGA

SEQ ID NO: 18531 - protein, 140 aa, Drosophila melanogaster
MSKGTGPLSKLYNITISTIDKFVPGAVQPLWQSPAGPRTVFFWAPAFKWSLVLAGLSDTLSRPPANISLNQCGSLAVTGLIWSRYSVVITPKNYNLLAVNIAVFLIQGYLMVKHLRWRSENSRNAVFNHSHYPIKSGDDW

SEQ ID NO: 18532 - protein, 331 aa, Drosophila melanogaster
MEVNQKWNWDTKPILVKCGGFSSQLAKNVTEKVDGDPLWGSRFDATNPEAVIQTHLDFLRNGADIILTNTYQSSVEGFVKYLGVTRERGVELIQKSVQLAKQAKEQYLSEIGSEAESALPLIMGSIGPYGAYLHDGSEYTGNYADKMSKEELRAWHKTRIEICLAAGVDGLALETLPCLMEAEAVTELVLDNFPDAKFWVSLQCMDEKHMASGENFAEAALSLWRLVQSRKAENRLLGIGLNCVNPLFVTPLLSSLTKVAGSDRIPLVVYSNRGEIYDVEQGDWTGTGEEVVKFVPEWIQLGVRIVGGCCRVYPTDVLAIRKYVDGLNIKP

SEQ ID NO: 18533 - protein, 1291 aa, Drosophila melanogaster
MSIRTEQDYDSATPALAQQMNLARRACWRIKSYSSESLFKTYASVITDTSANEIDAEAPPPPRDKTKTRIEPQIAPAKRNSSCTSSDWRGMFSKRTLLICALALILGSAQARPNTSAVGVAPRKVSQDIVDAVTQLNLGQSAPIDAVDVGLDPTPSARVPRPEPLKSGDENAKGDEGHKMERYPLSSVDFARVKTPFIIGIWILSASIAKIGFHMTPKLHLIFPESCLLIVVGVVIGVVLYFCTDVAVSPLTPNTFFFYMLPPIILDAGYFMPNRLFFDNLGTILLMAVVGTIFNIATIGGSLYACGKMGIYGESETPGLMDVFLFASLISAVDPVAVLAVFEEIHVNEILYIVVFGESLLNDAVTVVMYHMMESYNEIGLDKIIAQDIASGVGSFFVVALGGTAIGIIWGFLTGLVTRFTDHVRVIEPIFIFVMAYLAYLNAEIFHMSGILAITFCGITMKNYVESNISQKSHTTVKYALKMLSSSAETIIFMFLGVATVNNMHVWNTWFVVLTIAFCSVFRVIGVILLSALANRFRLHKLSRVDQFVMSYGGLRGAVAFALVLLVDENVVKQKNMFVTTTIAVIYFTVFLQGITIKPLVKILNVKRANKRKPTMNERIHERFMDHLMAGIEDIVGKTGNYNVRDKFKRFDNRFIRPLLIRDLKGAEPKIIETYSKLTMRDAMEVMRRNPSTIGQMTGTESMSALFRNYTNNYIGGSPSLTNLDNTCSRNLDMAELDYNPSKKDLTDARIHHLLAEELKPYRRHRRLSYSRHAVDDRDLSTQVNYKMQMNFRRMFNDRKHHKRSKRGASNKEAKENVKQNHVSFHDFQQNGTTKQLTNAEECQQNPNEINVVGPSDDWDDGLTFTAKSSPDSDRANNNSLIAHIQNLPGFDASKARIVVQHYAPKADDNPDTDIESPEQAIGPTAAELILPWRRDRSYQSIVAEHPIPEEDRNLSRESDGERRVATPTATESQLPWKRQGDECTDAVQQNEFPAWASNKEYLAYNSPSATFLGGINKPKQPKSVIGLFRRESSSSKAGSVGVGSTGAMDSAASGSETMVVSMSSQPPNAPSTSIHNPRLDKRSQSISSSSLGAGAHQLGPEGHSGPFPVTASHRRNVRRGSMLELSGDTIPEESSYQHGHSKSLCEPADSDEWEGAPLSAAGGANSELLMRMSGREPLLPRPSNTPRAQIRRMNAGAVGGAGVSQAGRKNQVTKALLDYEDSETDSDENDDDEDEDFDSYDDENIVVTTFTTPATGRRPGSSPGSGSEANTATTTTTSIRLTRNNDESII

SEQ ID NO: 18534 - protein, 855 aa, Drosophila melanogaster
MKAMDLNGFYQTFISFLIWGAFSNFPEVFAVRVANSQQNQPKKENQPDLTPMGSFWQQHVATPSSSTPFDSPFFSATHGLVQTHPSIGGSHSGPAPLNGNSLGSGAPSSILAGTKPALTAGSGYLNSRGSLPTSARYPANKITGTVVEPNPKSPFRHLDFSTSATAELRRNPALSAPDECARACREGEPPRICYYHFTLEYYTVLGAACQVCTPNATNTVWSHCQCVLADGVERGILTANRMIPGPSIQVCENDKVVIDVENHMEGMEVTIHWHGIWQRGSQYYDGVPFVTQCPIQQGNTFRYQWTGNAGTHFWHAHTGLQKLDGLYGSVVVRQPPSRDPNSHLYDFDLTTHIMLISDWLHEDAAERYPGRLAVNTGQDPESMLINGKGQFRDPNTGFMTNTPLEIFTITPGRRYRFRMINAFASVCPAQVTIEGHGMTVIATDGEPVHPVDVNTIISFSGERYDFVISADQPVGAYWIQLRGLGECGIRRAQQLAILRYARGPYQPASSPPTYDVGIPQGVVMNPLDAQCNRQRNDAICVSQLKNALEIDRGILAEKPDVKIFLPFRFFVYRAEDLFQPNTYNRFLVAPTGDHVISLIDEISYLSAPAPLTSQYNDINPDQFCNGDNRPADCGPNCMCTHKIDIPLNAIVEVVLVDEVVPSGDHLTSLVDEISYISPPAPPLSQIDDIPPEYFCNGDNRPPNCGPNCECTHMVDIPLGAIVEVVLVDEVQQVNLSHPFHLHGTAFYVVGLGRSPDKSIKKINLKHALELDQMGMLERHFSKPPLKDTIAVPNNGYVVIRFRADNPGYWLFHCHFLFHIVIGMNLIFHIGTTADLPPVPPRFPTCGDHVPPVTWY

SEQ ID NO: 18535 - protein, 784 aa, Drosophila melanogaster
MKAMDLNGFYQTFISFLIWGAFSNFPEVFAVRVANSQQNQPKKENQPDLTPMGSFWQQHVATPSSSTPFDSPFFSATHGLVQTHPSIGGSHSGPAPLNGNSLGSGAPSSILAGTKPALTAGSGYLNSRGSLPTSARYPANKITGTVVEPNPKSPFRHLDFSTSATAELRRNPALSAPDECARACREGEPPRICYYHFTLEYYTVLGAACQVCTPNATNTVWSHCQCVLADGVERGILTANRMIPGPSIQVCENDKVVIDVENHMEGMEVTIHWHGIWQRGSQYYDGVPFVTQCPIQQGNTFRYQWTGNAGTHFWHAHTGLQKLDGLYGSVVVRQPPSRDPNSHLYDFDLTTHIMLISDWLHEDAAERYPGRLAVNTGQDPESMLINGKGQFRDPNTGFMTNTPLEIFTITPGRRYRFRMINAFASVCPAQVTIEGHGMTVIATDGEPVHPVDVNTIISFSGERYDFVISADQPVGAYWIQLRGLGECGIRRAQQLAILRYARGPYQPASSPPTYDVGIPQGVVMNPLDAQCNRQRNDAICVSQLKNALEIDRGILAEKPDVKIFLPFRFFVYRAEDLFQPNTYNRFLVAPTGDHVISLIDEISYLSAPAPLTSQYNDINPDQFCNGDNRPADCGPNCMCTHKIDIPLNAIVEVVLVDEVQQPNLSHPFHLHGYGFSVIGIGRSPDSSVKKINLKHALDLDRRGLLHRQYNLPPTKDTIAVPNNGYVVLRFRADNPGFWLFHCHFLFHIVIGMNLILQVGTNADLPPVPPGFPTCGDHTPSIPIN

SEQ ID NO: 18536 - protein, 733 aa, Drosophila melanogaster
MGSFWQQHVATPSSSTPFDSPFFSATHGLVQTHPSIGGSHSGPAPLNGNSLGSGAPSSILAGTKPALTAGSGYLNSRGSLPTSARYPANKITGTVVEPNPKSPFRHLDFSTSATAELRRNPALSAPDECARACREGEPPRICYYHFTLEYYTVLGAACQVCTPNATNTVWSHCQCVLADGVERGILTANRMIPGPSIQVCENDKVVIDVENHMEGMEVTIHWHGIWQRGSQYYDGVPFVTQCPIQQGNTFRYQWTGNAGTHFWHAHTGLQKLDGLYGSVVVRQPPSRDPNSHLYDFDLTTHIMLISDWLHEDAAERYPGRLAVNTGQDPESMLINGKGQFRDPNTGFMTNTPLEIFTITPGRRYRFRMINAFASVCPAQVTIEGHGMTVIATDGEPVHPVDVNTIISFSGERYDFVISADQPVGAYWIQLRGLGECGIRRAQQLAILRYARGPYQPASSPPTYDVGIPQGVVMNPLDAQCNRQRNDAICVSQLKNALEIDRGILAEKPDVKIFLPFRFFVYRAEDLFQPNTYNRFLVAPTGDHVISLIDEISYLSAPAPLTSQYNDINPDQFCNGDNRPADCGPNCMCTHKIDIPLNAIVEVVLVDEVQQPNLSHPFHLHGYGFSVIGIGRSPDSSVKKINLKHALDLDRRGLLHRQYNLPPTKDTIAVPNNGYVVLRFRADNPGFWLFHCHFLFHIVIGMNLILQVGTNADLPPVPPGFPTCGDHTPSIPIN

SEQ ID NO: 18537 - protein, 1020 aa, Drosophila melanogaster
MSAINIKHNGSWLPAVDGIKDNEGRRPATLSLNKCTATALAVLQCSTPPIHSSSTLSFAADIKLLARKLSHFDPLTLKVPLKDVVCYLSLLEAGRPEDKLEFMFRLYDTDSNGVLDTAEMDAIVNQMMAVAEYLGWDVSELRPILQEMMVEIDYDADGTVSLDEWQRGGMTTIPLLVLLGVDSTTLKEDGIHVWRLKHFSKPAYCNLCLNMLVGLGKKGLCCVLCKYTVHERCVQHAPASCITTYVKSKKPKCGGDLLHHWVEGNCYGRCSKCRKRIKAYHGITGLTCRWCHMMLHNRCASSVKKECTLGEYSELIVPPTAICPAVLDRQRSVNQAHKKSQMHHHQATHFQITPPDELSCPLLVFVNPKSGGRQGDRILRKFQYMLNPRQVYDLSKGGPKEGLTLFKDLPRFRVICCGGDGTVGWVLEAMDSIELASQPAIGVIPLGTGNDLARCLRWGGGYEGENIPKLMDKFRRASTVMLDRWSIEVTNTPHSDDMRPKVTLHSNMQKVIELSQSVVVDKSLMERFEEIQRQSKQVATSMGTAASSTSIMMASKTETEMETMATMEFGSSTTTTNRTTTTKSISMSTFETQCLQQTLRTAMSSSSSNTSSGSPCNGNQDAETEVDSHAAAAADVREKSVPRRSGETEKQSLETLLLQHKQQMQQQQQQQQQGVTSLAVEEAATATPVGSNQSDNSSQRNKQNNILKQQITLSLDLSDHEDEPKDDGGGAGDGTKSNGNSIPATPATPITPTTPNAASSVLQQQQQQHLQFEQQQKPIKVQSDKDCTVPYNIINNYFSVGVDAAICVKFHLEREKNPHKFNSRMKNKLWYFEYATSETFAASCKNLHESIEIVCDGVALDLANGPHLQGVALLNIPYTHGGSNLWGEHLSQKRIRKSAGPFGKSKKLRAGDKEFSATSFNSVDLSVAIQDFGDRLIEVIGLENCLHMGQVRTGLRASGRRLAQCSEVIIKTKKTFPMQIDGEPWMQMPCTIKVTHKNQVPMLMAPRSEKGRGFFNLLCS

SEQ ID NO: 18538 - protein, 791 aa, Drosophila melanogaster
MRWELRYGWQIVTFRTNCATAAAVACHQLLCPVSLTSAVEIMPNSFPPEGRRRERRSGNLVLRAGCCCIGKYFLHNRCASSVKKECTLGEYSELIVPPTAICPAVLDRQRSVNQAHKATHFQITPPDELSCPLLVFVNPKSGGRQGDRILRKFQYMLNPRQVYDLSKGGPKEGLTLFKDLPRFRVICCGGDGTVGWVLEAMDSIELASQPAIGVIPLGTGNDLARCLRWGGGYEGENIPKLMDKFRRASTVMLDRWSIEVTNTPHSDDMRPKVTLHSNMQKVIELSQSVVVDKSLMERFEEIQRQSKQVATSMGTAASSTSIMMASKTETEMETMATMEFGSSTTTTNRTTTTKSISMSTFETQCLQQTLRTAMSSSSSNTSSGSPCNGNQDAETEVDSHAAAAADVREKSVPRRSGETEKQSLETLLLQHKQQMQQQQQQQQQGVTSLAVEEAATATPVGSNQSDNSSQRNKQNNILKQQITLSLDLSDHEDEPKDDGGGAGDGTKSNGNSIPATPATPITPTTPNAASSVLQQQQQQHLQFEQQQKPIKVQSDKDCTVPYNIINNYFSVGVDAAICVKFHLEREKNPHKFNSRMKNKLWYFEYATSETFAASCKNLHESIEIVCDGVALDLANGPHLQGVALLNIPYTHGGSNLWGEHLSQKRIRKSAGPFGKSKKLRAGDKEFSATSFNSVDLSVAIQDFGDRLIEVIGLENCLHMGQVRTGLRASGRRLAQCSEVIIKTKKTFPMQIDGEPWMQMPCTIKVTHKNQVPMLMAPRSEKGRGFFNLLCS

SEQ ID NO: 18539 - protein, 760 aa, Drosophila melanogaster
MVMSENSNISYCQAVANRTSFFTTAYNGIPETLILNTIFWVLLILLFTVLRHQAGDFGRLALVNSNGSKKRWTEIFYSRAASVVDPQPSTSTQVSPRPSTTSQGVPDSTPLSPIQPEEGLFGWIRVTLKLRKETILLHTGPDAVHYLSFQQHLMAVMALVTIVSLVIILPVNFLNGPKENPYDVNAFGRTTMANLSPDSPWLWVHTIITILYIPLVVLIMRRASGRNAFKKAATRTIMISNISSSDRNKTVVRNYMQELFPDVTIENVSIAYNISRLYVRNAEFERVHEARLYCEHHRNRDTLMVKPEMCSCKKENAYEYYQREERKLSGDVARLRASTMNEPLDIAFITVSTVQEAQNIVTHFTPGTYRQWHLVFAPSPDDLFWENLNVNKSHWYLKFFCVNAVLFLVLFFLSTPAMVVSLLNSRPWVKETEGKISPLVADFLPTLMLWTLSALMPVIVAISDKWMRHYTRSKQNYSIMTKCFGYLLMMIMILPSLGLTSAQALLEWGFLNQTDRWQCIFLPDRGSFYVNYIITAAFIGTALELLRFPELIVYIWSLLKAKSKAETPYIRKAILIEFPFGTHYAWTTLVFTIAIVYSVACPLIMPFAMIYICLKHFVDRHNLYFAYGPSNMISRKGGKIHSTAVTMTKFSVVILVLVMAMICFFRGDNGMARFLLLIISLAITLTLFTFMSPIKRCAATRRPSIVEIAGPAPIYVPDVLKDNGIRTSSVRPSAAAFGGYGSDSVSEYDSSQYSVNSVEA

SEQ ID NO: 18540 - protein, 2693 aa, Caenorhabditis elegans
MCTEKGKTWTKAEVTKQAFITLFNLVPGESYRFRVRADNTFGQSEPSDESELVVVKNVSRVVEEPKKKEVKVKEQESVDYERVAKDSEPSEYKTIDIHRLPNDLQAKYIIHEELGKGAYGTVYRATEKATGKTWAAKMVQVRPGVKKENVIHEISMMNQLHHEKLLNLHEAFDMGNEMWLIEEFVSGGELFEKILEDDSLMSEEEVRDYMHQILLGVSHMHKNQIVHLDLKPENILLKAKNSNELKIIDFGLARKLDPKKSVKLLFGTPEFCAPEVVNYQPVGLSTDMWTVGVISYVLLSGLSPFLGDSDEDTLANVSASDWDFDDPSWDDVSDLAKDFICRLMIKDKRKRMSVQDALRHPWITKMQPKLDKSGVPARQKRNFLSLKRWSDDLLPIGRLAKRGAIFRRLTMDGVFERNIAFDTDAAPSVKKQLEDIVANVGDLIATLSCDVDGVPSPKVQWYKDDKELTVPSMKYDSFYNEGLAELTVKNIVESDAGKYTCRATNDLGSIMTHAKLSVKADEKKKKKSKTSPAVIEKKKDRKTSKVVVIEEMIDMPPNFHHLLQDDEAKIGEPKILVVTNTTLPEPTVDWYHNGEHISINDSNYLRKHDKGRYELHILSVDSTDEGKWKAVGKNAFGECESEAKLTVVIPDGQYAPSFGKQLSDVKCSESDILKLEVNIQANPAPEINWFRNESEIEHSQHHRLQFDDGSGNYSLTIIDAYAEDSGEYKCVAKNKIGKAHTVCCVRIEELLSKRSKKIDGSKAPRFRMQLPTPREVPQGADLTLVCSVSGTPHPNIKWTKDDKPIDMSNKQVRHENGVCTLHIIGARDDDQGRYVCEAENIHGVAQSFSVVEIKEAVDKDHVRPKFLEPLVNCSTCEGNEMVLECCVTGKPIPTITWYKDGLKLIIENRMLQYTDRKGVSRLNIMNVVMNDDGEYTCEAVNSLGKDFTHCTVKVVDMGLSKTRLTPVRSRSRSRSRSPSVVGGEIQRPPVVTRPLADATVTEGNRELLEVEVDGFPTPTIEWYHDGKLVAESRTLRTYFDGRVAFLKIYEAHEEHNGQYVCKVSNKLGAVETRAIVVVEAPDAAEHVTQMPTFVKKLQDVVLKTAGETATFTCQSYANPAAQVVWLHNGKALQQTKSNYKTRLFDDNTATLVIENVTDELCGTYTAVANNQFGDVHTSAQLTISGSEAKKIAASLPYFIIELKPKINVVEGATLSIQADLNGSPIPEVVWLKDNSELVESDRIQMKCDGVNYQLLVRDVGLEDEGTYTITAENEKGKIRQNTEVSVTKSKEVKEKKEKKKVEKKDEGKKKPGRPGLPRPSGASKTEQVTMAFDAPSEGPADSYEVERRCPDQREWVSCGSTKSLELEIKGLTPNTEYIFRVAGKNKQGLGEWSEMTSTLKTASVGQAPQFTISPQSKIIANRDDEFEIAVEFSGTPTPSVKWYKENLQIVPDEKIDVATTSTSSILNLKSQEENGTFNCLIENELGQASASCQVTIFNKPASLQSTPDHSLERNLVPTLQKALNNESAQAGQQIMLTCRISSRSESTVAWFKDDERIESAGRYELSSDKKSNHKLVCHAVQSQDTGKYRCVVTNKYGYAESECNVAVEDVTKFIAPSFSATLSDSTAILGHNITLECKVEGSPAPEVSWTKDGERISTTRRIRQTQDENGNCKLSISKAESDDMGVYVCSATSVAGVDSTSSMVMIAKTTGTDSHLVIAQTADEKHEKPRFTRAPPSLIEVNESGQFTLIAKAVGEPKPTVTWLKDGREILRTNRIYHHFVTGDGESHLIAECVVSKTSGIFSCKAENPNGTVIAETQVIVQRMKPANQLANVAPKFTIPLTDMGIVNGHPTTLSCNVTGSPEPTLEWIYIDDSGHKINLTSSTTDWTECRFGKVAELKSERVLREQRGTYQCIATNSSGQATTQCYLLVGELSDEPAGPPRFVKCLQDTWTPLKESIEFSVELAGFPTPDLTWYHNEKKINEGKDVKITFPSDTTSVLSIKNVSLASLGMYFVEASNIHGVLRTAGRLNVSDERRKAEPPQFKHVLEPVLAVQPKVAFSEEHPRASSSAATARVKKGAAPMFLQGLEDMDLKAGASAAVAGKLGRKLRPHRSTTNDADKLAKALAQSLRLDEPRASIDSRPESAANAALDEVRAAINSRNKRVCRPKFMVKPKPRKVLEEYKSLRLKTAISGNPMPQVHWDKEGIILETGNKYSIYNDGDFYYLEVHHVSTFDKGFYNCTAANNEGIITCTSEIDVLPNKEDSAAQVAKRKSRKEAKAPNFIEVLPGRSQANLNESLCVECSVSAYPCASIIWTRNSVRLLPQADRYTMSYDGECASLKFISVTPGDEGTYACEAVNELGSAVTNMNLQVSGVDPNAAEGIPPLFRFEKIKSVRKVVDGSRVELAAELVQASEPLQIRWLRNKVTIVDSPSFSYSRSENMVFLTIADVFPEDGGEYTVEAKNQSGIARCTMQLDVRNNERSVADEAPRVFDFEPTTRSDPGVSVELRAKVIGHPDPVISWTKAGQKLNNEEKYMMRNEGDKFILRIANVTRADAGKYELTAINPSGQANAELELTVVQSTKTVGAKPKFNESPISVQTCEKNRAELRASFSGTPAPACRWFYNGNELIDGLDGYTITSSDTNSSLLINSVDKKHFGEYLCTIRNQNGEELANAMILSEGSSAALPQRRTIRR

SEQ ID NO: 18541 - protein, 928 aa, Pectobacterium carotovorum subsp. carotovorum
MTKYSLRARMLILILAPTLMIGLLLSSFFVIHRYNQLQTQLADSGTRIIEPLATISAYAITHRQMDTIPTLINTLHRRHSAIIRTISVFDARNQLLATTNVRNNVTLQPLSSDALSYNKLHLHHTNDALILHMPIVNDSEFMPGGVQPGTATPLGYLVIELDTSTIRLQQYQEIFIAALLLLLSLGAAVIFAYRLMRDVTTPIRNMVDTVDRIRRGQLDSRVEGYMLGELDMLKNGINSMAMSLTAYHEEMQQNIDQATYDLRETLEQMEIQNVELDLAKKRAQEAARIKSEFLANMSHELRTPLNGVIGFTRQTLKTSLNTTQTDYLLTIERSANNLLNIINDVLDFSKLEAGKLVLEDIPFSLHSTLDDVVMLLAHTAHEKGLELTLSIQNDVPEQYVGDPLRIQQIITNLLGNAIKFTEQGNIDIRVEKRRQEHHQVQLEVQICDTGIGIAELQQSQLFQAFRQADTSISRRHGGTGLGLVITQRLVKEMGGDISFQSQLNKGSTFWFHITLPLNPHTVPIEPVYTMLQGKHLAYVEYHPIAAQATLDILSQTPLMVSYSPTFEQLPEGEFDILLLAIPAQYRNTLLDYTPRLRDICRRAPCVILALPSLAQMDAEQLKAFGVHACLSKPLAASRLLPLLQNSTLFQLSFLPSDTTSHQGTVRHPARLPLSVMAVDDNPANLKLIGTLLEEQVDTIILCESGTEAIAQAKMHQIDIILMDIQMPGMDGICASELIRQIPHHATTPIIAVTAQTMTGEREHLLSSGMDDYLAKPIDEQMLKSVLTRHARKDPLKRDRADMVGLLSEHDDSQLSLDWALAQQQAANKPELARDLLQMLLDFLPEVQRKIENVLNGQTDDDIIELVHKLHGSCSYSGVPRLKRICRYLEQQLRKGVHANDLEPEWLELLDEIDNVNNAAQPHINPRLP

SEQ ID NO: 18542 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 18543 - protein, 294 aa, Vigna aconitifolia
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEETWPGVTALPDFKSTFPKWPPKDLATVVPNLDAAGLNLLSSMLCLDPSKRITARIAVEHEYFKDIKFVP

SEQ ID NO: 18544 - protein, 456 aa, Xenopus laevis
MQGYIQESDFNLVEEGFLARDLMEEIINEVSQTEDRDAFFVADLGDVVRKHLRFLKALPRVKPFYAVKCNSSKGVVKILAELGAGFDCASKTEIELVQDVGVAPERIIYANPCKQISQIKYAAKNGVQMMTFDNEVELSKVSRSHPNARMVLRIATDDSKSSARLSVKFGAPLKSCRRLLEMAKNLSVDVIGVSFHVGSGCTDSKAYTQAISDARLVFEMASEFGYKMWLLDIGGGFPGTEDSKIRFEEIAGVINPALDMYFPESSDVQIIAEPGRYYVASAFSLAVNVIAKKEVEHSVSDDEENESSKSIMYYVNDGVYGSFNCLVFDHAHPKPILHKKPSPDQPLYTSSLWGPTCDGLDQIAERVQLPELHVGDWLLFENMGAYTIAASSNFNGFQQSPVHYAMPRAAWKAVQLLQRGLQQTEEKENVCTPMSCGWEISDSLCFTRTFAATSII

SEQ ID NO: 18545 - protein, 139 aa, Lycopersicon esculentum
LDETECQIKCGDLFENSVVDEFNECAVSRKKCVPRKSDVGDFPVPDPSVLVQKFDMNDFIGKWYITRGLNPTFDVFDCQLHEFHTEGNKLVGSLTWRIGTPDGGFFTRSAVQKFVQDPKYPGILYNHDNEYLHYQDDWY

SEQ ID NO: 18546 - protein, 598 aa, Squalus acanthias
MSVSLVAVRLELANHSHHPEGFEYCAVNMADDESKEKKSLSSAKLLLEGKTTGEKSTILHQHIGRREMRDMVIETITSSKDKDTVDCSLKSEQKTTCDTDPVEKASTADPNDNSKVSKDQSGNAPDSPSKQLPDQISFFSGNSSVEVVHGIMHLYKTDKMTSLKEDVRRSAMLCILTVPATMTSHDLMRFVAPFDDSIEHMKIIRDSTPNQYMVLVKFCSQAEADSFYTACNGRQFNSIEDDVCQLVYVERAEVIKSEDGASLPVMGVTELPPCIVCLERMDESVNGVLTILCNHSFHSHCLQHWEDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQDEKIDALQLEYSYLLTSQLESQRIYWENKIVHLEKDAAEEINNVKTKFKETIEKCDSLEQKLNELMKDKQALERKCSQLNNRVLKLGTELKEEQEMNKCLRANQIQLQTKLKEEEKKLKDTCDEKDRQITEVQEQLRDVMFYLEAQQKINQMPADTRQEIQEGQINIASAAPSPGAITKQTSRRGRGRRSK

SEQ ID NO: 18547 - protein, 132 aa, Cyprinus carpio
PLDGSSNIDCLASIGTIFAIYRKETDDEPSEKDALRSGRNIVAAGYALYGSATMLVLSTGQGVNCFMLDPAIGEFILVDQDVRIKKKGKIYSLNEGYAAHFYPDVTEYLQKKKFPEDGSSPYGGRYVGSMVA

SEQ ID NO: 18548 - protein, 390 aa, Streptococcus thermophilus
MDVYIDLRKKNDEGYLGMRKNKIKILHVAQAAGGVDRYIGMLLKYLDKEKFENILVCSQDFHEEDYRDLVDSFEQVEMSRAIGGNDLKAIKAVRALIKKYNPDIVYAHSSKAGAIARVADIGLKNRCVYNPHGWAFNMRCSAKKKALYTAIEKIAAPFCDKIICISDAEKQSALDKKICRDDKLQVIFNGVDIEAYENGVHGVVKRKDLNIPEDAFVVGMVGRMSPQKAPDIFIKMAKLVKEKVPNAHFIIVGNGNQEAEIRKYAEDNGFSDSLHITGWVDNPMSYVELFDVACLLSRWEGFGLALPEYMMAGKPIVASSVDAIPNIIRDGENGLLVEVDDAIGANEAVLRIYQEDGLKDRLVAQGLEDVHSRFNARRVSEEHGKLFERL

SEQ ID NO: 18549 - protein, 355 aa, Emericella nidulans
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 18550 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 18551 - protein, 509 aa, Drosophila melanogaster
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDQHRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKEDKKGTVDRSTTVVSKEPEAARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 18552 - protein, 249 aa, Drosophila melanogaster
MSVGVLAGKVALVTGAGSGIGRATCRLLARDGAKVIAVDRNLKAAQETVQELGSERSAALEVDVSSAQSVQFSVAEALKKFQQAPTIVVNSAGITRDGYLLKMPERDYDDVYGVNLKGTFLVTQAYAKAMIEQKLENGTIVNLSSIVAKMNNVGQANYAATKAGVISFTEVASKEFGKFGIRVNCILPGYIDTPMVAVVPDSVKQEVVQRCPLGRLGQPEEIAEVIAFLASPQSSYVNGAAIEVTGGLK

SEQ ID NO: 18553 - protein, 743 aa, Drosophila melanogaster
MASEITNGKNGQNGKNGQKEESDSQIAPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVALSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 18554 - protein, 734 aa, Drosophila melanogaster
MAFVSNAIVGPENCKSVTPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVALSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 18555 - protein, 737 aa, Drosophila melanogaster
MAFVSNAIVGPENCKSVTVSLPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVALSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 18556 - protein, 1095 aa, Drosophila melanogaster
MTKKYEFDWIIPVPPELTTGCVFDRWFENEKETKENDFERDALFKVDEYGFFLYWKSEGRDGDVIELCQVSDIRAGGTPKDPKILDKVTKKNGTNIPELDKRSLTICSNTDYINITYHHVICPDAATAKSWQKNLRLITHNNRATNVCPRVNLMKHWMRLSYCVEKSGKIPVKTLAKTFASGKTEKLVYTCIKDAGLPDDKNATMTKEQFTFDKFYALYHKVCPRNDIEELFTSITKGKQDFISLEQFIQFMNDKQRDPRMNEILYPLYEEKRCTEIINDYELDEEKKKNVQMSLDGFKRYLMSDENAPVFLDRLDFYMEMDQPLAHYYINSSHNTYLSGRQIGGKSSVEMYRQTLLAGCRCVELDCWNGKGEDEEPIVTHGHAYCTEILFKDCIQAIADCAFVSSEYPVILSFENHCNRAQQYKLAKYCDDFFGDLLLKEPLPDHPLDPGLPLPPPCKLKRKILIKNKRMKPEVEKVELELWLKGELKTDDDPEEDASAGKPPEAAAAPAPAPEAAAAAEGAAEGGGGAEAEAAAANYSGSTTNVHPWLSSMVNYAQPIKFQGFDKAIEKNIAHNMSSFAESAGMNYLKQSSIDFVNYNKRQMSRIYPKGTRADSSNYMPQVFWNAGCQMVSLNFQSSDLPMQLNQGKFEYNGGCGYLLKPDFMRRADKDFDPFADAPVDGVIAAQCSVKVIAGQFLSDKKVGTYVEVDMFGLPSDTVKKEFRTRLVANNGLNPVYNEDPFVFRKVVLPDLAVLRFGVYEESGKILGQRILPLDGLQAGYRHVSLRTEANFPMSLPMLFVNIELKIYVPDGFEDFMAMLSDPRGFAGAAKQQNEQMKALGIEEQSGGAARDAGKAKEEEKKEPPLVFEPVTLESLRQEKGFQKVGKKQIKELDTLRKKHAKERTSVQKTQNAAIDKLIKGKSKDDIRNDANIKNSINDQTKQWTDMIARHRKEEWDMLRQHVQDSQDAMKALMLTVQAAQIKQLEDRHARDIKDLNAKQAKMSADTAKEVQNDKTLKTKNEKDRRLREKRQNNVKRFMEEKKQIGVKQGRAMEKLKLAHSKQIEEFSTDVQKLMDMYKIEEEAYKTQGKTEFYA

SEQ ID NO: 18557 - protein, 800 aa, Drosophila melanogaster [sequence omitted]

SEQ ID NO: 18558 - protein, 3218 aa, Drosophila melanogaster
MKNAIHPENCNGAGTEEEASSAFHAEIDRVLLNNNGNHGDSSNEGGGGNGSGRGGATGSGNIAGLGGSESMWSPGGGKSHDVAQAFANALLLRNMNHVVGKGQPVVQNHRKAYQCKGDTINPMANGEDLRLSKIIRRLINENNPTVSLELCSKLDQAVRTPINMGYMTCSFVWILDNMLTLYKQCPPPVLEECSKTLGLIGFINRKSYPIYEEFIVKNYKSSKRMQKYMIMALRATLSCDTKCELHMYADKIMLLLKDFLENAESADIFIVVSNTLVQFAASYAETFECHFTDVVDIVIGWQLEAGQPTDLKTHCAQVLEQLTPFFSKQIDFSYGLLDQFVEDITTLEEGEPANTAERVGAFVGAFNTLLKCLARMQIFVGMPTCECIVKMAVDHLIKIMPTLHLNTEALVNINELICICLLNNFTGLDPILLEQVLLDQVKRMISLTELQRQSVLYLLLCTVRRLRARLTPSLVHFIFQSNPYMTKVRLRSPGETSYKLLLRTCQETLLIRNVPLLQQAYKYLVDDIDACLEKLLITAPRSKARKASVLLVFHLSALAALAKQTSSIIGMYACKPSILELLLTNCRAHELKFWSKYPAAQQAIFGLLVVHCQANHNFRTNSSLLRDQELSAENTSPTANSFASILRFLDSVLGQAHQLAPQNLRVLLQWIQMLLRECREKIDLLMEQENFRGICRNIAATASKLVPLESAACIQTVLDYGLERLEKYPKLLILYRDTALQQLQMLSTNYHAPYFQIYAQLPLHLTLTGGESSMPGMASRRVSVWQQRISQYSAVRDNVFRDFFDRVQKPEQDSLIHCLRELFVRSCQVAPQDERQMNLSQCTKRCQRLAIAWLQFEAARYCVDQRLRTTVGKPQETFLGFEAIIMRHARLLSGCAKEIERSALDDLSLEELLSMQSNLSLLLGFLDALEKLIYNAAEGSAFALRPPEKQVAAFFRLNNPTCQSWFNRIRIGVVIIAMHVQQPELVIRYAQQILVNSKTQDPTYSQAIVYMAWSLVSCQEADSLRGLRLWARGKSCKSYKWLKYAADQAAGKRESALAGYRTILAEKELQSELEPHTRQFVVSQMMQCLQDLGQWSQLVELKQQQMTRPEDRELNPFLQRSNVEVNALERLLAKSEESCSSMDALGGVFQQLSLWPSNWDESVSSSGLSERASFSSIHMRQRTEDIVLHKLLEDRCVPDQAKNLLDTQWRDSLLNPSFDQRSCKELTLLRHIVQGVSGGQELSLLPVSSGRCQNRSKFISSAILMRCLAWTQLLRQHCAPGSWETLCLDAAAAAREEGNLQLAETLLTQFFGQPIGEIAALFSLEQGVQTDNPEMLRGYSELVKCLHLQQQQSQTHSGDLSSSIDVCAALCLNIQKSNNQPAAGADLLLNLADWIAVRTCNGLTTNQSPVLIQLLDQLPECPLTCDSSQPLAIPQAERMVARLVHSCLQQRPNYAEALIAYGNWCYRWGKKVADSCCVLTQADATAISQALDIPQPLESEKLDELLQALSTEQPPANCVEVCPDAARARDDEAAKNRLRRLTFLADKTPEALDAILQIWRRAIANTYDYYKDAARSYFQYLSFKSGSGPEKPEGEGVVSQRERLHVDDSNLVTTTLRLLRLIVKHASGLQEVLEQGLHTTPIAPWKVIIPQLFSRLNHHEPYVRKSVCDLLCRLAKSRPQLVIFPAVVGANREQQDATAPPATARPTTEDACCYGYLLGELSKQAPEAVQHVKLMVKELRRVCLLWDEYWIHSLAHIYNTYVSRVSALATDFRPDDHEGKNNRFNVWRPQLLADLEALVAVTSRPPETTYERSFRKRFDAPIRLTVDALRHRRYPEAWDKLKQLYHILQSNMIRGSGSTLKMQSISPVLCGIGRMRISMPGLDAHGPDGDQVYIESVESSVCVLPTKTKPKKVAFYGSNGQRYTFLFKGMEDLHLDERIMQFLSISNAIMACRSDAPGNGCYRAHHYSVIPLGPQSGLISWVDGVTPVFALYKKWQQRRSQVAGNAGAGAVANVPRRFTDLFYNKLSPLLAKHNMQVSDPRRQWPISVLLQVLDELSQETPNDLLARELWCQAGNAAEWRQSVRRFVRCMSVMSMIGYVIGLGDRHLDNVLINLGSGDIVHIDYNVCFEKGRTLRIPEKVPFRLTQNLVQAMGITGIEGPFRLGCEYVLKVMRKERETLLTLLEAFVYDPLVDWTTNDDAQALRRSLNAKLQESADGGGAGGLGVGDLKYHKKDKNKGKPLDSDVKRQPFLSKLGMLQKYWSTNKTELMPQLEEMEQEVGNLQAAQAKQVVAEEELVKLNQRSALIAEIKSLGTAIESHSFNTASLRNAVRRGHSEALALLSTERLPDFGRVQCILRSYGQCLQLYHLLDLQGQLVKLQMESNSENAREFSALTEALQLSGLDSMRSQLNELLGRMDMVAQKSSKHLQEYAGVMNFYPEQSHRQNLFVRFHDSFATYIQNGYTADSTTNTNSPSSSIICKADVVGVAEAMEYSWERLGCQLHEASKLYAANQAQALTLGAPTTALLSMIVQSGCSQLLLKASLVRTLDRAGGAFAAYEQVALASHDDGLLHHQLLFIHLVRTMLQGVLVMTKEEDQHLAQLESLLSALSHLKKMFEYDLPANLYRLLLLQPNLGKLSALCHLSASSLAQLFLEATMENGHKPPDQFPVERRFLLTLQPVYDQFLLASTSLDSLVSSMQSMLEDVHDVQTQQIMELGLMRSCHTELNDECFFGLVSEALESSRTCDVREMARPMLGFIHRLQVEKLAGLLPILTRNFYTAVGPQCLPTASCGDPAQADHLCESLFISLQSDGALLQQQAEIALLSQQVDLHTLAASAQYWAYSEALGSQLRCGPHIVSRPKLTAAIGECWLELDQKLTALQQLQAGLESQLSQLQTQRSNWNRNHIDNLLRMEQCNKQRTMSHVALLQKMTDGAGAVARLEQNAIVVGEEGQALVDHLEQWLAAHGQWQASSSRISAVEQSMVELLDPEGAIDHYWLENVQGLLEEQTCKVHREIAAIEGEQQSKHRFICTLLKETLRLLENMPRFHVQSLCSEAQAQGQGKMEYANVQLLSDHLREGQGLMQSLYMRLQELRKDICSDRRVLQPSMLQNWRHQLEMILTLAKQEVNEFFKGLEDFMQHAGETDSYEIFTHAKGSGNVHEQKRNAYGVSVWKKIRMKLEGRDPDSNQRSTVAEQVDYVIREACNPENLAVLYEGWTPWV

SEQ ID NO: 18559 - protein, 403 aa, Drosophila melanogaster
MLWTVHLDGGPQRVNHAAVGVGDFIYSFGGYCTGYDYRYNEPIDVHALNAHTMRWTLVPQQLDDAGVPLKYPLVPFQRYGHTVVAYKDRIYIWGGRNDENLCNTLYCFDPKTAQWSRPQVTGCLPGARDGHSACVIGNSMYIFGGFVDEINEFSSDVHSLNLDTMEWRYVQTFGVPPSYRDFHASVAYEQERMYIFGGRGDKHSPYHSQEETYCHEIVYLDMKTKVWHRPFTAGKVPVGRRSHSMFVYNKLIYVFGGYNGLLDQHFNDLYTFDPRTKLWNLIRANGKAPTARRRQCAIVMGTRMFLFGGTSPRSGSSSSPAAVSPTQETGGAAAAGGVVPPGVALIDYSDLHVLDFEPTLKTLATMVVLKHQLDISGLPRSFRSDLQMLTQPNSISRPINQAG

SEQ ID NO: 18560 - protein, 1457 aa, Drosophila melanogaster
MQQQQQPSIDQLPEPTASTSNSATTKPTIATATTSTTTTSGNNFHQQLQATTAATMQRLRTTFTRSRTPTGAEMKMQNSLEVPKQVRSASFDEMQLESQRASSSLLKQQSSSSASADERSSEAGFLQVPLAAHQQRSHSFDSATASAGSDDSGTFLEVPRRLKARRSSSTKTPPPCIHCHYLEEYERRMTAEQRYFIDHRELTALSYSNTSSEASEDEDEVEGHNAEEEEEGSAAIEDAEEETTEAATEEADEDPRTEVESEHDHDPDDDAALEMDIRIGNMSQGSSIEESRARLPRQMRRHTIGSSSVTSASEDEGLEGSDNGSPHFGNTLLPPQPTTPCGITFTLSPTNGDYPSPPHLPLDPGSPPISPCSSNSGRLPALAPIISTPCSSADADDAGAAMGLPVRARRRSISRQEAIFVEPTGNSLENVSHEEVDNSNTKSSVDTADSLDEASTMATCGSPGAAGGSGASSSHHNAFVVRDIYLMVPDLKRDRAASVDSCFSKLSSNAKTEELQPSADGCFLTVPNINATRSRSVDIVLPTDEQARYKALSMTGSTVTYADGRTASASNSRRPIRIVPDWTENAVQGEHYWKPTSASGDLCCLNEECIKSGQRMKCSACQLVAHHNCIPFVNEKSTLACKPTYRDVGIRQYREQTTTHHHWVHRKLEKGKCKQCGKFFPMKQAVQSKLFGSKEIVALACAWCHEIYHNKEACFNQAKIGEECRLGNYAPIIVPPSWIVKLPTKGNFKSSIRVSNKNNAASGSGGGGAGGGAGGGGGKSKKQTQRRQKGKEEKKEPRAFIVKPIPSPEVIPVIVFINPKSGGNQGHKLLGKFQHLLNPRQVFDLTQGGPKMGLDMFRKAPNLRVLACGGDGTVGWVLSVLDQIQPPLQPAPAVGVLPLGTGNDLARALGWGGGYTDEPIGKILREIGMSQCVLMDRWRVKVTPNDDVTDDHVDRSKPNVPLNVINNYFSFGVDAHIALEFHEAREAHPERFNSRLRNKMYYGQMGGKDLILRQYRNLSQWVTLECDGQDFTGKLRDAGCHAVLFLNIPSYGGGTHPWNDSFGASKPSIDDGLMEVVGLTTYQLPMLQAGMHGTCICQCRKARIITKRTIPMQVDGEACRVKPSVIEIELLNKALMLSKRKHGRGDVQVNPLEKMQLHILRVTMQQYEQYHYDKEMLRKLANKLGQIEIESQCDLEHVRNMLNTKFEESISYPKVSQDWCFIDSCTAEHYFRIDRAQEHLHYICDIAIDELYILDHEAATMPQTPDQERSFAAFSQRQAQNERRQMDQAQGRGPGSTDEDLQIGSKPIKVMKWKSPILEQTSDAILLAAQSGDLNMLRALHEQGYSLQSVNKNGQTALHFACKYNHRDIVKYIIASATRRLINMADKELGQTALHIAAEQNRRDICVMLVAAGAHLDTLDSGGNTPMMVAFNKNANEIATYLESKQGTQPVDGWLDD

SEQ ID NO: 18561 - protein, 821 aa, Drosophila melanogaster
MSAATHMAMPAHAVVPPPGTPPVLGGSGCSNLSLPSGKRGHKRSVSLENNAPLALRSTPSMGQSSLGSPLLQFGQAAPGQGHSQGFHTGTLKSRQEQRRLSQKFGSHSNLDDEGVGIGVGMGMGMGLQMRSKFQNIRQMFELSRSCVGGGGGDGRGGAAEEEAMQSLPATLPQQHQQQQQRRTTPIAGGSRHQQQQQMGEAEQTSGNFLRPIAFKPIPFEPDYRIACQQQQQHQQQLQLQQQQQQQQQQQQQQQLQLQHQQQQQHQQQHQHQHQQQHQSLQLPTEGGQAGGVAAERYGYGSTPSLAPLPTASAQKFGSTTDLRHLAARRRNHRLLQRCSNEDALTLDLLSTGSHDRPDGASSKSSGTVVGSSDLTPSPSDSGISELEAALKDRDSELSYLRQAMEHNEKDKEVYWEHETQRLRLFYEGQQRECQLKLRKMEQLLGLQQFQLKQHKLRQSEQVNRLQQQLDLARDSSQGLQQQVDALRHQLEDSEWRVCERNGEIALLKTQLKEAHLEINMKDHAIVSLKHSSNRSSSSSNSNSNKSCDTNTSQSQPKQQAKEEQQQQQHPELQQQQQQQQQQQQQQQQQQQQQQQQQQQQQQQQQQQQQLKQQHQPDQQQLQKIITLKDQVIGALTSELAKLRKELSDLAIAHEYGEEPCGRYTRLKQQLDNLNEICQKTRKYTTTSASPTAVASPAAQVAPPAPSPAAHVATPSCAQELPKLDVLVQRLQLDQGQGTQQTLDTLIEESTTYAEDIAKLRQKLDDFRLNLELEKRQWSAEKDKVLGYQKQLQAHYIQMYQKLRCLDSAGAAVGQVEATSGN

SEQ ID NO: 18562 - protein, 916 aa, Drosophila melanogaster
MANYQTAHAQERRIQELDQTVESIFDVRKRMGKGAYGIVWKATDRRTKNTVALKKVFDAFRDETDAQRTYREVIFLRAFRCHPNIVRLVDIFKASNNLDFYLVFEFMESDLHNVIKRGNVLKDVHKRFVMYQLINAIKFIHSGNVIHRDLKPSNILIDSKCRLKVADFGLARTLSSRRIYDDLEQDGMLTDYVATRWYRAPEILVASRNYTKGIDMWGLGCILGEMIRQKPLFQGTSTVNQIEKIVTSLPNVTKLDIASIGPSFGSVLLSRNIQRDRRYSLDEMMKNCCDDGISLVKALLVLNPHNRLTAKEAIRHPYVSRFQYASAEMDLHMDVVPPLKDHVRYDVDQYRNSLYELIDRETSCSNRTVSNSTPSSNRDELPKPVRVTKQARTTSAKQPTTSPAERKKEPSSVEVTQSRKNIKLLGSAHKAQSKEINHMESAITQVSIASAPPAAAPPAPAATAPAVPRKSGDKSVPKCQHNNAAVQRELAAVAAAAAVARRKKSSWQSQAQSQGKFHTEAKAHVQTAIQTQKDNIKDSPPRMIQESQSLTEAKAPIPKNRYSNKMCQEKKYKKKHHSMSCITRDTFPSETEHRQQREERAYQRQMKRELQLKESYRRRIEAESEPLKETTEQESKTIKVIEQKVCEHTEKKADESLSKDQQKDSITFGTCVRERIHHLELEMEKCTEELVDFVELNADVLNYANVSTHLKKLQRSKESDEKDEDDRRALPEGIGGPGSQNYEIFRQEQEKERQRQVQEFLARDETNEYDNLDLDHAYRAKYYTAYKEIGKELNPAPDSGGRDSGSEHSPGRDNYTTYADYFLKYTTPQQNWNDLERANGLQREHDRIYGLFWLNDRRQEEKYRRKLAQNDQEELPVHHHKACRHRHHKPNHHAPYDHMRPTEDDIQEADSLPESN

SEQ ID NO: 18563 - protein, 537 aa, Drosophila melanogaster
MESTTKVKVNGFVESTSSSAAPAIQTKSTTGFDAELQDGLSCKELFQNGEGLTYNDFLILPGYIDFTAEEVDLSSPLTKSLTLRAPLVSSPMDTVTESEMAIAMALCGGIGIIHHNCTPEYQALEVHKVKKYKHGFMRDPSVMSPTNTVGDVLEARRKNGFTGYPVTENGKLGGKLLGMVTSRDIDFRENQPEVLLADIMTTELVTAPNGINLPTANAILEKSKKGKLPIVNQAGELVAMIARTDLKKARSYPNASKDSNKQLLVGAAIGTRSEDKARLALLVANGVDVIILDSSQGNSVYQVEMIKYIKETYPELQVIGGNVVTRAQAKNLIDAGVDGLRVGMGSGSICITQEVMACGCPQATAVYQVSTYARQFGVPVIADGGIQSIGHIVKAIALGASAVMMGSLLAGTSEAPGEYFFSDGVRLKKYRGMGSLEAMERGDAKGAAMSRYYHNEMDKMKVAQGVSGSIVDKGSVLRYLPYLECGLQHSCQDIGANSINKLRDMIYNGQLRFMKRTHSAQLEGNVHGLFSYEKRLF

SEQ ID NO: 18564 - protein, 312 aa, Drosophila melanogaster
MGNISASITSQSKMGKDFDAVGFVKDFAAGGISAAVSKTAVAPIERVKLLLQVQHISKQISPDKQYKGMVDCFIRIPKEQGFSSFWRGNLANVIRYFPTQALNFAFKDKYKQVFLGGVDKNTQFWRYFAGNLASGGAAGATSLCFVYPLDFARTRLAADTGKGGQREFTGLGNCLTKIFKSDGIVGLYRGFGVSVQGIIIYRAAYFGFYDTARGMLPDPKNTPIYISWAIAQVVTTVAGIVSYPFDTVRRRMMMQSGRKATEVIYKNTLHCWATIAKQEGTGAFFKGAFSNILRGTGGAFVLVLYDEIKKVL

SEQ ID NO: 18565 - protein, 419 aa, Drosophila melanogaster
MAKDEEDDLLPDKDAAKGFYAKYEPKEILGRGISSTVRRCIEKETGKEFAAKIIDLGATTESGETNPYHMLEATRQEISILRQVMGHPYIIDLQDVFESDAFVFLVFELCPKGELFDYLTSVVTLSEKKTRTIMRQIFEGVEYIHAKSIVHRDLKPENILLDENHNVKITDFGFAKQLQEGEKLTNLCGTPGYLAPETLKCNMFEGSPGYSQEVDIWACGVIMFTLLVGCPPFWHRKQMVMLRNIMEGKYSFTSPEWADISEDPKDLIRKCLVVDPSQRITVKEVLRHPFFNQMLFEQNIDGLKRSLSTKSRRMSRITEIALLRKQSRFNARKKFQFAILVIRAIIRIRRLRFTAEPLHVEEAIRDPYRVKVLRKVIDGCAFRVYGHWVKKGEGQNRAALFENTPRTELHALYINNLSR

SEQ ID NO: 18566 - protein, 158 aa, Drosophila melanogaster
MPRYREWDLACKVYVGNLGSSASKYEIENAFSKYGPLRNVWVARNPPGFAFVEFEDRRDAEDATRGLDGTRCCGTRIRVEMSSGRSREGRGGGGGGGGGGGGSGGGGRGGGSGARAGGGGRAGDGGGRYRSRSPRRSRTRSRSFSRDRRSRSDSRDRH

SEQ ID NO: 18567 - protein, 133 aa, Drosophila melanogaster
MGLEYFSEILDVILKPVIDSSSGLLYGDEKKWYGMIHARYIRSERGLIAMHRKYMRGDFGSCPNISCDRQNTLPVGVSAVWGKSTVKIHCPRCKSNFHPKSDTQLDGAMFGPSFPDIFFSMLPNLTSPLDDPR

SEQ ID NO: 18568 - protein, 1962 aa, Drosophila melanogaster
MSSSQNNNSSWIDWFLGIKGNQFLCRVPTDYVQDTFNQMGLEYFSEILDVILKPVIDSSSGLLYGDEKKWYGMIHARYIRSERGLIAMHRKYLRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYMRGDFGSCPNISCDRQNTLPVGLSAVWGKSTVKIHCPRCKSNFHPKSDTQLDGAMFGPSFPDIFFSLLPNLTSPLDDPRQNNNSSWIDWFLGIKGNQFLCRVPTDYVQDTFNQMGLEYFSEILDVILKPVIDSSSGLLYGDEKKWYGMIHARYIRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYMRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYLRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYMRGDFGSCPNISCDRQNTLPVGLSAVWGKSTVKIHCPRCKSNFHPKSDTQLDGAMFGPSFPDIFFSMLPNLTSPLDDPRELATCRAPRTTTAAGSIGSSGSRATSSSCRVPTDYVQDTFNQMGLEYFSEILDVILKPVIDSSSGLLYGDEKKWYGMIHARYIRSERGLIAMHRKYMRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYLRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDEKKWYGMIHARYIRSERGLIAMHRKYLRGDFGSCPNISCDRQNTLPVGLSAVWGKSTVKIHCPRCKSNFHPKSDTQLDGAMFGPSFPDIFFSMLPNLTSPLDDPRQNNNSSWIDWFLGIKGNQFLCRVPTDYVQDTFNQMGLEYFSEILDVILKPVIDSSSGLLYGDGKKWYGMIHARYIRSERGLIAMHRKYMRGDFGSCPNISCDRQNTLPVGLSAVWGKSTVKIHCPRCKSNFYPKSDTQLDGAMFGPSFPDIFFSLLPNLTSPLDDPRQNNNSSWIDWFLGIKGNQFLCRVPTDYVQDTFNQMGLEYFSEILDVILKPVIDSSSGLLYGDEKKWYGMIHARYIRAERGLIAMHRKYMRGDFGSCPNISCDRQNTLPVGLSAVWGKSTVKIHCPRCKSNFHPKSDTQLDGAMFGPSFPDIFFSLLPNLTSPLDDPR

SEQ ID NO: 18569 - protein, 432 aa, Drosophila melanogaster
MSKPSYKVADISLAEWGRKAIIIAENEMPGLMACRKKYGPSKPLKGARITGCLHMTVQTAVLIETLVELGAQVQWSSCNIFSTQDNAAAAIAATGVPVYAWKGETDEEYMWCIEQTLVFPDGQPLNMILDDGGDLTNLVHEKFPQYLKNIKGLSEETTTGVHNLYKMFKEGRLGVPAINVNDSVTKSKFDNLYGCRESLIDGIKRATDVMIAGKVCCVAGYGDVGKGCAQALKGFGGRVIVTEVDPINALQAAMEGYEVTTMEEASKEASIFVTTTGCRDIITSVHLQQMPDDAIVCNIGHFDIEIDVDWLNANAKEKVNVKPQVDRYTMQSGKHIILLAEGRLVNLGCAHGHPSFVMSNSFTNQVLAQIELWTKSDKYAVGVHVLPKILDEEVASLHLEKLGVKLTKLTEKQATYLGVSQTGPFKPDHYRY

SEQ ID NO: 18570 - protein, 160 aa, Drosophila melanogaster
MEIRIKCREMLATALKSGNMPPGCGDPDDMAAKLEDAIYGDLNGCKVKYKNRIRSRLANLRDPKNPELRQKFLLGQITPEELSKMTPEEMASDDMKQMRQKYVQDSINAAQMAKVQGTKTDQFKCERCDKRNCSQLHIRDGDEPIITFVICDECGNRWKS

SEQ ID NO: 18571 - protein, 224 aa, Drosophila melanogaster
MEEPKSVSTAELPSTSTGASSSSSTLSNNVSYDKIAWTRDITEPLAEESSTSQLRPLGTSIPTNSTASELKKSNTSYSFTGDYLSGGNKADLKGGYPFGGTDTDTKANEKDKEKEHTADDSLYECNICLDTAKDAVVSMCGHLFCWPCLHQWLLTRPNRKLCPVCKAAVDKDKVIPLYGRNITKFHHAPLDNVQNQILFPGSLDSDSATDFTCLSVLELFLSGS

SEQ ID NO: 18572 - protein, 307 aa, Drosophila melanogaster
MTRHARNCTAGAVYTYNEKKRDAAESGYGTNAQRLGKDSVKSFDCCSLTLQPCRRPVITKDGYLFDKEAILQYIVTKKNEYSRRLKEYERLRRAEEDKLSQEANSKQQARMERFVNAEKPAMTPAHSSAAASEKPSTSSAAAAASSESSSASSISNMTNGHEKKLPSFWLPSECPNAGLAKAQKPDATIYCPVSQKPLRVKDLIDVKFTLLKDGDTKRSLIAKEARYMCPITHDVLSNAVPCAVLRPTGDVVTMECVERLIRKDMIHPLTDRKLKEKDIIPLQRGGTGYATTNDHLQAKEKRPMLQA

SEQ ID NO: 18573 - protein, 242 aa, Drosophila melanogaster
MWTDLAGKVILVTGAGAGIGQALVKQLASAGATVIAVARKPEQLQQLVAFDPVHIQPLQLDLSGWQAVREGLAKVPLLDGLVNNAGVAIIKPFEELTEQDFDTHFDVNIKAVFNVTQSLLPRLKDGASIVNVSSIASSRSFGGHTAYSATKAALDSLTKSLALELGPRKIRVNSVNPTVVLTKMGADNWSDPAKSGPLLAHIPLNRFCEVQEVVDATGYLLSSKSSFVNGHHILLEGGYSVS

SEQ ID NO: 18574 - protein, 158 aa, Drosophila melanogaster
MDAPTIKLESSDGVIFSTEVKAAKLSETIKTMLEVSAVENDENAVVPLPKVNAFILNKILTWAYHHKDDDDQAAEGEELTPQSPHDISPWDANFINVDQPILFEITVAANYLEIKGLEDLCCKTLANMIRGKTPEEIRQTFNIEDDLPIDTAELGEDL

SEQ ID NO: 18575 - protein, 167 aa, Drosophila melanogaster
MVTPTIKLESSEGVIFPTEVRVAMVSETIKTMLDHFAVQNDENAIVPLHSVSTFTLGKILAWANHHKDDDDQSTEGEELKPRRPYAISPWDAIFLMVNSTTLLEIILAAKQLQIKGLLELTYNVVANMIRGKTPEEIRFIFNIPEDVSPSVDGELRWKDLFLWPMDF

SEQ ID NO: 18576 - protein, 264 aa, Drosophila melanogaster
MGSKGKAGLDFSGKVVLITGAASGIGAAAAEMFSKLGACLALVDREEEGLICVMKRCMKMGHEPYGIAGDLLKPPEIECIARKTTERYEGKLDVLVNGAGIMPTGTLQSTELACFTHVMEANVRSGFYLTKLLLPQLLQCKGSIVNVSSVCGLRAFPNLVAYNMSKAAVDQFTRSLALDLGPQGVRVNAVNPGVIRTNLQKAGGMDEQSYAEFLEHSKKTHALGRIGEPKEVAAAICFLASELASFVTGVTLPVDGGKQVMCPR

SEQ ID NO: 18577 - protein, 256 aa, Drosophila melanogaster
MNFAGKVVLITGASSGIGAATAIKFAKYGACLALNGRNVENLKKVAAECSKVSQSQPALVVGDIAKEADTQRIWSETLQQYGKLDVLVNNAGIIETGTIETTSLEQYDRVMNTNLRAIYHLTMLATPELVKTKGNIVNVSSVNGIRSFPGVLAYNISKMGVDQFTRCVALELAAKGVRVNCVNPGVTVTNLHARGGMDAETYKKFLEHSKTTHALGRPGDVKEVAAAIAFLASDEASFSTGVSLPVDGGRHAMCPR

SEQ ID NO: 18578 - protein, 211 aa, Drosophila melanogaster
MRFAPSLSLKSTRGVHQSDTEVSKIMRSLDVIPDVIHIGPQEFLNVTYHGHLAAHCGKVLEPMQVRDEPSVKWPSAPENYYALLMVDPDVPNAITPTHREFLHWMVLNIPGNLLALGDVRVGYMGATPLKGTGTHRFVFLLYKQRDYTKFDFPKLPKHSVKGRSGFETKRFAKKYRFGHPVAGNFFTSQWSPDVPSLIKAISHNARQVAHF

SEQ ID NO: 18579 - protein, 187 aa, Drosophila melanogaster
MSDSTVCFSKHKIVPDILKTCPATLLTVTYGGGQVVDVGGELTPTQVQSQPKVKWDADPNAFYTLLLTDPDAPSRKEPKFREWHHWLVVNIPGNQVENGVVLTEYVGAGPPQGTGLHRYVFLVFKQPQKLTCNEPKIPKTSGDKRANFSTSKFMSKYKLGDPIAGNFFQAQWDDYVPKLYKQLSGKK

SEQ ID NO: 18580 - protein, 536 aa, Drosophila melanogaster
MSKRSCQILTLLGLCLVCHEATLVGGHVLVYRKATSQLIEEFNDLPAQFGPNLPSNGLKVYVVPARRPYYGCDSLDRPPHLKYPPSAKFVALVARGECVFERKIRVAQNASYSAVIVYNNEGDDLEQMSAENITGIRIPSVFVGHTTGKALATYFTTEVVLIINDELPFNINTQLILPFSILIGMCFIIMVIYMIYKCIREQRRLRRHRLPKSMLKKLPVLRYTKNNANNKYDTCVICLEDFIEDDKLRVLPCSHPYHTHCIDPWLTENRRVCPICKRKVFTKGEARASRSRQPSLDNVTDTDDDTTPLLQQQQSNGRQVGQVSSASSAGGAAGSSSSVAAAAVAGTTRHGTFRRGHAGRNPFEESQSSDDENALLASTVRPATSSGAHERINPFDRAPNLPAHLAEQLTESRRSVWSRINFASFFRRQPAVISVAAPPYLERVESGTSAMGLPVTGTIAVASPASNNILNPNLSGSFKDEDDMPPHRSIYEPIAISTPAADSATVDDSAFLQTPTQGGIGVAALPHSASDRQFLI

SEQ ID NO: 18581 - protein, 329 aa, Drosophila melanogaster
MVNTKFLTFNNGEKMPVIGIGTWQASDEEIETAIDAALEAGYRHIDTAPVYGNEKAIGRVLKRWLDAGKVKREELFIVTKVPPVSNRPHEVEPTIKKSLEDLQLDYVDLYLVHTPFTININEDGSFKLDKEGLMEVDVTTNHAAIWVAMEALVEKGLTKSIGVSNFSKDQVARLLKNCKIRPANNQIEHHVYLQQRDLVDFCKSENITVTAYSPLGSKGIAKFNAGAGIVRDLPDLMDIPEVKEIAASHGKTPAQVLLRWIIDTGVSAIPKSTNPARLKQNLDVFDFELTAEEVAKLSSLDQNIRICDFAFFHGVERHPEFTFKNQYTN

SEQ ID NO: 18582 - protein, 580 aa, Drosophila melanogaster
MSVLFFQQLRLNLKHPRDPSSDRFILSKGHAAPILYAAWAEAGLFPIADLNNLRKIDSDLEGHPTPRLNFIDVGTGSLGQGVAVGAGMAYVGKNFDKADYRTYVVVGDGESAEGSIWESLHFAGHYKLDNLCVIFDVNRLGQSEATSLQHKLDVYRDRLEAFGFNAVVVDGHDVEELSKAFHCAAITKNKPTAIIAKTFKGRDFPNIEDLDNWHGKPLGDKAAEVVKHLEGLIVNKNVKLTPKPVPKTGAAPDVDINNIKLSSPPAYKLGDSIATRLAYGTALAKIGQNNLRVVALDGDTKNSTFSDKLKNLDPQRYIECFIAEQNLVGVAVGAACRRRTVAFVSTFATFFTRAFDQIRMGAISQTNVNFVGSHCGCSIGEDGPSQMGLEDIAMFRTIPGSTIFYPSDAVSTERAVELAANTKGVCFIRTSRPNTCVIYDNEEPFTIGRGKVVRQKSSDEVLLIGAGITLYECLAAADQLEKNCITVRVIDPFTVKPLDAELIIEHGKQCGGRVVVVEDHYQQGGLGEAVLSALAGERNFVVKHLYVPTVPRSGPPSVLIDMFGISARHVVNAVNEILKD

SEQ ID NO: 18583 - protein, 151 aa, Drosophila melanogaster
MSATPPTTPAPTAAASAGKGLHSRAYNGLIKACDKYVPPKMRPLWMHPAGPKTIFFWAPIVKWSLVIAGLSDLTRPADKISPNGCLALGATNLIWTRYSLVIIPKNYSLFAVNLFVSLTQLFQLGRYYNYQWEQSRLEKNGEQCPAIEASL

SEQ ID NO: 18584 - protein, 154 aa, Drosophila melanogaster
MSSTAVQPPPPVPPPPPSAVPSAGKGIHSKLYNGMIGAADKFVPAKLRPLWMHPAGPKTIFFWAPVFKWGLVAAGLSDLARPADTISVSGCAALAATGIIWSRYSLVIIPKNYSLFAVNLFVGITQVVQLARAYHYHQSQEKLKQEQQQPAVQN

SEQ ID NO: 18585 - protein, 557 aa, Drosophila melanogaster
MFRATEIGSEETLPALAELSQVGYERDARDVEWVAWRGERAQLKLAHRSSLPNYGFAPPTIRMKYRYPRAVFFVLATKFFEAFAANGIRTVLALYLRDDLNFTESFSTVVLHIFNFFGQFCPIIGAILADSYIGNVRTISGFSFIYAFGWLLLTLTSLPAMGLPMVLLVSIALLFIAVGNGSIRACITSLGALQFKLPEQSVHLAEYFSFYYFVYYFGIFLSKILPPLVRANTQCFDKAECYPAVFGTLGAAFMMAWFIFLVGKWFYKSEKLSDDNILFKFCGCIKTALVEKWRRRKSTKRSNYWLHNAVVAYDMGFVNDVSRVLRISKLFIPLPFYFALLAQQDSSWTFQATQMNTTLMGVTIQPDQAKAVGPIFLFMLIPLWQYITVPLLRRYFNWELQPLHSVTVGGIFSAGAFFCAGALQERIKNSPPQTVNIAWQLPQFLLLMMGELLLSIPGLQFAFTQAPTSMKSVVTAAWFLNNAFGNLIVVLVTELGMLSSQMAEYFFYAVVMLVCIILYALLAFDYTLQERKAGMYVRMDSEAEDRDVPSTSRSGSI

SEQ ID NO: 18586 - protein, 530 aa, Drosophila melanogaster
MSSLRPEEARKLATAASVSPLSNCQFCGVVISSIADEQKLEFTNKYKGSCTLLCSYDSQGVVLRVVSDDDRSHVLKEYMIAADTDAAQMGRRSYAVSLDADNLVLRFASEQDQQLFRKVVENVKHLRPKSVFSQRTEESSASQYFQFYGYLSQQQNMMQDYVRTSTYQRAILGNAVDFQDKIVLDVGAGSGILSFFAVQAGAAKVYAIEASNMAQYAQQLVESNNVQHKISVIPGKIEEIELPEKVDVIISEPMGYMLYNERMLETYLHARKWLKPQGKMYPTHGDLHIAPFSDESLYSEQYNKANFWYQSAFHGVDLTTLHKEGMKEYFRQPIVDTFDIRICMAKSVRHVCDFLNDKEDDLHLISIPLEFHILQTGICHGLAFWFDVEFSGSSQNVWLSTSPTAPLTHWYQVRCLLPMPIFIKQGQTLTGRVLLEANRRQSYDVTIDLHIEGTLISSSNTLDLKNPYFRYTGAPVQAPPGTSTQSPSEQYWTQVDTQGSRNSSSMLNGGISVNGIGEGMDITHGLMHPH

SEQ ID NO: 18587 - protein, 220 aa, Drosophila melanogaster
MSNQETQVSSLPMPPERYIANYTDENIRRNRAPRPPPPPAQHEVYSMFGIQYNNDEMIRSLESQNIKRLIPIHFDRRKELKKLNHSLLVNFLDLIDFLILNPDSPRRTEKIDDISLLFVNMHHLLNEFRPHQARETLRVMMEMQKRQRVETAARFQKHLERVREIVNTAFSALPVLDDDDDSGGAKIKTEVDPLEANAAAKNDPSYQHDRMLCKLVDAIE

SEQ ID NO: 18588 - protein, 135 aa, Drosophila melanogaster
MPRYREWDLACKVYVGNLGSSASKHEIEGAFAKYGPLRNVWVARNPPGFAFVEFEDRRDAEDATRALDGTRCCGTRIRVEMSSGRSRDRRRGEGGSSGRSGSGRYRSRSPRRSRSPRSRSFSRDRRSRSDSRDRH

SEQ ID NO: 18589 - protein, 144 aa, Drosophila melanogaster
MPRYREWDLACKVYVGNLGSSASKHEIEGAFAKYGPLRNVWVARNPPGFAFVEFEDRRDAEDATRALDGTRCCGTRIRVEMSSGRSRDRRRGEGGSSGRSGSGRYRITPSARTTSTATSSFYNINNLQQQPSSQPQPATFNLQL

SEQ ID NO: 18590 - protein, 106 aa, Drosophila melanogaster
MPRYREWDLACKVYVGNLGSSASKHEIEGAFAKYGPLRNVWVARNPPGFAFVEFEDRRDAEDATRALDGTRCCGTRIRVEMSSGRSRDRRRGEGGSSGRSGSGRYR

SEQ ID NO: 18591 - protein, 486 aa, Drosophila melanogaster
MSNKTCCRGPGYATPLDAMRSGPREKLLYTVTVQPNLDEPHGDYLSTVDVDPESPTYCQIVHRTFTNRKGDELHHSGWNACSSCYYVDESSKTVPKRDRLVLPSLNSDFIYILDVVTDPRKPEIVKTIDGDVLKSHNVTAPHTTHCLANGNIMISVMGDAEGYAKGDFILFDSDFNCIGTWTKGDKKALCGYDFWYQPYFDVMVSSEWGAPNKWRRGWKNVDLEDMSQYGCRLNFYKWSTQTLYQTIDLGSDGITPLEIRFLHNPKKAEGFVGCALNAKVFHFKKKSDSDEFEAKKVIDIPGKLVDTGSGVAEDMGGMISDIIISLDDRFLYVNCWRHGDVRQYDITDPENPKLTGQLFLGGAICSDLPNVIVKEDKELKERPPARYVKGRRLEGGPQMLQLSLDGKRLYVSSSLYSPWDKQFYPKMVSQGGHIVLIDVDTVNGGISLNEDFLVDFANEPYGPSLPHEMRYPGGDCTSDIWLANDA

SEQ ID NO: 18592 - protein, 313 aa, Drosophila melanogaster
MDLEKNLLREMADSMLNDVISTRAYEWVFKRYERLFKDKIVLDVGCRSGLLSLMSVEAGAVKVMALGNRESAEFVSKAFIGTEKEDIFEFIDGDIHEIVLPCGLKKVDIIVSEWVGHSVFVDSLFKEVIFAREKWLVKGGFIIPNVAQLFVCGIADHPRKTVEVNILPQSDYPGRSYMVREPVSLIEDYVAKEQLITEKYLLKTIDLCTAHINDESFRVPFKLRGLRDSQLGAVVLYSDIGLCRPRGKFRLMFSTGPKRPRTYVRQTILFMDNPVEVAKCELVIGELGMYYKPDEHREVEYSFSLGSSTVANP

SEQ ID NO: 18593 - protein, 341 aa, Drosophila melanogaster
MSFNANQKLPFLEGKDSDYFQSYSRLETHMNMLRDSVRMQAFRDAIVQDGGLFQDKIVLDVGCGTGILSLFAAEAGASKVIAVECTDIADIAEEIIRDNQKENVVKVVKGLVEQVELPDGIEKVDIIVSEWMGNALYMEAMINSVLFARDKWLTRGGRILPSTGNLWLMGAYDPHRRTNLNFWCNVEGIDMGCVRKPFSQEPLVEFVPIQQLLTDECFIHSTNLAVARNQPVEFQSNFQLKVMRTGIINMLVLYFDVLFPSGKSNKSVSLTTSPHSPWTHWEQTVLHLDEPLYVRIRDRVRGVLAMTPTGQDGRGMNFDLHISFRGERTRVESFKSFSSPR

SEQ ID NO: 18594 - protein, 474 aa, Drosophila melanogaster
MDEGDELTTCLFCTETSANISVAIDHLDARHKVNLSQLQRKFEMDQYSFIKLINYIRAKKISAEQLLSAEHPLWQDEKYLQPGEYEPWLCYDYEVLKTDGAPTQPSVLELQQRIAEQSQLLQQANEDMERMRNDYKALLQKVHADGEPKGSDQSVPRNNVCLDNEYFKSYAHFGIHHEMLSDKVRTSTYRASLLQNEAVVRGKTVLDVGCGTGILSIFASKAGAARVVGIDNSDIVYTAMDIIRKNKVENVELIKGRLEDTDLPETKYDIIISEWMGYFLLYESMLDSIIYARENHLNPNGIILPSRCTLSLLGYGDDTLYADEVEFWSNVYEVDMSDLRKQSIEEPLMQVVDAEFMLTEPEQIANFDIMTVDMNYPNFTHQFSLKVTKPGRLSAFVGYFETLFELPSPVMFSTSPSATPTHWKQTVFFIENPQVVKEGDVICGKITSRRHKEDVRGLSVDIEVFGKKHKYNVV

SEQ ID NO: 18595 - protein, 262 aa, Drosophila melanogaster
MTERENNVYKAKLAEQAERYDEMVEAMKKVASMDVELTVEERNLLSVAYKNVIGARRASWRIITSIEQKEENKGAEEKLEMIKTYRGQVEKELRDICSDILNVLEKHLIPCATSGESKVFYYKMKGDYHRYLAEFATGSDRKDAAENSLIAYKAASDIAMNDLPPTHPIRLGLALNFSVFYYEILNSPDRACRLAKAAFDDAIAELDTLSEESYKDSTLIMQLLRDNLTLWTSDMQAEEVDPNAGDGEPKEQIQDVEDQDVS

SEQ ID NO: 18596 - protein, 261 aa, Drosophila melanogaster
MTERENNVYKAKLAEQAERYDEMVEAMKKVASMDVELTVEERNLLSVAYKNVIGARRASWRIITSIEQKEENKGAEEKLEMIKTYRGQVEKELRDICSDILNVLEKHLIPCATSGESKVFYYKMKGDYHRYLAEFATGSDRKDAAENSLIAYKAASDIAMNDLPPTHPIRLGLALNFSVFYYEILNSPDRACRLAKAAFDDAIAELDTLSEESYKDSTLIMQLLRDNLTLWTSDMQAEVDPNAGDGEPKEQIQDVEDQDVS

SEQ ID NO: 18597 - protein, 260 aa, Drosophila melanogaster
MTERENNVYKAKLAEQAERYDEMVEAMKKVASMDVELTVEERNLLSVAYKNVIGARRASWRIITSIEQKEENKGAEEKLEMIKTYRGQVEKELRDICSDILNVLEKHLIPCATSGESKVFYYKMKGDYHRYLAEFATGSDRKDAAENSLIAYKAASDIAMNDLPPTHPIRLGLALNFSVFYYEILNSPDRACRLAKAAFDDAIAELDTLSEESYKDSTLIMQLLRDNLTLWTSDMQAEDPNAGDGEPKEQIQDVEDQDVS

SEQ ID NO: 18598 - protein, 256 aa, Drosophila melanogaster
MTERENNVYKAKLAEQAERYDEMVEAMKKVASMDVELTVEERNLLSVAYKNVIGARRASWRIITSIEQKEENKGAEEKLEMIKTYRGQVEKELRDICSDILNVLEKHLIPCATSGESKVFYYKMKGDYHRYLAEFATGSDRKDAAENSLIAYKAASDIAMNDLPPTHPIRLGLALNFSVFYYEILNSPDRACRLAKAAFDDAIAELDTLSEESYKDSTLIMQLLRDNLTLWTSDMQAEGDGEPKEQIQDVEDQDVS

SEQ ID NO: 18599 - protein, 147 aa, Drosophila melanogaster
MSDYFEELGHEPTGPLGANDLARNLKRLQVLAIMNGIDMEIEVPEASKRAILELPVHEIVKSDEGGDLECSVCKEPAEEGQKYRILPCKHEFHEECILLWLKKTNSCPLCRYELETDDPVYEELRRFRQDEANRRERENTLLDSMFG

SEQ ID NO: 18600 - protein, 1571 aa, Drosophila melanogaster
MSNRRRVRTIDYLALQQSLRLQKTPAATTNAEEQVAREEENGNGHHSTVTAETPPTPPIPPIPPIRLRREQSVEEDVARVEYRVKQTPSRPVQMTRNRIGALEEDMPPEDELAAHYEAFGTTPPRTRLKIKNRDWERKQKVVNVTASADLPASVGGTPKKTRTARSRVLRRNTMDCALLNEMFVNDESKRTDKRLQSLLRDSEREMKNSLATTAVAAPRGNSFHETAHPLESLDQIMPLNSEAMAPIPLRIASKVVESCNRYRCVSSRPIGYRSSAPPLAFAAQLPAGMLRSDGRATPGLGKRKDFHETFANLIKLGSVDRQDAKLSQEEHTWQTELKDLIWLELQAWQADRTVEQQDKYLFEARQGVSDLLTHIINYKFQPRYRREPSLISLDSGTHSDSNSNASSPLPSKMCQGCMSLYCKDCMDHQELALREVEGMLTRLEAAEALYPSSQAMGALHPIYKSQSFVGRIKSMCLWYNITKQNKLKLSILGKILARLQDEKFSWPVCTSSYIATDSGSSSASGVENDDSAVNSMDSSKPPSMAGSASRKGVTPCHKVQFMLNDATHVPGETSSSNESTSTEVSQWSSECSHSHMRKGSMHDINIFSVEPLGTCSSNGTGEQSTGLYRKFIENVLKSRGLAKSLAFLHKLHNVALYKAHIALEKPGAEDFDYESDAESIEEDVPRLDPEISREQVVELRTYGYWSEEAQSINLPSYIPTFVFLSGIPLQFMHEFLRMRLETRPVRPNPLSLEQLMKELREGLTLALTHRERYQRHITTALVENEAELGSYISILNHYDATVRKTFELYLEYIDQLVLVAVPEGNQKSVLEKEWMFTKLISPMIKGMHTLASQKFCGIISKLLRSISERLVKRTVELDQQIDGTADTDDNEEVKWQLLTICRETQSLLTVERERSIKVLFFAKTFCRDVETTDFHREHYEHDVANQQHDFICSDVKAAFKLLQQDVLQVRNKLTAIIEGVQKRCCLSNMRDLDEQDKQAVLSRTREILHQGYKFGFEYHKDVIRLFEQKIMDQKDSGAHTVDLALGIIAYAKMWMHFVMERCERGRGMRPRWASQGLEFLILACDPQITQHLDDDEFEALKQQMDRCISHVIGITSEPEKVAKKKASPRTRKTSSPATSRSRTPTRTPMSAGMVLNPNTPPLQSPPYNKLLHPQFSLKEDVSGTSYSPVDSSDYVDTPCQRSANGELRLLVPQTPPTPASPGKSSLESTPLALRQERVRDAVNRLDMDLEDGLRERRLIGQVKSLNSSDKVHIRARSVHFRWHRGIKIGQGRFGKVYTAVNNNTGELMAMKEIAIQPGETRALKNVAEELKILEGIKHKNLVRYYGIEVHREELLIFMELCSEGTLESLVELTGNLPEALTRRFTAQLLSGVSELHKHGIVHRDIKTANIFLVDGSNSLKLGDFGSAVKIQAHTTVPGELQGYVGTQAYMAPEVFTKTNSDGHGRAADIWSVGCVVVEMASGKRPWAQFDSNFQIMFKVGMGEKPQAPESLSQEGHDFIDHCLQHDPKRRLTAVELLEHNFCKYGRDECSSEQLQMQVRGSFRRNVATSSS

SEQ ID NO: 18601 - protein, 1612 aa, Drosophila melanogaster
MSNRRRVRTIDYLALQQSLRLQKTPAATTNAEEQVAREEENGNGHHSTVTAETPPTPPIPPIPPIRLRREQSVEEDVASKDSIDPRRESAVAYRGSVIQPPGQSSHLIAQEEVCKMRRKKVEYRVKQTPSRPVQMTRNRIGALEEDMPPEDELAAHYEAFGTTPPRTRLKIKNRDWERKQKVVNVTASADLPASVGGTPKKTRTARSRVLRRNTMDCALLNEMFVNDESKRTDKRLQSLLRDSEREMKNSLATTAVAAPRGNSFHETAHPLESLDQIMPLNSEAMAPIPLRIASKVVESCNRYRCVSSRPIGYRSSAPPLAFAAQLPAGMLRSDGRATPGLGKRKDFHETFANLIKLGSVDRQDAKLSQEEHTWQTELKDLIWLELQAWQADRTVEQQDKYLFEARQGVSDLLTHIINYKFQPRYRREPSLISLDSGTHSDSNSNASSPLPSKMCQGCMSLYCKDCMDHQELALREVEGMLTRLEAAEALYPSSQAMGALHPIYKSQSFVGRIKSMCLWYNITKQNKLKLSILGKILARLQDEKFSWPVCTSSYIATDSGSSSASGVENDDSAVNSMDSSKPPSMAGSASRKGVTPCHKVQFMLNDATHVPGETSSSNESTSTEVSQWSSECSHSHMRKGSMHDINIFSVEPLGTCSSNGTGEQSTGLYRKFIENVLKSRGLAKSLAFLHKLHNVALYKAHIALEKPGAEDFDYESDAESIEEDVPRLDPEISREQVVELRTYGYWSEEAQSINLPSYIPTFVFLSGIPLQFMHEFLRMRLETRPVRPNPLSLEQLMKELREGLTLALTHRERYQRHITTALVENEAELGSYISILNHYDATVRKTFELYLEYIDQLVLVAVPEGNQKSVLEKEWMFTKLISPMIKGMHTLASQKFCGIISKLLRSISERLVKRTVELDQQIDGTADTDDNEEVKWQLLTICRETQSLLTVERERSIKVLFFAKTFCRDVETTDFHREHYEHDVANQQHDFICSDVKAAFKLLQQDVLQVRNKLTAIIEGVQKRCCLSNMRDLDEQDKQAVLSRTREILHQGYKFGFEYHKDVIRLFEQKIMDQKDSGAHTVDLALGIIAYAKMWMHFVMERCERGRGMRPRWASQGLEFLILACDPQITQHLDDDEFEALKQQMDRCISHVIGITSEPEKVAKKKASPRTRKTSSPATSRSRTPTRTPMSAGMVLNPNTPPLQSPPYNKLLHPQFSLKEDVSGTSYSPVDSSDYVDTPCQRSANGELRLLVPQTPPTPASPGKSSLESTPLALRQERVRDAVNRLDMDLEDGLRERRLIGQVKSLNSSDKVHIRARSVHFRWHRGIKIGQGRFGKVYTAVNNNTGELMAMKEIAIQPGETRALKNVAEELKILEGIKHKNLVRYYGIEVHREELLIFMELCSEGTLESLVELTGNLPEALTRRFTAQLLSGVSELHKHGIVHRDIKTANIFLVDGSNSLKLGDFGSAVKIQAHTTVPGELQGYVGTQAYMAPEVFTKTNSDGHGRAADIWSVGCVVVEMASGKRPWAQFDSNFQIMFKVGMGEKPQAPESLSQEGHDFIDHCLQHDPKRRLTAVELLEHNFCKYGRDECSSEQLQMQVRGSFRRNVATSSS

SEQ ID NO: 18602 - protein, 314 aa, Drosophila melanogaster
MTTILDNFQRAEKIGEGTYGIVYKARSNSTGQDVALKKIRLEGETEGVPSTAIREISLLKNLKHPNVVQLFDVVISGNNLYMIFEYLNMDLKKLMDKKKDVFTPQLIKSYMHQILDAVGFCHTNRILHRDLKPQNLLVDTAGKIKLADFGLARAFNVPMRAYTHEVVTLWYRAPEILLGTKFYSTGVDIWSLGCIFSEMIMRRSLFPGDSEIDQLYRIFRTLSTPDETNWPGVTQLPDFKTKFPRWEGTNMPQPITEHEAHELIMSMLCYDPNLRISAKDALQHAYFRNVQHVDHVALPVDPNAGSASRLTRLV

SEQ ID NO: 18603 - protein, 747 aa, Drosophila melanogaster
MGRRKREDSSDEEGDDCRQKRTAETTVKTVEQLMRELSFPGHTPLELKLGNLGYLLGKGMSVDLKENLINELVICLGYYPGQASAYATLVGLINVADFEFGSECLLFMAHKVGESVHIRDWNRCRGVVHCMVDLYHCQVLPSSYILKLLAAFLKDCEALKDPDDLVGVTPQIRRDFLAYCVLSAMPLIGRDLEGETAFDKLIVSLQIYIKKRSALHTNMLSVWPDFNQRDYLELLWQQVDGMRQNHWAEPEHQLIPRPYKSFSETLSHGRIHQLRDYDLAAHEERCRYPLPRVCFRIFSCDSVGEIPNMPPPVSIERHLLEAHILDILISFHKERKICADSLLMYAASKPQLPVYYCIVEVILGEMLRLPTANWSTIAYGSILVELCKRQPDKIPQVVAQALDIIYNRLNSMSVACFDRLVNWVSHHISNFGFNCQWSKWAQGLPSPIDPSATNLQPKVVFLRELLKKCFRIKDVVPDILADFLPPPVLPHFKFVDETLPGAILSKDLLEAMRSPQASPEMISEIIKSSTGIGPLLKINVFTQNCLHLGSKSFSHTFGILRKYHSVFKDLVAGDPERQAAVLNGIFDVWVASDQYKFVVTEKLVTGLIIEPISVVRWIFGPSMRKELTKIYIWELLHSALRHLKRVQQKIEVVDVDDPSACDPVVKGILFTIVQRFVKTLCGAPFADEGTEEHYWFQWVLGRLEETLFIYADDFRVINNKLIKMSEDASDLRPEISKTIAAFVACVM

SEQ ID NO: 18604 - protein, 176 aa, Drosophila melanogaster
MDTAGIIPDIIDVKPASKATITYPSGVQVELGKELTPTQVKDQPTVVFDAEPNSLYTILLVDPDAPSREDPKFRELLHWLVINIPGNKVSEGQTIAEYIGAGPREGTGLHRYVFLVFKQNDKITTEKFVSKTSRTGRINVKARDYIQKYSFGGPVAGNFFQAQYDDYVKTLIETVQ

SEQ ID NO: 18605 - protein, 1564 aa, Drosophila melanogaster
MADGGHSFVKKTFHKPTYCHHCSDLLWGLIQQGYICEVCNFIIHERCVSSVVTPCSGIAPCIIKNPVAHCWSEPTHHKRKFCTVCRKRLDETPAVHCLVCEYFAHIECQDFAVPDCTENATYVPGKELLNVKHQHHWREGNLPSTSKCAYCKKTCWSSECLTGYRCEWCGMTTHAGCRMYLPTECNFGILQPIYLPPHSVSIPRTEVPIEAIIGVQVKSKTSLVRDYSCPSPDLSCPIPGAGSGSLTSLGLKELLELHRQRLEQSKQHFLLSTPPTPTSCGSISLCHSPTPSSLTVGETSNEAEQDRERDQDQPEEEPEEENTEQDSALQLTTSTSNVIGNLQKWPSANSSLHLLYTNLFRKLGQGKRRRKRGISSGGLSPSEDEDDVDGGVCDISGGDLSDDYDHCDVALRRRSLRSRQPRDVSETDYHGDAEAEAEGETVPRESCYETSDTGGELTNTDDLDSSLNLISNLSYNSSNNSNACNVPGGATAPDARNTATTSTTAPGKSGHALSVQGGRQQPKTGALAQIKPKPKPILMPKHKAQGKGGSLSSPLSNSNSSDCSSASPSAPATLLQLSPVGRSKSFQESAAITAVSRYKKYGRGLFQRRRSKRSPKNAVGVGGKSNYSLDRLSQNIEITIQDEDGNFHPYDDNYHMLAGRLDATDVDDDVGFDDLYLDDRPSGASDDVAFAGDISDGGASSRSRASDASDGHVLGRLLRQVRQGLSVGWRKPRYQKRRARSISEEFSSGDTPRFKDEESASKAESGHGPSSGGAGGGGGSGGAGGSSAAGASASAAGGSSGHYRPDSGSGHKSDKSEKDREKKEKEREEKDIEMIKVFDGNNSFRRQQYRVIIVQRTYTLEQLLTTALRAFHITRDPQAFYLTDLYAPAGMEDTPMLDPTPVLNLVHLEGKRPAIYLRFHDRDRGHVRVYPGKLQCSMLEDPYVSVPVDNSTVIKDLIRDALDKFGLQDNQIQDYRCSEVLLDRGVTERILSWNERPWDIMKQLGKDSIRQMELMRFYMQHKQDPHGPNIALFVGNLPTGLSQRNYEQILNKYVTDENKFISIGPIYYEYGSVVLTFEDSMKAVRAFYNLRETIIEDKKLLVLLLPNIEPSMVPSDVRPLLVFVNVKSGGCQGLELISSFRKLLNPYQVFDLDNGGPLPGYVQPITVFVIRPLIFDSIISLYVFRQITNYKILVCGGDGTIGWVLQCLDNVGQDSECSSPPCAIVPLGTGNDLARVLCWGSGYTGGEDPLNLLRDVIEAEEIRLDRWTVVFHPEDKPEEPAMKAPSQTTGKKKKAHQAHLSQSQQTNQHHQLPALTSSDISGGAQNEDNSQIFVMNNYFGIGIDADLCLDFHNAREENPNQFNSRLRNKGYYVKMGLRKIVGRKAVKDLQKELRLEVDGKIVELPPVDGIIILNILSWGSGANPWGPDKDDQFSTPNHYDGMLEVVGVTGVVHLGQIQSGIRTAMRIAQGGHIKIHLNTDMPVQVDGEPWIQSPGDVVVLKSALKATMLKKNKLKMKRRNTEPTMMVAGSAAPPLSLALPPSVGEVGVAGEGAEGDGGTNNTDF

SEQ ID NO: 18606 - protein, 662 aa, Drosophila melanogaster
MNNSPKDPYRGGGGGSGPQDGAGSTGVSINIESDDNDSTTAEHDYLLPASSSSVTSGGGVGGGGVVSGGSTSTSVNLDHQHVPTARSSSLSGGNVRHGNILSTFLARQRSYTPASNSSSPVRVTTQMNRRLQQSRSMGANTGGSLEEPSSAGAAGGPGASPGTAAGVRQMGFWRVNLNDVFSLSTASSTEALRSFISHSNFRYPPATTAAPAAPGPQPAANPVDNSHILLGQQQPSMPEPVSPLRYGRVSAVSGASSAGAMGRSISLREGEMRHNHSLNGGRHNASAIGLNSNPAAFDEREANESQDLDESDGNVENGGGGGNPPEPAENNPEDEHLISDDMVVQILSHFVRYLPLIFILFFKFLHDHLLGIVDLLVLQTVMYNVNRSVRNQVARLAQKNYAVMVRDTFLVAVVVTVRLFLATSPPDPFGLIVPPSRKSVFIEVTALPFHTSSEGDSPTTSSEPIKTNMYKDTYKSLNVIPLGMLLYYIAVSDLIIKLLTMLVKLIITMLPHHLMRLKVRARLYVLVEYISQFYRAMTPITQWLLFLYESYSGLEVVSGGLFSAMYLGAKIFELVERGKSLKKAIDSERPPTKDELDAAGALCPICHDAFNTPTVLECGHIFCDECVQTWFKREQTCPMCRAKVSDDPAWQDGSTTFFHQLY

SEQ ID NO: 18607 - protein, 366 aa, Drosophila melanogaster
MSVSITKKFYKLDINRTEWEIPDIYQDLQPVGSGAYGQVSKAVVRGTNMHVAIKKLARPFQSAVHAKRTYRELRLLKHMDHENVIGLLDIFHPHPANGSLENFQQVYLVTHLMDADLNNIIRMQHLSDDHVQFLVYQILRGLKYIHSAGVIHRDLKPSNIAVNEDCELRILDFGLARPTENEMTGYVATRWYRAPEIMLNWMHYDQTVDIWSVGCIMAELITRRTLFPGTDHIHQLNLIMEMLGTPPAEFLKKISSESARSYIQSLPPMKGRSFKNVFKNANPLAIDLLEKMLELDAEKRITAEEALSHPYLEKYAEPSVEQTSPPYDHSFEDMDLPVDKWKELIYKEVTNFKPPPSYAQVLKDVK

SEQ ID NO: 18608 - protein, 575 aa, Drosophila melanogaster
MAPTKATTRAAITSGHHQLQQAVNPILGALGAATRKGLTRRAAATGNIDPNVENMQTRAKRKADHSPIKNDKIKRSALGNLTNNVKIMTLHPAQDEEQSGVGKKPTAQQLQALMDAKKQENLSVNVFGASKMTTRASSKVEDSVENCHKVLDKLEEALARPKPRPKAVPAAKKTVLGEVQLPAMPNPMQIPVLLPPTHNLAAPQVAAVKPVRRISNDFNKTEDSLYMSALEDVSSCDSMRLSGNFEAARRRSAKLQQKTEQQPQPLLLTLPETAPSQVVPIPPVPEEVEDFDRKNWDDPFQVSHYAMDIFNYLKVREAEFPIADYMPRQIHLTTWMRTLLVDWMVEVQETFELNHETLYLAVKIVDLYLCREVINKEKLQLLGAAAFFIACKYDERQPPLIEDFLYICDGAYNHDELVRMERETLRVIKYDLGIPLSYRFLRRYARCAKVPMPTLTLARYILELSLMDYANISFSDSQMASAALFMALRMHGGPGQLDKQTWTSTLIYYTGYQLADFAEIVTALNAGLHRKPRATIKTIRNKYSHKIFHEVAKVPLLTNQELFQGNLDLNESNLS

SEQ ID NO: 18609 - protein, 677 aa, Drosophila melanogaster
MGQNFLRRLPANRVASCPWRFAMSKRESKSFASLVLIVLLIFASNPSQCESSKDDFPQAKFEWPSFAWMRNKTTKGTPALDLKNDYSQMELANFGDFDRHPCRRVCQQGQSQNCYYQLVVHNYQRLGPECQRCQFDERACASEHCIYGDGVANPVMAVNRMVPGPSIELCENDTVVVDVLNYLSEPTTMHWHGVHMHRTPEMDGAPFITQYPLQPGEVQRHEFKVDRSGSLWYHSHVGWQRGFGVAGAFVVRQTSQENQHSQLYDYDLVEHTLMIQDIFYEYNLQDVRNILVNGKGRNHLSQLPDNDNRHRYERLRVTPGYRYRMRVILNGIANCPVEFSIEQHRLLMISTDGNDIEPVLADGFFLTSAERFDFVLEANQYKKNYWIRIKGYEQCENRNIYQGAVLSYRGSARSELPQGDILDKPSSRAADEDLILVNDFRFKPANSTAISSLRQSLDKDNNVGTVALRSVDPVPWTRYTKFLTHYSSFGSRTAPNGEVLFQISDISYNSPGISLLQGRHLYQDDRYFCNKSSLAAEGRNCERELCECVNVMRLPAYRPLEMVVANYLDSTHPFHIHGFTFRLVGQGVLGNLNDLRNIQELDRRGRLPRLSEDSAAVAKDTVQIPGQGYIIVRFISNNPGFWLYHCHVEAHAVQGMVAVLKIGEDHQMKNIPARVRC

SEQ ID NO: 18610 - protein, 1150 aa, Drosophila melanogaster
MDDFIKTLIAEVKSQGVFDEFRFNCCLADVDTKPAYQNVRTQVETAVNDFLAKQQWTPETNKVQLRERLRKHLMDSDVLDKGVDQIVDQVVNPKVATIFEPKIESIVYKYLGITPPARPTMLSAPPLPPFGAHLNGSSLLNVETTVGLLPTDLEQISPDSDRATVKSESRDDELPPGVDDEDTSPSYELVSERKTLAIKEELNNVSLNNSDSVNGVSQASQLSQVSSDSRLTMASSTESMVDSHQHTAAHNSGEPENICEEAQMPKFSENSWDASAGTGRSEGRQLHFDIKQDAITFEGTERKNSVSETTSTGLQILSIEDEIMSEVKANIDDANNASIESIAPEPVQVPAPPKVNPPPPPRPASPKVEPPPPAPPGVESPPGPQPPASPRFDPPPPHTIEPPPPPAPPTLVPPPPPAPPTIKPPPPPAPPTVEPPPPPPPAPPTVEPPPPPPPAPTKVEPPPPPAPAEVEPPPPPAPTELEPPPPPAPPKVELPPPPAPPKAEAAITPRRAKGSNGFITELAVTPKESETRDKPHNVNTDVKEDEQPATTEDKQDKPLELGLDAPKDAVSTASESTESPTSTSSQSKSHSKSRDKEKEKDRRHHRHSDDKHRRRSTDRDRDRSRDKSHSKHSSSSSSKHSSSNSSSSKHKSSSSKNDKSSSSSSSRSNRESSSSKRSGTTSSSRHESSSHKKHKSSSSSSRSERDKGKEKDKEREKDSQSRSHHSSSSSSSSSRRKDHDRGRDRDRNKSNTSGSAENKAIHDDHSESKEKYKQRRGSDSNDEGKPPSSGGPAKNSQPEDSAATMKSDAPVENANGTNGNSNGSTNGACDNVSGVVIVSDILQQSTSSFVELTAGSQSHDRAESSKHEPEDIDGKEADNQPEKTELEARQDECASQNEVPTVEPQTLADSVPDLPAKESMDTLEDEKVETNVEENKSEEESKPENPPEECVDEPAQVGDVEDPPQDADKPATPVPISNEQSDEFSADFVTHFEENTDEFRTRLQLINQLIEDRKNLLNRLSEDGTQEEAVDIRALRRSLSKRRRSSMQEQHRVERETTPPQPRSPSSSSTAGSPAKRLRQDEPKSSPTPSDASINSKENEALEKQEHDALSARRLSKKLCQQQRYTNDDLYKPRPILSQRSRRRGLDSIL

SEQ ID NO: 18611 - protein, 1109 aa, Drosophila melanogaster
MDDFIKTLIAEVKSQGVFDEFRFNCCLADVDTKPAYQNVRTQVETAVNDFLAKQQWTPETNKVQLRERLRKHLMDSDVLDKGVDQIVDQVVNPKVATIFEPKIESIVYKYLGITPPARPTMLSAPPLPPFGAHLNGSSLLNVETTVGLLPTDLEQISPDSDRATVKSESRDDELPPGVDDEDTSPSYELVSERKTLAIKEELNNVSLNNSDSVNGVSQASQLSQVSSDSRLTMASSTESMVDSHQHTAAHNSGEPENICEEAQMPKFSENSWDASAGTGRSEGRQLHFDIKQDAITFEGTERKNSVSETTSTGLQILSIEDEIMSEVKANIDDANNASIESIAPEPVQVPAPPKVNPPPPPRPASPKVEPPPPAPPGVESPPGPQPPASPRFDPPPPHTIEPPPPPAPPTLVPPPPPAPPTIKPPPPPAPPTVEPPPPPPPAPPTVEPPPPPPPAPTKVEPPPPPAPAEVEPPPPPAPTELEPPPPPAPPKVELPPPPAPPKAEAAITPRRAKGSNGFITELAVTPKESETRDKPHNVNTDVKEDEQPATTEDKQDKPLELGLDAPKDAVSTASESTESPTSTSSQSKSHSKSRDKEKEKDRRHHRHSDDKHRRRSTDRDRDRSRDKSHSKHSSSSSSKHSSSNSSSSKHKSSSSKNDKSSSSSSSRSNRESSSSKRSGTTSSSRHESSSHKKHKSSSSSSRSERDKGKEKDKEREKDSQSRSHHSSSSSSSSSRRKDHDRGRDRDRNKSNTSGSAENKAIHDDHSESKEKYKQRRGSDSNDEGKPPSSGGPAKNSQPEDSAATMKSDAPVENANGTNGNSNGSTNGACDNVSGVVIVSDILQQSTSSFVELTAGSQSHDRAESSKHEPEDIDGKEADNQPEKTELEARQDECASQNEVPTVEPQTLADSVPDLPAKESMDTLEDEKVETNVEENKSEEESKPENPPEECVDEPAQVGDVEDPPQDADKPATPVPISNEQSDEFSADFVTHFEENTDEFRTRLQLINQLIEDRKNLLNRLSEDGTQEEAVDIRALRRSLSKRRRSSMQEQHRVERETTPPQPRSPSSSSTAGSPAKRLRQDEPKSSPTPSDASINSKENEALEKQEHAV

SEQ ID NO: 18612 - protein, 1105 aa, Drosophila melanogaster
MHPAGEKRGGRPNDKYTAEALESIKQDLTRFEVQNNHRNNQNYTPLRYTATNGRNDALTPDYHHAKQPMEPPPSASPAPDVVIPPPPAIVGQPGAGSISVSGVGVGVVGVANGRVPKMMTALMPNKLIRKPSIERDTASSHYLRCSPALDSGAGSSRSDSPHSHHTHQPSSRTVGNPGGNGGFSPSPSGFSEVAPPAPPPRNPTACSAATPPPPVPPTSQAYVKRRSPALNNRPPAIAPPTQRGNSPVITQNGLKNPQQQLTQQLKSLNLYPGGGSGAVVEPPPPYLIQGGAGGAAPPPPPPSYTASMQSRQSPTQSQQSDYRKSPSSGIYSATSAGSPSPITVSLPPAPLAKPQPRVYQARSQQPIIMQSVKSTQVQKPVLQTAVAPQSPSSASASNSPVHVLAAPPSYPQKSAAVVQQQQQAAAAAHQQQHQHQQSKPPTPTTPPLVGLNSKPNCLEPPSYAKSMQAKAATVVQQQQQQQQQQQQVQQQQVQQQQQQQQQQLQALRVLQAQAQRERDQRERDQRERERDQQKLANGNPGRQMLPPPPYQSNNNNNSEIKPPSCNNNNIQISNSNLATTPPIPPAKYNNNSSNTGANSSGGSNGSTGTTASSSTSCKKIKHASPIPERKKISKEKEEERKEFRIRQYSPQAFKFFMEQHIENVIKSYRQRTYRKNQLEKEMHKVGLPDQTQIEMRKMLNQKESNYIRLKRAKMDKSMFVKLKPIGVGAFGEVTLVSKIDTSNHLYAMKTLRKADVLKRNQVAHVKAERDILAEADNNWVVKLYYSFQDKDNLYFVMDYIPGGDLMSLLIKLGIFEEELARFYIAEVTCAVDSVHKMGFIHRDIKPDNILIDRDGHIKLTDFGLCTGFRWTHNSKYYQENGNHSRQDSMEPWEEYSENGPKPTVLERRRMRDHQRVLAHSLVGTPNYIAPEVLERSGYTQLCDYWSVGVILYEMLVGQPPFLANSPLETQQKVINWEKTLHIPPQAELSREATDLIRRLCASADKRLGKSVDEVKSHDFFKGIDFADMRKQKAPYIPEIKHPTDTSNFDPVDPEKLRSNDSTMSSGDDVDQNDRTFHGFFEFTFRRFFDDKQPPDMTDDQAPVYV

SEQ ID NO: 18613 - protein, 444 aa, Drosophila melanogaster
MGTATQFIVGFIGALGAFCLGAVIGWSGPVENEVKNSNAYNFTPRQTEWGLVGSLMTLGAAFSCIPVGVLIGKIGRKTTMLILLPPFFIGWLLILLASHIAMLLLGRFVVGFCGGAFCVTCPMYVTEIAQVQYRGTMGCFFQLLIVFGILYAFVVGGFVKTFYFNIACAILPVIFFVLMIFMPESPIFLAQKGKAEKAEKSLKFLRGKDADVSGELKEMSAEGQKEKASVGKILCRRITLKGLFLSIGLMLFQQMTGINAIIFYSTFIFETAGSTLEPRISTIIVGIVQAIATIISILVIEKVGRKILLLVSACMMGISTLIMALYFGMLMKSGVGWLALIAVCVFIIGFSLGFGPVPWLMMAELFAEDVKALAGSIAGTTNWCFAFIVTLLFPVLNDIIGATACFAIFFGFAVAAFVFILFLIPETKGKTLNEIQAKMGEKAE

SEQ ID NO: 18614 - protein, 248 aa, Drosophila melanogaster
MSTVDKEELVQKAKLAEQSERYDDMAQAMKSVTETGVELSNEERNLLSVAYKNVVGARRSSWRVISSIEQKTEASARKQQLAREYRERVEKELREICYEVLGLLDKYLIPKASNPESKVFYLKMKGDYYRYLAEVATGDARNTVVDDSQTAYQDAFDISKGKMQPTHPIRLGLALNFSVFYYEILNSPDKACQLAKQAFDDAIAELDTLNEDSYKDSTLIMQLLRDNLTLWTSDTQGDEAEPQEGGDN

SEQ ID NO: 18615 - protein, 248 aa, Drosophila melanogaster
MSTVDKEELVQKAKLAEQSERYDDMAQAMKSVTETGVELSNEERNLLSVAYKNVVGARRSSWRVISSIEQKTEASARKQQLAREYRERVEKELREICYEVLGLLDKYLIPKASNPESKVFYLKMKGDYYRYLAEVATGDARNTVVDDSKNAYQEAFDIAKTKMQPTHPIRLGLALNFSVFYYEILNSPDKACQLAKQAFDDAIAELDTLNEDSYKDSTLIMQLLRDNLTLWTSDTQGDEAEPQEGGDN

SEQ ID NO: 18616 - protein, 133 aa, Drosophila melanogaster
MSTVDKEELVQKAKLAEQSERYDDMAQAMKSVTETGVELSNEERNLLSVAYKNVVGARRSSWRVISSIEQKTEASARKQQLAREYRERVEKELREICYEVLGLLDKYLIPKASKLFRLLLRNYQFTSEGLSLS

SEQ ID NO: 18617 - protein, 354 aa, Drosophila melanogaster
MGCTTSAEERAAIQRSKQIEKNLKEDGIQAAKDIKLLLLGAGESGKSTIVKQMKIIHESGFTAEDFKQYRPVVYSNTIQSLVAILRAMPTLSIQYSNNERESDAKMVFDVCQRMHDTEPFSEELLAAMKRLWQDAGVQECFSRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 18618 - protein, 354 aa, Drosophila melanogaster
MGCAQSAEERAAAARSRLIERNLKEDGIQAAKDIKLLLLGAGESGKSTIVKQMKIIHESGFTAEDFKQYRPVVYSNTIQSLVAILRAMPTLSIQYSNNERESDAKMVFDVCQRMHDTEPFSEELLAAMKRLWQDAGVQECFSRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 18619 - protein, 113 aa, Drosophila melanogaster
MADDPENSVDRPTDDGDAGKPEKMFTLKKWNAVAMWSWDVECDICAICRVQVMDSCLRCQADNKRDVMGRQDCVVVWGECNHSFHHCCMSLWVKQNNRCPLCQQEWSIQRMGK

SEQ ID NO: 18620 - protein, 857 aa, Drosophila melanogaster
MSGRDNRGAGGGGGGHQPLSNAMGKLKEKLTRVGDELGYHRVESNLSTSNTATSLDTILPEDPFLFPQVSPQRHPQNTVRTQRLLEDEPPLSFRPLLEDDDINEPPTQQQQRTPLRASGSLELTPLPPPPTSLEIREHRDRQQRGAQGDELQRSKQSLKGSRVSFERRDTGNSNTNSNKAAESSDEDSFEEKRTGFQQQKATSVDHKGILKDLKHILANDNRRQFQAKKHVSLDVKGTRFLQDLLKESSSEEEFHKTRREFQGRKHQSLDPRVTFKLDKVLQGSSTDSDEEGEDAEHKRLIHRPKDITKPVIIDLKDLESESDEDFLTSRQHFQQQRSISTDSRKSRRLYEMDEMDNKRGENIRHAVPFVRQITEDGKPKLEVYRPTTNPIYIWTQVLAALSVSLGSLVVGFVSAYTSPALVSMTDRNITSFEVTQDAGSWVGGIMPLAGLAGGIAGGPLIEYLGRRNTILATAVPFIVSSLLIACAVNVAMVLCGRFLAGFCVGIASLSLPVYLGETVQPEVRGTLGLLPTAFGNIGILLCFVAGSFMNWSMLAFLGAALPVPFLILMFLIPETPRWFVGRGLEERARKALKWLRGKEADVEPELKGLMRSQADADRQASRNTMLELLKLNNLKPLSISLGLMFFQQFSGINAVIFYTVQIFKDAGSTIDGNLCTIIVGIVNFLATFIGIVLIDRAGRKILLYVSDIAMVLTLFVLGGFFYCKTYGPDVSHLGWLPLTCFVIYILGFSLGFGPIPWLMMGEILPAKIRGSAASVATAFNWFCTFVVTKTFQDLTVAMGAHGAFWLFGAICFVGLFFVIIYVPETQGKTLEDIERKMMGRVRRMSSVANIKPLSFNM

SEQ ID NO: 18621 - protein, 489 aa, Drosophila melanogaster
MKILMRADTHVSFSVPVEEPKAICTFSQVLAALSVSLGSLVVGFVSAYTSPALVSMTDRNITSFEVTQDAGSWVGGIMPLAGLAGGIAGGPLIEYLGRRNTILATAVPFIVSSLLIACAVNVAMVLCGRFLAGFCVGIASLSLPVYLGETVQPEVRGTLGLLPTAFGNIGILLCFVAGSFMNWSMLAFLGAALPVPFLILMFLIPETPRWFVGRGLEERARKALKWLRGKEADVEPELKGLMRSQADADRQASRNTMLELLKLNNLKPLSISLGLMFFQQFSGINAVIFYTVQIFKDAGSTIDGNLCTIIVGIVNFLATFIGIVLIDRAGRKILLYVSDIAMVLTLFVLGGFFYCKTYGPDVSHLGWLPLTCFVIYILGFSLGFGPIPWLMMGEILPAKIRGSAASVATAFNWFCTFVVTKTFQDLTVAMGAHGAFWLFGAICFVGLFFVIIYVPETQGKTLEDIERKMMGRVRRMSSVANIKPLSFNM

SEQ ID NO: 18622 - protein, 488 aa, Drosophila melanogaster
MKILMRADTHVSFSVPADGLKANFTFSQVLAALSVSLCSLVVGFVSAYTSPALVSMTDRTITSFEVTKDAGSWVGGIMPLAALAGGITGGPLIEYLGRRSTILATAVPFIVSSLLIACAVNVIMILCGRFLTGFCVGIASLSLPVYLGETLQPEVRGTLGLLPTALGNIGILVCYVAGSFMNWSMLAFLGAALPVPFLILMIIIPETPRWFVNRGQEERARKALKWLRGKEADVEPELKELMQSQADADRQATQNTCLELFKRNNLKPLSISLGLMFFQQFSGINAVIFYTVQIFKDAGSTIDSNLSTIIVGVVNFFATFMGIILIDRLGRKILLYVSDIAMIVTLSILGGFFYCKAHGPDVSHLGWLPLTCFVIYILGFSLGFGPIPWLMMGEILPAKIRGPAASVVTAFNWFCTFVVTKTFQDLTVAMGAHGAFWLFGAICIVGLFFVIIFVPETRGKSLEEIERKMMGRVPMSSVVNIKPFPFNM

SEQ ID NO: 18623 - protein, 433 aa, Drosophila melanogaster
MTDRTITSFEVTKDAGSWVGGIMPLAALAGGITGGPLIEYLGRRSTILATAVPFIVSSLLIACAVNVIMILCGRFLTGFCVGIASLSLPVYLGETLQPEVRGTLGLLPTALGNIGILVCYVAGSFMNWSMLAFLGAALPVPFLILMIIIPETPRWFVNRGQEERARKALKWLRGKEADVEPELKELMQSQADADRQATQNTCLELFKRNNLKPLSISLGLMFFQQFSGINAVIFYTVQIFKDAGSTIDSNLSTIIVGVVNFFATFMGIILIDRLGRKILLYVSDIAMIVTLSILGGFFYCKAHGPDVSHLGWLPLTCFVIYILGFSLGFGPIPWLMMGEILPAKIRGPAASVVTAFNWFCTFVVTKTFQDLTVAMGAHGAFWLFGAICIVGLFFVIIFVPETRGKSLEEIERKMMGRVPMSSVVNIKPFPFNM

SEQ ID NO: 18624 - protein, 353 aa, Drosophila melanogaster
MECCLSEEAKEQKRINQEIEKQLRRDKRDARRELKLLLLGTGESGKSTFIKQMRIIHGSGYSDEDKRGYIKLVFQNIFMAMQSMIKAMDMLKISYGQGEHSELADLVMSIDYETVTTFEDPYLNAIKTLWDDAGIQECYDRRREYQLTDSAKYYLKDLDRVAQPAYLPTEQDILRVRVPTTGIIEYPFDLEEIRFRMVDVGGQRSERRKWIHCFENVTSIIFLVALSEYDQILFESDNENRMEESKALFRTIITYPWFQNSSVILFLNKKDLLEEKIMYSHLVDYFPEYDGPQRDAITAREFILRMFVDLNPDSEKIIYSHFTCATDTENIRFVFAAVKDTILQSNLKEYNLV

SEQ ID NO: 18625 - protein, 353 aa, Drosophila melanogaster
MECCLSEEAKEQKRINQEIEKQLRRDKRDARRELKLLLLGTGESGKSTFIKQMRIIHGSGYSDEDKRGYIKLVFQNIFMAMQSMIKAMDMLKISYGQGEHSELADLVMSIDYETVTTFEDPYLNAIKTLWDDAGIQECYDRRREYQLTDSAKYYLSDLARIEQADYLPTEQDILRARVPTTGILEYPFDLDGIVFRMVDVGGQRSERRKWIHCFENVTSIIFLVALSEYDQILFESDNENRMEESKALFRTIITYPWFQNSSVILFLNKKDLLEEKIMYSHLVDYFPEYDGPKQDHAAAKQFVLKKYLACNPDPERQCYSHFTTATDTENIKLVFCAVKDTIMQNALKEFNLG

SEQ ID NO: 18626 - protein, 321 aa, Drosophila melanogaster
MRKLTNSCALRKKDLNGNSNYCYWVRGVGCIGMYQGYNVRISTGACESGKSTFIKQMRIIHGSGYSDEDKRGYIKLVFQNIFMAMQSMIKAMDMLKISYGQGEHSELADLVMSIDYETVTTFEDPYLNAIKTLWHDAGIQECYDRRREYQLTDSTEYFLGDIGRIEQADYLPTNQDILRAREPTFNITVYPFELDGYVLSMVDVAGQRTERRKWIHFFSNVTSIIFLAALSEYDQFMMESENDNRLEESKALFHTIITFEWFKNASIILFLNKMDVLEEKIMYSHLVDYFPEYDDTENIKFVFAAVKDTILQCNLKESNLF

SEQ ID NO: 18627 - protein, 340 aa, Drosophila melanogaster
MRKLTNSCALRKKDLNGNSNYCYWVRGVGCIGMYQGYNVRISTGACESGKSTFIKQMRIIHGSGYSDEDKRGYIKLVFQNIFMAMQSMIKAMDMLKISYGQGEHSELADLVMSIDYETVTTFEDPYLNAIKTLWHDAGIQECYDRRREYQLTDSTEYFLGDIGRIEQADYLPTNQDILRAREPTFNITVYPFELDGYVLSMVDVAGQRTERRKWIHFFSNVTSIIFLAALSEYDQFMMESENDNRLEESKALFHTIITFEWFKNASIILFLNKMDVLEEKIMYSHLVDYFPEYDGPKQDAYAAREYVLRMFQSISLDTYKKIYSHFTCATGKCIVLIYLA

SEQ ID NO: 18628 - protein, 534 aa, Drosophila melanogaster
MDIGTIELSVEALIGSLLALSILFAFCRSLLSEDFVSTFKTRHSWKSIKVLEQACFCNVCEILLTPSAGLFCDCCGLCTHATPPCQRRADREYRCKDKWLRNESSVRHLWVHGNLPMGVHCADCNEEVDHHVSTDPGLYGWRCAWCQRCYHNDCYTRADSMEACDLGEFKDMIFPPYSFVAARTRDSMRLHLASITPPDIENWEPLIVIANTKSGSSTGANVLSLLRGYLHPLQVMELGSRGPQDALQWAAKASPRPCRILVAGGDGTIGWVLNTIYTLNIKPQPSVAIMPLGTGNDLSRVLGWGAEPPSVLDPVKILRSIRRARSVNLDRFDLQIEKLHYRLPIQRHPTKTIHVYNYFSVGVDAYITYNFHKTRESRFYLLSSRIFNKLLYFTFGTQQVMQPGCEHIEEKLTLYLDNKPVQLPELQALVFLNIDSWGAGCKLCELSNANGEVRIVNSISDGMMEVFGIVSSFHIAQLQCNISKPVRIGQAKQIRLQVKETVPMQADGEPWMQSPADIRLSSRSQARVLKLAAT

SEQ ID NO: 18629 - protein, 860 aa, Drosophila melanogaster
MTLETQPVGGVSDGKIAGLYDLEETLGSGHFAVVKLARHVFTGAKVAVKVVDKTKLDDVSKAHLFQEVRCMKLVQHPNVVRLYEVIDTQTKLYLVLELGDGGDLYDYIMKHDSGLSEELARKYFRQILRAITYCHQLHVVHRDLKPENVVFFEKLGLVKLTDFGFSNKFLPGQKLETFCGSLAYSAPEILLGDSYDAPAVDIWSLGVILYMLVCGQAPFEKANDSETLTMIMDCKYTVPSHVSTDCRDLIASMLVRDPKKRATVEEIASSAWLKPIDEPDSTTSTSEHFLPLVSREQLGEEDHAFIIQKMINGNIASKEEILQALDKNKYNHITATYFLLAELRLRRRREELAQKQRLLNDASMKVGDASRKLVPEKPSPTEAQKGGVPISINVTPAAQFANDGGKPDKRSRKCSIVREEDEEESATECTAVGNELKVTSSSRREAFSDSPFSRSIHERSSSEPGNQTKGEQIANSGVPSHSRTKIVVSVDATLAHKLKQMEKSAKIDEDTLSGLKELEIGKLKPLPSSSKNPVLTHRRTKLNKIRTPSCSSSEASDDDTKTRNKKKINKFVGDTPVRFRMHRRDSHDDSSDSQDQLYPPPGSASNAGNFISKSGSVSGKKEGQSQYKEPNNKSDENRKSHSQKNRKQHNKDHVDKHSHAERQLADSSTATTGNSTNRRRRIRESQSLDRITEAQEYEMRHRCYAESEAASSSSSSTQHIDQRYSLLSLNTSTFSVAETKEEYDEEADATNATDQIMNTLNAAKATLQQEQYFNNNTNLSRNFNHNHNQSIIHISSQKANGKKSNETPKDIYNLNSIEHIDLILEDKSLTKAIHVTGSKCFVTMKKIRRLGKYFPVMNFS

SEQ ID NO: 18630 - protein, 415 aa, Magnaporthe grisea
MSDLQGRKIFKVFNQDFIVDERYTVTKELGQGAYGIVCAAVNNQTSEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMAKKPFPTLFPNANPDALDLLDRMLAFDPSSRISVEQALEHPYLHIWHDASDEPDCPTTFNFDFEVVEDVGEMRKMILDEVYRFRQLVRTAPGAGGHGAPHAPQVPIPAGAGQGQWKAEDPRPQEYVGQMNDLEAELAGGLDQRR
